United States Patent 7,868,149 (PLANT GENOME SEQUENCE AND USES THEREOF) - sequence listing, part 65

SEQ ID NO: 35243 - DNA, 15234 bp, Oryza sativa
aaagaatattgtatagtactagaatcgtgtttgcaagaatagccctgagcaactaatgtctttaaatgctgtttactgcaaccctaaccctttatagtgtaactcctttgtactcctttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacacctgctgcttgtcatatttcttctaatacttatcgataatcttagtcgaattcacttgaaaacctctagctcttcctgcatcggcagttcgtccagcaatgtgtaccatattgatgggaaaaggattgcaatcgatcttcatcggcctcttggagtcatcaaacttgattttgcctcctttaatagctgcttggatctgctatctaaagacattacaatcattggtagaatgagacccagaattatgccacttgcaatacctcctcttgcctaactcctcagccgatgggattgtgtgcccagcaggaagctgaatctgtttctccagaagtagaaaatcaaagatcttatcagcctttgtgatatcaaagtcatatctttcttcttttccagaactcttcacccattggcatggtataaccttcttgcttctaacccattcggctgctgctatctcagaatcatcatcatcatcatcatcatcagatccatacatatagggacatacatgattgaccttcttaaagcttttcctggcttctgcaaacatctgctcatgcaaggttaccttctgtacaagatgtgacaaactatcaaagtccttggatgagaactttttcctgattggagctgccctgaaaagccaaatcggctaactgagcatcagttaagctcaagctgtagcacttattcctcatctttatgaacgtctgaatgtagtcctgcacaggctcatcatgcctttgccgaatcgctgttaaatcagacaatttcatctcatgaaccccactataaaaatagctatgaaaatgcttctccaaatcggcccaactgttgattgatccacatggcaaagaagaacaccaagtaaaagccgatccagacaaagacaatggaaacaacctaaccctcagagcatccacagccgatgcttcaccacactgagctaagaatcggctaacgtgctcataggttgaaacgctgtcctgtcctgagaattttgaaaaatatgaaaccttgaatcggttaggcaatggaaccctctcaaaccactcagcgtacggatgccgatacaggtttccagcatccttcggcttgagcccaaactgctctctcatcacatctgcaatcatatcggcccatggtctttgctgaggcactccctgcgcttgttgtggcattggctcgaattgattgtattgaggagcgaactggggctgagtcgaccccccttactgatattgaacttgtggtgatggaggctgatactgataattcaaattgcccccttgataattctgaaagtttagttgtatattacgcaccaaatgttcgggaataacttgaggtaccaccattttatctggttgcacattatgaaccaaatgctctgggacaacttgattcgcagcgtgctgtcttagctaattgtcaggtgttccgaacccagccgatgcattcaccaaaccttgatgctgaatcggctgaacaacctgttgcctcggtcttgtctgctgaatcggctacacaacctgctgtcttggtggcatctgctgaatcggttgttgctagattgtgtcaacagtaggctgagctggtaagaacatagcagcaacttggtcttgagttagccgattcacattttgtccattatgctatggctgttctctcaccaacaaccaaggattaattagttgacctggtgccgatgatggtgcagccggtgcaggagccgagactggtgctgtcggttgagccgatggtgcactgtgaggaattggctgaacagctggctgattattagtgaccaagggccgatagtttgggaaaacacctcctggcaaataaaccggtcctgtagcctgatactcagctatcgagcaatcaaccatcgacttcaccatgtttgacaaagtattgactaacacccaagattgattaattaaagcatgttgcacggcatagtcaatcctatcctggaagttgttaaattgtagctgtgccgtgttgccatcttgattatgattctcactgaaagtgcatctaggacccctcatttattttggtgttaatgacaacacaattagagggtaactaatgctttttgttgagacgtatgcaaggatgaaaaagtagtggatgtcaacacaataagtattgcggcatcttttgtggtaattgtcttctaatccatgcatatcttgtgttcttgagtattaggatgccgtactattaagaggaatgccacatgcatataattggtagaacactagtgctcaaaatcatttatttgaagtgttcctgttttatgtctgtcggactatccgatgttgattagactatccgaaatttcacagaactttgctcactgtcttgggtctgagtgttggctaaaaaatatcggactatccgatataaggtcggactatccgatacgtcggactatctgaaatttctcagaacttcactctctgttttgaattgctttttattccttttgagtgagttttaaatcagactatccgatatgatcggagtatctaatgatccagagactaagaaattcaatggaacttgagtctctgtgagaggatgaaattcttggttcaaaaataacggaatatccgatatgacatcagactatccgatcgattggattgtccgaaattctctagaatttcgttctctgtctctggcctgcttgggggtcaaaaacatcggactatccgatgtcacctcagactttccgaggtgggatgaaaagattctctcccaacggccacattttgggggcttctatgaataccccccacctaacccttttctagggttacccaactcattcattcacattcactttgggttgagcttggtgctaaggtgctttggatctttgagctctctctccctctctcaaatcccctcttgttctttgtgtggtcgatcttggtggttgtggatttggggtttgagggcctagtgtgtgtttcactcgatcttgagcactagggttgaccaagagttgtgtgatgtttgttactcttggaggttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcccctcaaggatttgaactccgggaagaactcggtgaacttcattgttggtgatatctcttcttccattatttagctttgttttttgtgccgctataaatctagtcgctgtttgggccatactcttgtttgtgcactagatctacttgtagtgttcttttagtggatcagacagtctgatccaacatcagactatctgatattttcggatagtctgactgtggatcagactatcagttttagcttcggcataaagttttaaattagcctattcaccccccctctaggcctaattgaccttttcaattggtatcagagcctaatctccaaattaggcttaaccgcttggagggatcatgtcgggccaaatgggggaaggcaaagatggtgataagggagctaagtttccttatcactatccaactacatccacatcttatgtgagtacctatagcagcaaagctccgtacttcaatggtacggactatgccgcttggaagcataagatgaagatgcatttgaagtctattaacccatctatttggagaatagtcgaaaaaggctatgttttgcagaatcccgaagatcccaccaaggaggacgacgagaataagcacaagaacgctcaagccgccaatgcaatacttagtgccttgagtggaagtgagttcaaccgtgtggatggcattgagagtgccaaagtgatttgggacacgcttcggaacttgcatgaaggcacggatagtgttcgtgagtccaaggtggagatcttcaaggggcaatttgagagatttgtgatgttggatggtgagagcccaagtgacatgtatgaccggttgagcaagatcgtcaatgagatcaagggacttggctccaaggacatgaccgatgaggttgtggtcaagaagatggttcgagcaatcactccaaggaactctaccttggttaccatcattcgtgagcgtccggactataagactctcacacctcatgatttgctcggacgcattcttgcccatgacattcttgtgcaagagtccaaggaggtcatccaatacatcaaccaaagctcaacgacaagcatcaagaaggaagacttggcattgaaggcaaaggaagaagaagaagagagccacaagagcaagagcaaggaggagatcgatgatgaagaaatggttctcttcgtcaagaagttcggcaagttcatgaggcgaagcggcttcttcaagggaaattcttccaagcatcactccagcaagtcaagtggaagacattccgcaagagtgtgctacgtgtgcaaagagcccgggcacttcattgcggattgccctcacctcaaggatggttcccacatcaaggaagataagaagaaggatgagaagaaggagaagtataagcatagcaagcgggaacattatggccaagctcaccttgggatgattttcagctccgactccgagtcaagctcaagtgatggagaaggagtcgccacgttcgccgtcaagccttcatcaccaccaagactcttcgactactaaagtgatgaggatgctcccatttgcctcatggcaaaggagcctaaggtaccttctcctctcaagtcatttaatgttgattttattagtgacgaggaggatgaggttgaggatgaagttatggatgatgagttgcttaaatccataaccaaggaatctgtcacaccctgatttttgtttcaggatttataaattatttaataaattattatcagaatttatattaaatgttcattaatttacaagtgaagttaaatgtgggaaataaaatttcctaaatataaagcatggatggatttaatttttattaaattcttcatggttaattatactctctggaattttctcagatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataatttaaagatcatttaagtgattattttaattgggaaagtaataaaatcctcctcctcagcttgggccattttcagcccattccttcctttccttcctctctcttccgccggcccaacctgagccgcctcctctcctctcagcctagccggaaaagtctattttccctccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaacagccgccgccggccatctccagtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgagcttgccatccgagtcggctgccattgatgacgtcagcatgacgtcatcggtttttctttttcccgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaaggccgattattgcaaggcaagtcacacagatcctaaacacaatcctttgagcatattgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttcataatggtgggttgtgagcacatggttttgagagtcgtgctcctgacaattaaggaccggttcgcgagctactgttgtgaaacattaaccgtaccaaccacaagccagcatgggcaacggctttatcttttgtatagcatgattcattatagtgcgccagactgagaagtggcgagaagtccatgggggtcgctggggagtccatgccttgtttataagggggtgattatgatccaggaacggtgcactgttttgagttgtgttgtgcgaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagaatccataccacacttgagtgagttgcttgggagaattgaggatcaatatgcaacacttgagaggcaagaggaattgctcattcatgagaaagagcgatctcatgaactcaagtgcgaacttgctaaggagagagaaaaatgaggctttggtacggctttacaagcaaaccaaagagtctcatgctaatcttgaggtggcaaacgctcaacttcaagagagagtggatggcttggataaagcttacctctctcttgaagagaagtttgaaaccttaaagaatagtgtctctctccctagcaaggcatcatgctccaaaattgccccaagcaatgaaccttgtgcaagatgcaaagatattgatattgaagcttgtgctactaactctatttccttgagtgctttgcaaaagcaaaatgagaagcttatgggactccttcacaatggcctacttaagtgccatatgggtagtaaggccctaaaagagtacctaggctatcaaagggacaacttcaaccatgagggtcttgggtatgttcctccaccaaaaggaaaggtggacaagagtgtgatgatcaagaggccccaaggtcttagcaactttgttagggccaaaagtatccttcctaatgattgtgcttcacattgttcttttgatgcatcttatgttcttaggaagaatgctagtggtcgtgttgttgctaagtatgtaggcccaaggggcaagaatatttctatcaagagagttctttgggtgcctaaggcacttgttactaacatgagaggacccaagcaagtatgggtacctaaaactagaaattgatcccttgtaggaatatgtcactggtggaagaagttgggtgattgatagtggatgcaccaatcacatgaccggagaagaatcaatgttttcatctcttgatccaaatggcacttcacaagataacatagtcttcggggacgatggaaagggaaacgttatgggattgggtaagattgcaatctctaatgatctttctattgccaacgttctcttggtaaaatctctaaactacaatcttttgtccgtttctcaattatgttctatgggttacaattgtctttttaccgatgttgatgtgaccgtctatagaaggaatgattcctcggtagtctttaagtgtgttctcaagggaaagctttaccttgtgaattttcctcaagtaaagccaaacatgagacatgcttagtggctaagtccaacacggggtggctttggcatcggaggctagcccatgttggtatgaggaatcttcacaagcttctaaagcacaatcacatccttggactaacaaatgttcaatttgagaaagatagggtgtatagcgcatgtcaagccggcaaacaaattggagcacatcaccccgtcaagaatgtgatgaccactacaagaccattggagcttctccacatggacctcttcggaccaattgcttatctaagcattggaggtaacaaatatggtcttgttattgttgatgactttttacgcttcacgtgggtgttctttttgcatgacaagagtgagacacaagctatcttcaagaagtttgcaagaagagcacaaaacgagttcgacctcaagatcaagaacattcgaagcgacaatggcaaggagttcaagaacacgtgcatcgagagtttccttgatgaagaaggcatcaagcatgagttctcggctccatattcacctcaacaaaatggagtggctgagaggaagaataggactctcattgagatggcgaggaccatgttggatgagtacaagacatcggaccgtttttgggccgaagccgccaacaccgcatgccacgccatcaaccgcctttatcttcaccgccttcttaagaagactccctatgagcttcttaccggtaataaaccaaatgtctcttactttcgtgttatcggtagtaagtgttacattcttaataagaaggctagatcctctaagttcgctcccaaagtggatgagggattcttgcttgggtatgggtcaaatgaatgcgcataccgtgttttcaacaaaacctccggtattgttgaaatcgcgcgtgatgtgacatttgacgaaactaatggctctcaagtagagcaagttgactcacatgtgttaggtgaagaggaggatccaagcgaagcaatcaaaagattggctcttgggaacgtgcgtcctagggagccaagcctcttcctcaacacaagtggagccacctacatcaacccaagccgacgttccctctacctcaagcatggatcaaggtgaagaaggcgagcaagtgccaccctcaccgatcaacttagctcgcccaagaatccaccaaagtatccaaagagatcatcccaccgacaacatcttaggagacatcaacaagggagtatccactcgttctcgtattgcaaatttttgtgagcattactcgtttgtgtcttctcttgaacctctaagggtggaagaagctctaaatgatccggattgggtgatggcaatgcaagaggagttgaacaatttcacccgtaatgaagtgtggactttggtggagcgacctcggcaaaatgtgattggcacaaagtggatcttccgcaacaagcaagacgaggccggggtcataataaggaacaaggcgaggttagtggcgcaagggttcacccaaatcgaaggattagatttcggtgaaacttttgcgccggtagctagacttgagtcgattcgcatattgcttgcttttgctactaacctcaattttaagctatatcaaatggatgtcaaaagcgccttcctcaacgggcctatcaacgagttggtatacgtggagcaaccacctggcttcgaggatccgaagtatcccaaccacgtgtacaaactccacaaggcactctacgtgcttaagcaagcccctagagcttggtatgagtgtcttcgcaattttcttgtgaagaacggctttgaaatcgggaaagccgattcaactctttttactaaaagacatgataatgatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaatcaagcaactcaaggaaggaactttcatttgccaaacaaagtatttgaaggacatgctcaagaagtttggaatggagaatgcgaagccaattcacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgcaagatttcaagccgctccgaaggtgtgtcaccttgtggccgtgaagagaattcttagatatttagtgcacacacctaatcttagtctttggtatcctaagggagcgaggtttgatctcattggttatgccgatgcggattatgccgggtgcaaagtggataggaaaagcacatcgggtacttgccaattcttgggtaggtcccttgtttcttgatcttccaagaagcaaaactccgtcgccctatccaccgccgaagcggaatacgtttcggcggggagttgttgtgctcaacttctttggatgaagcaaaccttgagagactatggcctaaatgtgtccaaaatcccactcctatgtgacaatgagagcgccattaagttagccaataaccccgtccaacattcccgaaccaagcatatagatattcgccaccatttcttaagagaccattccacaagaggcgacatagacatccaacatgtaagaaccgacaaacaattggtggatatcttcaccaagcctctagatgaagctaggttttgtgagttgagaagtgagctaaatatcttggattctcggaatgtggcttgatcttttgcatgcatttgtttttcatttactagaataggtttgcttgccacatcatgacaaagtgaacattcaattcatgaataaacactagtcataatctatgaggataacttgaatctatgtgtacggggatctcattctctaatgaatcttggtccttgcacaatttcctatagattcgtacattccctctcttgagggtgcctagttttctttcttttgctgcatttgtccaagtaatagtctagccgagttcatcctataaaaatgttgttgaaaaaaaaaatcttccttgagccatcctttattgtctctgccacaaaggatgtcggactgtctgacatcaagtcagactatccggccacaatcggacagtccgatttcaaatcggactatccgacgtggggccaagggcaaggggacttaacctccccgggggtaactctttttttttaccccttcagtcatttgtctcagtcgtttctctctccacccctcttctcctctcaaaaccctagttctaggccaccaaaaatcttcgtttcagagtctctgattgctattccttctctttagggtggtttccctccctcaactccttccaaatcacttgttccccagtgattctcttggtggttcttgaggtatttccttgtttttcctctatctccctcatggtatattatttcaagatttccttcggtgaatcttcttgttttagtgcctagatctagtacctagaagatcctttgattccattggatatttttgtgtgaatcgagatttgttggtctagggcaaaaggccgtcggattgtctaatatgccgccggatagtccaatgtacatcagatagtccgacgtcaaatcagactatccgacctccttttggcccagtccaaatttctccttgcttcacatttaaatattcttcttccacttcttcttaatcattatcctctgttctaaatcagtgtatcctcatgatcaaggatcagttcaagaatcaagtttactctcgccgtgggtcaatgagttctcgaggtcgctctccctcttccaaggctcgtcatgctatacggcgtatgtctgaatcccgcaaagataccattgacgcgcaagctcaagcctctgaccaagcagctcaagtggctaatgtggagcgtggtgctcctcttcctcctcgccgcagccgagttagtggagaaggatcaagtgcacctgctagcaaagtaaggagaggcaatcctacggattcttctgagcctggtcaaggtagtggttctcatgcaccatcctttgaggaagagattcagttagaagaggacattgccgctcagcaagccgctcaggaagaagggcctttctttatcactgctccctctagagatcctaattatcatcggagagtcataaggtggaaccgcaagtggactgaattggagaaagagcgtaagaaagatccctacaaatttcaacagttgtccaccgatcctcggttttggaacctttttcagcaggattactatgagacagtgattgcacctaagaagggggctattcttatgcagtgggttgattggaagtatatggaggagttgcatgatccaattattgatgaagtcattgaagcttgtgctcggcaaaacttgaaggaattcatgggcttgcaatacccatggtgcaaagaaatcattgcacaattctatgccatagtttactttgagcccaacaaagaaaagactattcattggatgacagatggcactatatacttagtgacatatgccaagtttgctgccattttggggtttccggctcgctctcgcaccaatcgtgtcaagattaatgctgagaagcccatggacacaaattctcttcacttcttgtaccaagatgtggactatgagttaggcaccatcaaaggtctccttcccttctatgcctatctcaacaagctcttgcgcaaaactctcaatcccaaggaaggtgatgctagcaacgtccttgcctatacaagaaatttgctttacaagatgaaggctcacccacagctctttgacgcctttgacttcatctttgaagaaatccggcttatctccatgatgcctaagccctaagcgaggacttggctatgggccttacattatgaagatgattgagattatgtccaagaagaagtttcacaaggaggtggcacataccggttaccatgtccgtcccatcaaggctgctgctgtgccggctggacaaaccactcgtgcttcttctcgtgccggtccctccgctaccgtcaccaagccggattccaactcgtccttgaggttcttcaagtccatcttcaacttatgcaagaccatcttagcttggcaagccaaggaacgcagagcaaggaagaaggacactcgacggatcaagaacctccttcgcaacgcccatttgccgtgttcccccgatggttctgaggttgaggacagtggggaggatgtgattgaggacccgtttgcagctgaggcaagctcctctcgtgcggatcgtggcaaggctcctatggaggaagaagaagaggaggaggaaggtgactatgctaaggagtcaagtgaggagggcgaggattctaatgaggatgagtgatcctctttttcccttttggtgccttgatgccaaagggggagaaccacctatcaacaaaaatctctaatctatctcctttcttgatggctagtcgaaccttgggcttttgtgtcttgttatgtgcaattatctattatccatgctcaaatgtgtgaaatatcttgtcattggcatatgcatgaggttatattgtcatttctaatctagtgcatagattgagggggagctctcctatttcatttctagcatatctttagggggagctccaccaaaa

SEQ ID NO: 35244 - DNA, 201 bp, Oryza sativa
acgaacgaaacgtacgtgcacgagaacatgaacaaacgaacgaacgtgaacgtgaacgaacgtaaacataatgttgtatttgaacgtacgtaaacgaatgaacgtgcgtgaacgaaaagtgaacttaacaagaacgcgaacattacttaacgtacgttaatgtggacgcacgtgaatgaacaaacgttggtgaatgaaacg

SEQ ID NO: 35245 - DNA, 825 bp, Oryza sativa
agcatattgaatcccagtttataaaattattttgatttaaattaatgcattatcgctttatttaaattcccgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaataggacaacattaggtggtttttataacttagactttgggaattttcatatcacttggatgctatggaatggatggcttttgttggaattggacacacacctccccctctattcaaaacccccaaaaatggttttaggctgggctcgaggtgcgtggttgggtttggttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgt

SEQ ID NO: 35246 - DNA, 8123 bp, Oryza sativa
ttgtaattagacttagtatataattattgactagctagggtcctaatgtacgtcacttagacttggcatagttgactattacagttttaatacaatattatttgagttttcgtataagattattatagttttaatataagattattagatttgtaattagacttagcatatacgacaattagacttagaatatatgacttagcatatatgattgttagcatataagattgttaaagcaaaaatgtctcatgacttagcaactatttcttgtatgaacagacggctgatcgcgatgaggaacagatattgtatgatacaatcgcggagggaagcagccagtactggaacgaagaagaggggaacgaggatccaaaccagtacttgaacgaggaagggaacgtggagagggatgcggaggggaaccaagaggggcacgtggagagggatgtggaggggaatcaggaggaggaggctagtggaagtcaaccctccgctggacggaagagggcacgcgggcaacgaggtgccgcgaagaagcttgagggtcggcacatcataacggaagtggacgaagacggccgacctattgccccggtggaagcagccaagaactacatacgtcacagcggttgggttgtgcgggataacgtgcctgtcagtacggtgtactggcgcagaacaagggcacgcggagatcatgagagctttgtcccagatttggagaaagagatgctgtggaccacaatgctcgagacattcacccttcccgtggatacagaggacaaagtgaaaaggtggactctaaagaaaatggcataacagtttcagagattcaagggaaatctgtaccagaaatatatcctgaaggggcagacaccgaacttcgacacattcccaaagctaagggatcactgggacgagtttgttgcatataagacaggtcaacaaggacaggcgatgatggaaagaaacaaagaaaatgcctccaagaagaagtaccatcaccacttggggtcagacggctatagcgtcgcgatgccgaagtgggaggagatggaggcaagcttgcttgagaggggtatcgaaccggccaccgctaattggccggatcgatcgaagttctggtattatgctcacggtggaacgctcaacccagctgatggctccctggtcttcagcgatcagatacgcgaggctgcacgtcgactaacggacgcagtggaagcctcttctcagggcacgttccgacccgacagagagaaggacgagctgtcactcgccctgtagactccagagcatccaggatgaacacgagggaaaggggtgattccttggaagattgggttcaagaaggacatccacacgtacaggagtcggatgaggagcaagagagataccgaggcaaagattgcagatcttgagtacagggtatcaagctacgagctcagcatgcaagaggaggtggcaaggaaggttgatgaacgcatggccgcacatcggtcccatgatccccagccgaccattcctcctgcaatggtgagcccttcaggaaatcgtagcagctgcgccttaacggggcaggtaggatcacagtgcatggacgccatgcaaacccaggacaaaaccacctgccccgttgatgacatcactcagcggacaccatgtgagctgcatattcccttcaagaacttatcaataaaggtaagcttgtagtttatagattttagatttgtccattctgtaagttgctgcttatatatgttcattacaaataaataacctctcaccacgtgaaggtggcgtcaggcatggccatcccaacagacccttcaggtacttaccactacaggtcgattctagcaggatactccaaggtcgaagttgagttggtcgaaggtgcgtacgaggacctcgagttggattaccctggaggagatggtgagacgcatctacgagacacaagccacgccattatactatggcgcaagtggtacatcatcctccctgggcgacaagcggcatctcgtgcaccatctcctccggctctgccatctcctcctcaggctcttgcaccgtctcttcctcatgctccagcaccgtctccacctcaggctcctgcactgactcctcctcaggctcctgtaccaactcctcctcaggctcctacactgactcctccgcaagctcctcgtccggcaccttccaagtcaagggccccccaagctccaccgcctgcccccacaagggcaacgaagaaggcgaaagttgacgccgccaagaacaaggacccggggtacgattgcacgcaagaggagcttgacgcttatgtggcatcagaagtcaggagacaattgaagcctcgaagcccagaaaagaagattcctatagacccgagtgtcaagaacttcttcaggggtatgtctgcacctgccaaggaggccataaagctatcggactgtgagcgaacactcaagaaaacatcttctggaaagtccaaaccagtctctcagcttggagagcaaccaaaccaggagatcaagccgttggtgaccggtgaagattttggaatacaagaatttattaatgacactggctaactacggatcaattgctacgaggcgcaccaatcgaaaaggcggaagtgaaatacatgtacgaactcggtaaaccgcttgtcaagcatgagcagctgcagtccctacctacagaaatgtacaagttccatcaactgtacatggagatgagcgccaccggtagagagatgatcggagcgaggatcagggacacggacttcttgcaaggagatgacattctctggatcaatttcaagggtatctactaactataccagctggacgagttgctggattttgtaagtatcgttcagttagatttcttattacgtttcctttaattagttaggtccttgtatataagtacactatatataatatatactcccttttatcgttatagaatggagattcaaagggctcgacggcggggggttttcgatactggattaattgaccctcggaaagtaaacgttgcaatgctcgaccagtatccgcaagccacagaggacaatctcgtccatctcctgaaggcgcagcattacaagacgttcatactgttgccgtacaacacagagttagtttaattttactgtctttctataccaaatttcattctcgtacgaacatgctaagtgtttcatatgtaatgtatcccacgcacattacagattccactgggtgcttttactcttcgacctggaggcctgcaccgtcaacgtatatgactcaatggataaaaaagacctacgtttgacaaggttttcgaacttatagataggtactgtcataagttcctatgttaattaagaatcttgttatagttaattgctactacgaatcatagctttaaactccatgtagggcttggtatcggttccgtcatttggtccgtggcaaatggagagaaagacttaggcggaagttcaattttcctgtgagtacatgtcacgaccggaaataacccaacgggcgttccttacgtgcgtgcattattccttgtcccaggagacaaggtacaccaaaagttgatacgattcagagtttaacaagcggaagcgtaattaattaatctattacatgggtggcgaagacccagcacacaagaagacaaacgaaaaacagcggaagactagggcgacgaccacaggcgcttgacggcaggcacgagctagacaccaaagccttcatcttccaggaactcctcttctgagtttgggaaaaattgagcaagactgagtacaaccaccgtactcaacaagacacacccacaagtgcagaatacatgcaagggagtacaagggggttatagtataaagggttagggtttgcagtaaacagcattaaaagacacttagttgctcaaagttattttgtaaacacgattctatagctatataatattattaatcaaggccgtgaacccacacgagcctgccttaacccaaggcatacgatgattcagaccgaactggcaacccgaccctgagtcccagctcgtcccaagccaacccaggccagccattccacattttaattgttaagtaggttttaagaattaaaaacactaacttgggtacattgctcggcttgcccataaccgagggcgcggctattcaaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctagggccagaacccccgggacaggtaggcaggactgaacccgtagcagtaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcctgaagaccggtccttatatggctgaggtgctactatcaaaaccatgcaccccgagcccagcctaaaaccattttgagagttttgaatagagggtgaggtgtgaatccaattccacaataatccatccattccatagtgtccaggtgatgagaatattcccaaagtctagagttgtaaaaccacataatgttgcctaattaaccagcgaagcatctacctaaaatcatactagtggtaccatgagtagagtgtccactagttggggttttatttattctagggtgaacaggggaataataacaataacaataataaggtcataacaaaagtaaataggcatggctagacaaaacagtgataacgtgagaatttaaataaagcgataatgcaataatttaaatcaaaataattttataaactgggattcaatgtgttcgaggatgatgtgacttgccttgctcgctttcccaaacgtcggcttcaacctccacgaagagcggatcttccgaagctgcagcgtctacacgaccaacggaaaagaaaaggcttttactctaataaactccatataacccacaagaacaaagcacaaaaatgggttcttgacttcttaaggaaaaattaaagacttgaacggtccaattccgagttcaaatggccaagttatggccatttgaagtttatatgctctttaaatgaatatttacgaatttcttcatttaaattttaatttaaaaatggtttattgcgtcagccgagggggaggggcatgcggaccgggtccacgggagtggggcccacgcggcagcctcacggtccacggtggaccgggtgcacccgggctcacaccgatcggcgccgtgggccccacacgtcagccgcacccgagggcgcgggcggctgacggccgggccccacgcggcagccactcggcgcacccaagggcggccaagccggcgcggacggcgggaggcggcgccccgcgccccgatggtcgccgccggcgaccaccggcgcggcggagcggcggccgagagaggggagggaagggggaaaggaggcgacggtccacggctcacctcggggcgacggcggcgatgagggaggcggccgaagcggagggaggcggtgtcgcggctcgggtcgacggggtcggcggcgctccggcggtcggcgaccgaaacggagaggtggacgaggtcggcgaggatgcggcgaacccgaaggaggcggcgccgaggtgggaggcggtccggggcgacgacggcggcggaccggagctcggcggcgatggcggagagagagagcgacgtcgcgagctcgaatccggcgaggaggaagggcggcgagaggcggaaacggacagaggaggtgcggggagggtttaaatagggttggaagggggagagagcggccggggaggaaggaaaccggcgcgggaggtccggccgccatcaatggcgccggcgagatttgcgggggcaaatccgcccgtttgaacgcgagagagagagggaaaaatgggaggaaaggaagaggggatcacggggagtatttccccccactttattgcacgcggggacggcgggatgcggcggatttggcggcggcggcggcgcttggcgcagggggagcggcgggagcggcgggaggtcagggatgatgggtgggccccacccgtcagcgagggtgccgggcgggcccgcccgtcagcggcgcgcgcgcggggagaggctgagtgggccgcggggagaggagagagagggggagggagatggaccgaattcggcccattagagagaaggagggattttagggtttttctttttataaaacctttttaactttgtttatttcttaacaattattatttgtgctctgaaaattcaactaaaatttatttacgtattttaggcttttaggaaatatataaaaatcctctaagccttatttgacttttaaccttgcacattttaattgttggaggctttcacatggtttttaatgattctatgcataatttagaggatgtattttagagtcgttttgggacgcgacaaacctaccccccttaaacggaatctcgaccccgagattcggaagaactggcgaagagatcaggatgggctgccttcaactcgtcttcatgctcccaagtagcttcttcctcggcgtgggtgctccattggaccttgcaaaaacggattacccggttcctggtcctgcgctccatggtgtccaggattttcactggtctctctacgtaggtcaagtcttcgcgaacttcaatctgctctgagtcggcctgctcggacggcactcgaaggcatttcttgagttgcgacacatggaacacatcatgcacgttgcccaaggatgcgggcagctccaactggtaagcgacttctccgcgtcgagcaatgatacggaaaggacccacgaaccgaggtgcgagcttccctttcgtctgaaacttgtgtacgccccgcaatggcgtgaccctaaggtacacaaagtcatccactgcaaattctaggttacggcgtcggttatctgcatagctcttctgccgagactgtgccacctttagattatcccgaatagttctgaccttcgcttcagcttctctcaggatatcagtcccgaacacttggctttccccaacttggtcccacaatagcggtgtccggcatttgcggccatacaacgcttcatagggtgccatttgtatgctggcttggtagctgttattgtaggagaactcggcgtaggggagactcttatcctaggtcttcctgaaatctagaacacaggcacggagcatatcttccaggatctgatttagacgctcggtctgtccatctgtctgcgggtgatacgcggtgctgaaatttaaccgggtacccaactcttcttggagcttcttctagaagtgagaggtgaattggcttcccctatcagatacaattttcttaggaacgccatggagactcacgatcctagcgaacaagcttgggcctagaggtactcttgtgggtggtgatcttcaggctacggcagacgcggcggcgcttggggcgacagacctctccctgggcgatcttgagctgacacagctgcgcctccactgcgtctaggtccttcttcagctgtagattctcctaacgcagctccaggatcttcatgttgttctcgaccaacccacgacacaccatatgatggaagtcgatacgggccgcgtcgtatgcctccaccatgcgtgccaggtgcatgatggtagcgtcatcctccgagctagcatccctgaaggtggcgcagtcgcgggctcctccacgacgagggtggtagcggtagggcgagtgctgcaacccgtccgggtatcactggtgaagagtgccgatggcgaggagagcggcgttctggcaagccgcggagaaagaatctccacccgcggtaactgccaacgaagtcctctcgggtgagccagtgaggaaataacccaacgggcgttccttacgtgcgt

SEQ ID NO: 35247 - DNA, 9245 bp, Oryza sativa
acaggtgggccccacccgtcaactagggtgcggggcgggccgccccgtcaacggcgcgcgcgcgggaaaaagccgattggcccgcgggaagagaaaatagaggggaagggagatggaccgaattcggcccattagagagaaggagggattttagggtttttctttttataaaacctttttaactttgtttatttcttaacaattattatttgtgctctgaaaattcaactaaaatttatttacgtattttaggcttttaggaaatatataaaaatcctctaagccttatttgacttttaaccttgcacattttaattgttggaggctttcacacggtttttaatgattctaggcataatttagaggatgtattttagagtcgttttggggcgtgataggcacgagctcgaggaggaaggctaccctgttgtcgactacgagtcagagcgtcagaccgccatatcgacaacagttagataggctaccccaaacattgtactggtatgattatggtgaataaagagcaactccggcttcggccaacaggacgtagggttattacctgacaattcaggggtcccaacctgtataaaaatccctgtctccatctcttttacctcagtctcgcgtatatcctagtaccgacgatccccatactatgcaaatactagaattgcgacatcaaacatcgacagtagtagtgtagtaggaaccaaatctaaccattgatcctgatggatactttagaattttacttttacaccgtggaagggtattttcgttatttcaggtgctcccacgaaggctagtgattcgctcgttcccgttcgttgcgcacgacggccttcgcccgtcctcgtgcgcccgacgtctaccttcgcctttcgcgaggcctcccgttcttttcgcgcgaacccacggccacggcggcaccgcccctcaccttaatgcgcggccgccgcccgccgcccctccttgcgtagtcgcgtgaacccacggccacgtacgacggcgccatccctccaccccctgtggccctgtgcaccgcagcaccgcttcattcttgggatatgatggtgtacctgctctagggaaggtcgctttgttgaaatgtgttcttgaatcgctcaattgctatactgcaaaactaattactgaatcactgatgtttagctgatgatgtataatttaatcattttcgcattagcatcaggcaaatgagctaatgccgaagctcgtttatctgcagcagaactgagacggaccaagtactgagttctagactgaactgaaataaggttaaaaaagaaagctcaacgactcgcggttgcaagcacactctcactctattagcgtcattctaatcagttatccgaatctacaatttgactgacaaaaataactacaatcagatatgagctaaaactgtgttagtgtcttcttaatcagctatttcaatctgcaatttgaccgacaaaaacaacaattgacaagaaattgatcaacatcagcatggctacgacgatcttgaacccttcatcggtttgattaccttccggccttgccttagattctgatatggatcatcccacttcaattaggtgttgctaaaccttgacgctacggttgaaacaggtgtactagcagagtccctttttttttttgcgagagtactagcagagtcctttgacaggatctcatcatcagtatcaaattgacggcactgccaaacgcgtaaagtgcggcggcctccgtcgcgcacagcagcactgcaggtctgcagcatctcgcctcgcctccgttctccctctcgcatctcatttctcgacaaaacgactctcgtcgccatccccgcgtgctgcagttgtgaaccgattgagcatattgacccgtggactagattacgaacttacccctatgccaattgcaaattcatcacaatgccatctattacatttccaacattacccctccatgaattatactacggggctgtttgttttggtgccacacattgccacaccacatgttaggcatgccacagattgttagcttagcgtttggttgcttgtttcagttgtggcaagccacactttcttgtttcatgggcctacatgtcatatactcattttctagctaaacattgccacacttgtggccaacaaattgttggccacactttgtttgccatgccacatctatggcaaattgagttatggcaatgttaggcaacaaccaaacagaccctacatctactaccaggtgtagtaggattgaatctaatccattagatcgaatcaaatggacgtctcacattcattttgaggtactttaaaaaaatcctaaattaaaattctaaaccacatatatatcacaattggactgaaagaaatatgatcaaattaaaatcctaaaagatatatcacaactggacggaaggaaatataatcacagaaataacaacatgaacctacaaataactttgtcccaaactataattcaaatttgttaataatttttaatacaatagtttttaatggatcaaatagtgctaaaattaataatgtaaatggaaaaacaacttagaggagttaggcagggtgatcctctttctcctcttttgtttgcccttggtgctgatcttctgcaatctgtaattaacaaagcacatcaaaggggggtgttgtctttgccaatcctggtcagtaacgatgataactttcatgtgatacaatatgctgatgatacctttttttttttaagcttcctccactcagttatttgctttaaaggctctgttgaactcctttgctgtctcttctggcctaagagtgaattttgcaaagtcctgtatgatccctctgaatatctctgaagaaaaatcacagctgttggctgctacttttggctgttccattggatcattgcctttcacatatgtaggtctgccactgggaaaaaaacgatcgagaatggttgatttctctccttcaacagacagaattgaaagaaggttaacagccactcactttggtaaaggtgtgtagaccaaaagacaagggggggggattgggtgtcattgatctcagagtacaaaacaaggctcttctccctaagcatctacataagttttacaacaagttggacatcccttgggtcaattttgcttggtcttcttactactctctggaggcccctcaagttgccagaagccatggctctttctggtgaaaagatgtttttcaatatgatgtcctcttcaggggtattgcaaagcccatgcaacggacgagcacttcttttagtagctaaaaaaaataaaaacatttacatcgttcgtcttttcaattccacactcacctctacctcagtgatatttcctcaaagcaccgcttggcctttgtttgtcccctctcgcgtgagtgcaaaggcatttcaccttttcgagagaacgggcagggagctcctgcaatttcactatagaagaagagagttaatccagtttataaggaaaaccggacccaaaaaccttacaacaatatgttaatttatggaaaccaatgaaaaccccggcattgataaactaaacctaagaatagcagtccaacaagggaaaaactcctaaaacgaagcctccaagaaagatacgccgacaaaacggcgacatcgcccgatccaaacaaatctaaggttttcacccttgatgtggagttgaatgagggatccaatagcaaagtcttcaagaaggtaaacggtgcccgagggtgtcgcccttgctagcattgacaagccgaggaaggctttcacctcgaagtccccttcaaccatagtgtcctcaacggaacccaccaaatgccacgtgtacaccgaaggtacctgcacaattcacaccacctgcacaacgaccaaaacaggcgccgttgacgacctgctctaccacctagccagatcggcagagcttcactgagccgcggagccagaccgtcgatgccaccgaatggccacataggtcgctgaagctccaccaagcgacctcgtcgttgccactgccactgggggtccggccttgcccgactccaactgggatgtgccagatctggctgtccccctcgctgccatcaccaccaccgacaatgtggccgcgactggggatctggcctctcgtgctggagagacgctcagatcccattggagtggttccagatctggacctagggtagctaggtccgatcatccccctcgctgccttcaccgccgctgctagctagtactcaatttttagaaatttgttgtaatataaatgaaaattaaaaacaagtacacatgttataggttttatgtcatttagaagtagatattttttatttcctttcaatggcaaaaacttcatatagtttagtgacataattatataattatgtgactagattctttgcagatttttgttgctcacatgtagtcaaaaattcataaatatttcgtttactatagggatgcacgaaaagttcatttatttactcttttttggaaaatatttagatggattataaatttacatcatatttcaatagtatttacatagcaagttacagtggtattatactataattgcaagtgtaattatatgtatatataaatgtaaatattcaatactaatccccaatttgcacaattctcataggaactgggtaataatgtatgtatatgaaatcttatctggtacggtcgttattttcctctttgctgattctgtagctgattttgatcctttcgatattgggagcgtatcctatacacacaggccctcgcgtgtacacaccgtgtacaccaactaaaatttatcacaaaaagttctagaaatattcatacatatactttcaatagtattacatctgcttgcaaaatcgcatcttcaaattcattctacatagagagtaaaaaaagataaaattctgacaaaattacaatattaaaactgtcagattttttgtttttttcttacagctaaaatataataaatttgaggttaagattttaaccctaggtataatactattgaaagtacatatatgaatttttctagattttttggtgacatttgttagttagtgtgtacgtatgtacacttgagagcttgtgtgcatgggatatgttactttcgatattttcgaggctttttgcactttactgatttcagaagatcctgcatttgtataaaaagatatatatatattagaaatacacacatgatgacatagtgcttgcaaatttatgtaaattatatatgtgagcacttacataacaatcgaaccatatttacacgctatttacatcaccaatatactaaactaacatatgtaatttcaattatattgcagtgtagcttttagttattatccatccaatgtgataacattgaaccattttgaagtgaatatattgtactgatgcagctaatttgagcttttggatcatgtagagagaagtaagctaatttgagtacctgtttttttttatagatgtccccaggtaatttccattatcaactatactgcagattttgatcacagtttgtgattatgagatgtataaacttcaaatttcatcagaccaaagaggttgagatgttgtacaaatcaagattcagaggttagaggaattgcacctttcaaattcatctgatttatgcattcttctgtaagatttccttttgatttgtggggttgatttaattctgtatctttgatttgatctatagcgtatcacctgagttcttctccctcaatttctctctacttctccatgggttttgttcaggttgttgagttctggatctgggaagaatatcacgtgtgtgctgttgcttcaggctgtgagcttttttaactctcaagttggcgttgtgcttgctttaagatttgtgctttttggtatctgcacatccaatatttgggttttttttttaaggaataagttcatccgaggtcccttgactttacaccgaatccgattttcgtccttgaaccccaaaaccagatacaatacgtccctaaactgtcaaaaccggtacaaattaggtccctcagcgttttggaaggtggttttggctgacgtggcgcttacgtggttggtttgactagatcttcgtcccacgtggcattgatgtggcgcttacgtggcaattctatcccgaaaaaataataaaaaccatgggcccacatattagttaaaaaatataattttaaaaaggtggggcccacatgggccccatatgtcagcctcactcccttctctccttccatctccttctcggggagcggacgggcaggtggggggcggagcgcacgggcggctccttcgacggcgtggccgctgcgtcacgggcgactgcgccagcgtgctgtcctgctccgtctccggcgagccgccacgctgcccgagtacacggctacacgctcggctcctgacccggcgccggcgacgacttcctcgacctgtcgcttgtcgacgggttaacgtgccggtaagcttccagacgaccaacggcggcggcgccaggtgcagcaaggggcgcgggccgagctgcgccgtggacatcatggcgaggtacgtgcctccccgagctccgtgtcccaggcggctgcgccagtgcgtgcggcaagttcggcgcggcgacacctactgctaccggggccagtttgaggcttcgagcacgtctgccctgttggcgttgacagacacggtagctagctggatgaacaaaagaagacttgctacatgcacaaaactaactaaccggtagacttgctccactagctcatgcaggacatgcaagtactagcatagcacaaagccatagctaactactagctgatttggcgatccttgcaagccactaacatgaacatatcacatttggtagcaccagcatgcaaccaggtctaacacatgatgtgatccaaaaactaaacaagtacttaaggatcctatgcaacaagattagtgctaacatgcccgccgacgagctactccatgttcttaaggggctatgccccgacgcctacagctacgccaaggacgaccagaccagcaccttcacctgccccgccggcaccaaccaccgcgtggacttctgcccgccgacgagcggcgtgacggctggcgacgacgacggtgtgcgtggccaccgcctcccgcagctgagctgccggatttgtgcagccgcggcggtggtcctcctcccgccgcaggccacggcctcccgcggctgagctgccagatttgtgttccgtgtgcatccgcggcgatggtcatggtcctcctcccgccgccagccacggcctcccgccgtgagctgccgaattttcgtggcttcggcgtcggtcttcctcccacctcggccacggtgaagaccggtattgagctgccggattgtgcagccgcagcaacagtcctcctcccgccgccgttcacggcctcaagaggagcatcctggtggaggtgtatgccgcggcgcacgccgagctgccgccgccggagctcggacagcccgcctcgctcgcctgctccgccgtccacccgcccgtccgctcccgggaaggagagagagaggggagagggaagagggaagaagagaggagtgagagggtaggagtgaggctgacatgtggggctcacgtgggccccgtcatttttaaattattttttcatgaaccagacgtgtaggcccacagtttttattattttttcgaggtagaattgccacgtaagcgccacatcaatgccacatggaatgaagacttagtcaagccagccacgtaagcgccacgtcagccaaaaccacctaccaaaccgccgagggacctcgtttgtactggttttgatagtttagggactggttatatctggttttagggttcaaggacgaaatccgaattcggtgtaaagttaagggatctcagatgaacttattccttttttatatctttattgcaatagctgggcctttcaattcgtcatattgttgattgggttttcgaatgggcttagtaaataatttgggcttttgcgttttagtgcattaatttgggttggaaaaagtatactttgactccctcaactatcacccgagtatgattcatgtcctccaaccacaaaactgggtatatcgactcctccaactaccaaaaccggtgcaaacaatgcccctaggtggttttggaggtggttttggatgacgacctacgtggcgcccttgatggagtcgttgtcctacgtggcgcttacattgcattagaataaaacaaaaaataaaaagaaatatgtgggacctatatatcattcacacaaataaagtattgtgggacccacatgtcatcctccctctccttcccttcttcctcctccctccctctctctcccttatctctcttctcctccggcctttcccttcttcgctggccgcgagctgctactctggctcctcctgccgcgctcggtggatggcgtccttttcaactacgtcgaccaccgtcgcccgcacctcttctctcacccccaccccgcctcttcgccatcagtgccggcgtcgtgcggcggcggcacggtcgacggcgacctcacctccgtgtcggccggtgaccgggcgtggtggaccgtcgttgaccaccacgacgaccttgtcctctacgacgtctactggggtagccgcctcttcgtctgcaacccagcaacgcggcggtgggcaatgctgccgccgccgtggccagaaccggagcacgagcccagcgcgtacgccgccgcacaccgacgatggccgcgaagaagggaaaggccgggggagagggagagataagggagagagagaaagaggaggaggaagaagggaaggatagggaggatgacatgtgggtcccacaatactttatttgtgtgaatgatatgcacgtttcacatacttctatttactgcattttttattcacatcccacgtaagcgccatgtaggataaaaaattggtctagatggttaggtaggcgccgcgtcatccaaaaccacccaggggcattgtttgcaccggttttaatagttaaggagtcgatatatccggttttatagttggatgacatgaatcatactcggactcggacgatagttgagtgagtcaaagtatactttttccatttgggtttgccgatttatgggcatgtttccattattttgggcctgtttgttttatttaggac

SEQ ID NO: 35248 - DNA, 7717 bp, Oryza sativa
aaaaaatctgttaaatgatgtgtaggcagtactgtaatttaatggcaagagatgatagaggcaaaatagacttgttccttggtacgggtgaaaacgggacgggtatttctcgcccgcttgcccaaccgtattaatctaggataaattcgggtacctattttatgccggatatgatatcgggttcagtagggtggtatccgacggatatggagtacctgttaaattgtgcgggtattaccgataaactacccgtatattatccggactgctaccaccaccactccaccaggccaacaacccaacaacccaaaaggcccaccaaacactaaccctagccacttaggctgggtttggaatcagccgttcccaacttacacagtgcgcatgaaaaatagagcagtctattagtgcgcgattaattaagtattagtttttttttcttcaaaaatgaatcaatatgatttttttaagcaactttcgtatagaaacttttaaaaacacacatcgtttagcagtttaaaaagcgtgcacgtagaatacgatggagaggggataggaaccccgtaattttgacaaattgacccttctataaaacttattttcaaaataagccatgtcaaaaactaattttaaaactaggccgtgacctcagcgccaaccccgatggcgctgaactaaaacgttcgcagcgccagcattgttggcactaaggtcatatctgacatggaacatattagccataattgaggttcagcgccaaataagttggcgctgacctcttagaacgtttaaaagtagtgtggacaataactaacacaagtttcattcaatttaaatgtttttatcgttccttggtaagaactgagaacctaaatcatacaacataaaattcaaaattcaaaattataataattgaactaagtattttattgagattaacattttaattaatgttttcaaatttgtttattccagattgaacataaaataaataatccccataaaaagtaaaataaaaataaatctacaaacaaaatatgtgattgtttggaaaaaaaaatcaatagaacaagaatcatgcaacataaaattgaaaatacaaaattataataattgagctaagtattttgttgagattaacattttaattaatgttttcaaatttgtttattccagattgaacataaaataaataatccccttaaaaagtaacataaaaagaaatctacaaacaaaatatgtgattgtttggaaaaataaatcaaagggggataagtaagaaagaacctgaaaaggggcttccccagttcgaactggcaacctgagagcaggtgcagaacagcagaagggctgacaactgagctagcttctgcattatgtgtggtgtttgtatctcatgaagataaagattaagtgtttcacgcaaaacgaggtggtaataatatgtgattaattaagttttaattattataaacttaaaaaatggactaatctggtattttagaacaacttttatatacaaagtttttttttacgaaacgcatcgtttagcagtttgaaaagcgtaccacgataatataaaattttatcctccactagtagaagaaacgaacagcggcagcacacatatgcttttaaaccacacaaatatcagcgccaacacacatagcgctgagctcctcttttgtcgctaatccgtgccacgttggacgtaatattagcgccagccgctaattagggtggcgatgggacgtattatgtcagcgccattagggttgacgctgaggtcatggcctagttttaaaattagtttttgacacggtttattttgaaaataagttttatagaagggtccatttgtcaaaattacggtagtaaccttggtttcaaacacagcctaaattatgtcaggcagccaggcaggagccacacgcacttatgtcaccgagggagccacacgcacgtacgtcaccaggagagagtcgtgggacgatattcacacgtatcagggacgtacaatacgtatcggacaagtatcggtaattcttttatttgcttgaaaaccgagaaaatgtcggatacgtacggtatatgtacgtatctgtatccgtcgacgtatcggggattcggggtaacgtagctcgccagcgcccaacaccgccatcgtatgttgcgttgccgcggcgctggctgctagtggctacgctgccgtgtgcccgcgtccgccagccaccgtgtcgtacgtcgccgcgtgggactttgatactaatgtagtagtaccgttacttacggagttattgatacatgacatatatttgtccatatttgttgtattagaatatatcatatttaattatagatttgtttttttatggggtatatggtatatatatatatatatatatatatatatatatatatatatatatatatatatatatatatatataattgttgctttgatttgatatccgaataaatattcgcaaccaatagtatttgtgtccatcttggtaagtattcattctgtatttatcccccgatattatccgggcctatattctatccgataatatccgtctccgacccaattcaaattataaaatatgggttagatatgggttctttaaatcaaactattaccgggtgttgatttctgaaggggggaaaataatctctctatttattgtttgcgtgacttgtttagtgtgtgttctggattccagataaggttttaaaaagttattattaactaatactcaagaggttcagtttgccatgtagtttccattaaatctgaatgcatcaatgcatcaatcaatgtaaggccaagcatttatgtaaaatgtgttgttagttgtagctaaaacaatatcaagatatactgaattatgtttacagtagactgttaacatcaggggcaaagctaggatatgatatgacattggggggtgggggagaagggaatggggggagctgcaagaacaaatggccaaagtccatatataataatcacagcttctacattggttgggctaggattttcaattgcaacagaaaagtcctaggaacaactagcttatagaatcaatcaatcgtcttcctcttcatcttggctgaagttatgatgggaaatcccaaaattcagaactcacaaactgactgatgtctacatgactacattgtctatgtgtctaaatcagggactagtgaatactggacttgtaaaagaaaggagaacaattgttattttgttgtgttgggggagaaaaggagaatgaactcacctctggactacggctcgcagcgtgctggactgtgcttgacggcgagatgcaccgcacgcgattgctgtcgctgatgaagggtgaagtcgcggagaagctcgctgccgtctgctgacaccgcatgctgcgtttttgggtcgccgatggctgctgctctcgctactgtgcgtgaacttgcgaagctgaagcgatgggcactcgataaaaaaggcagacagtttttactaatgggcttaccagcgagggagaatttggttttttttttttttgagggggggggggcgcaaatctggtagggaggtgttggcactggttaacatcctctttatagggcctgttcagccagcaccaacagttacgtgcacgcacaaggaagtgcagcagctgcagtcctggctgccgaacagagccatagatctctcatagagcatctgagttcacctcaaatatatactccctccgtttcatataataagaatttatagtattgcctacatttatatagttgttaatgaatctagacacatgtgcatctatatgaatgtgtgtgggcaatgctagaagttcttacattgtgagacggaggaagtagtcagctagatgtttcttgctttgttcagtatttgatattgtggaatcgtcgctggtccatggaatgtatatcaagtttgctgatttataacttatatgcaagagttccttagcagtatattctatgcttcctacagaatgaatctgggcagatttttttatgatgtgctttactcactaagtcaacattgtgactataactcaacatgttctagttcaatagaaaaggttatatagaattagaggttatggatcgattatcatattgtatcctaaaaactgtagaatatgtgtatcttttttgtctttcagcaatttactttcttcatgcaggtgttgccggcttgccgtatgacaagctaatttggaacgactccggtggcataaattacaggcccagtcttctcacgggaccatctgagcaaaaaaaggcaacttactggagtattatatttttagaaggtcatttgaattgtatgacacgttcttaaggaaataggatggatctgtggatatccaacctgccctatagtcaattgcctgaattacctgagctatcagagctaagcattacaggctattgttataccattctattgctagtcgaagtaaaatagaaacagacaaatgctaaacaactggagtacttccagggttgtctttcagcggaaaaaaaaatctgatgagatgtcaacataaaatgtgactgcagtgtatcgagtagtacatacgactgtgtaatgctcaacagcaacgaacacaaagtatcacaaagtatcactaatcacgggacagacgcctcgtcacggacggggggagactgtctcgtgggtgtccgtccagctcggggggtcgcggaactgggtgctgaagctgggctctgagctcagtcgcttcggcatccactctgtcatacgaagcaaggtgggagaggactgtactgactatagaacggattgtctcccgattgggagactcggcctgtgccctggcacattcctcgactccccgaagaccttgaagcagctcctgaatcagttctttttccttcagtaaagacgagtaaaggctttgaagcttcttgttggtgggggacaggtcagcgtcagcttcggcgggaacaccagcagcagcacgagccggggcctcagcgccgccatcgttcagagcggcacgccgcgcgttcctctcacgcctgatgcgacgacggcctggctgcgcacacatcaaacataccaacaattaatttgctaggcatgttaatttgctaagaattaaacgcaattcagtcattcagtgtactcgaacctctcggccgacagcgccgccacctatagctggtgggcgtggggcatctgctgcgcccgccacggcagcgtcttgatcaccaccgcctcctctagctggtgggcgtggggcatgtgctgcggccgccacggcctcgccctcatcgccaccgtggaagaacagctaaaacattgcaaacactcgtgtcaaaatgaagaaacctcaaaataaaattacacttaagctcgctggagctaacctggcggcggatgagagtgagacggtgtctaagatgtacgggcaacatggagagctggtgctctccgcgctgcccggctcccaggtcgatctcgtcgccgcgcatgtaactatgtaagcgagactagctcctgggaggtcatctcccaacacgcgccgcgagctccctgaaccatcccggcgcggccgcccagtcaacccacacgtctcccccaccgttgaggagagcctcgccgacgccgtgcacgacgtcgccggcaatgtagacaaactgatgcagcgtccgcccgtcgtggacaaagggcatccagaaacgtacgtcgaggtttgcgtttgcggttgtgagcaccggaacccaaacctcacggtgacggtccgcgcggggagggcgtcgtccgcctctcgcctggagctccaggtcgacgccgacgccgcgcgctcctgtcccgacgaacggaacagagtcctgatcgctcgccgaaggagggccacagcgctcgctccctcgagccgcgccatggcctccatcgttcggcgtgcccccgtctctcgcctggagccccaggtcgacgccgacgccgcgcgctcctcccccgacgaacagaggagagtcccatccccatctcccgcacccgcgcccaggggacgccgcgtggtcggcgaagcggctggcctggcctgcgacgcgcggcgaactggaattggcgtccccgccgcagcgcccgcgcccgcgagacgcggcgtgatcggcggagctggggctcgcttggccgcggccgcggtggtggtgctgttgcgtcgaaacattgccaccgcgacgcacgtcacgcacagcgtggtcggcgtggcctccgccgtgccgagatgaagcggaagtagcgtccccgctgcggcgcccgcggccgcgagacgcagcgtgatcggcggagttcgggcccgcttggccgcggccgcggaggtggtgccgcggcgaagcaggaccaccgtgccctccgccgcgatgccctcgcccgtggcccgcggcgattgcgatcggaccctcctggccgcgcccaccgcggccgtgtcctccagccggaggagcgtggcgggggaggcgcgcgtgtgcctcgggagctccccgagtctggcgatggccgccgcgccgctccctcatctttccttggtggggaaggcgaggcgcgcgcaacgtcggcggcggcgagggatggggatacgggcgcagtggcgggtggtggaggcgacggggaagaggtggggaatggagggggattcgaggggttggcggtggcggaggcggagttgatggttataaagccgtggggaggaggaggcgacgcgaagacgaaaggttctagaagcttagctcatcggcgagagacgcgaagaccatcttgttgcgcacgatttgcgaaggaaacagcggcgaggtgggcccgcgcgcgctcggcacagcagccgttgtccgttgcctcgcggagagcggagagaggagaggggagagagagatggaggggagttggggagagagaggaggaagaggagggggtgataatgacacgtgggacccctccatttttaaattaattttttgatctaactaacatatggcctcacaatttttattattttttaattaaaataccacgtaaacgtcacgtcactgtcaaattagccacgtaggcgtcacgtcagtgaaaaccgccgtctaaaccgccatgaaacttatattgcaatggttttgacagttgagggatccgttgtatctggttttccggttgaagaacgttaattagattcattggcaagtcaagggacctcagatgaacttattccattcgtgcaactatgtagtccgtttcctatttcgatcagtgggtttccttttgcgctttgggcttttcagttgggtttacatctgggcttctgtgggacccaattttttataaaattctttttttgaatttttgtggacccactggcactgtttgattttttgaaatccgcgctatcttttgttgcccagagagagagatctttctctcgttctcgtcgtctcaggcaacacggcgacgatttcgctcggcgatgcgaatgcggctgtttcttctagcacgagattctacaactccggcaatgactgctgtgacgcagcgctctgctcagctgcatcagaacttgacgcggtggcaaattttctggtaagtactttcctctttcttcatcctcttcattctatttcgacgatgcggacatgacgaggttgcttgcgatgtagttcgttgactcattcc

SEQ ID NO: 35249 - DNA, 678 bp, Oryza sativa
gctcgagatatggccggtgaactagatcagtgcttaagtttcatttagatctctgcttgtggttgcttttgcttgtgtgaactagatctgaggttaagtttacttcatttagatcagtacttttattttcttttccttgtgtgaactagatctctggttttgttcgtttatgtgcacattattgtctttttaggaacaatatgttagtcttttttatgtttttttcaatttattgtttggattcatttgttcaattatttgttatttcagtagttagaattgcagctagttatgaaactattagcatattaagttatttgtcttttgttatttgttatttgtcttttgtctttgtatccagaagttgagtactagcagtcacatattttgtatattagttggcactgtaattctgtgaagaataaaatccaaataggtgaagatggcactagcagttatttttttagactagtccattttcattgaatagtctgcaatatagagcgcgaacggcttgctcggcagcggtgacagtgcctggagcgcgcgcggcctgcttggagggagttgttgaggaggcggcgatgtcatacgcgtaggcggagtggattgcgttcttggtctcgtcgtggctgtcggcgacgtagacgacgccgtcactgctgatgcagccgaaga

SEQ ID NO: 35250 - DNA, 26754 bp, Oryza sativa
tttaaaagctgtttactgcaatcctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggcctttgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcagtattttcgaaataaaaatcctctgttatttgtgaaaaccctctagtctttctctgtcttgctgcttcatttatcgccaaaatctgacctttttaaaatgttgcttttctttttgtttttgtttgaagatggccggcagcgtcacccgtcgtggtttggacatgactggtttcgtcttggagctgcggggcatgtgcgttgtcctggggtatccacatggagtggactaccagggcaggccgcttccggagcaggagggtgacgatgcagagccccacgctgcttgggaggtcactgcagtaatcctcgctggctctcccgagcggacttcgctgacagtcaccgcgggtggagattctttccccgccgcttgccagagcgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgccgccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggagaagcctccggcgttggtagcacagaggatgcgctgttgctcaccttccgtcctggcccgtcgcagcggtagacgaacagttagtaggcttgcgcgtgtgttctttctcgtttgtcttcttgttggagttgtgtggggcatggttatgccggtgtgtggtataactgtgtcggagcctgtctttattttatttgcctaagcaacttgaactttaatgaaccaatttaatagcagtaataaattcaagaattatggtagtcgtggatggttagctttaattgtcagctctctctgtttgctggttctgtgtggggttttcagatggtgatgaccaggagaagtgctgccaccggtgatagcaaccaacctgaaggcagcaaccaccaccaccagggcagcccacctccacctcctcctccgcctccaccaccgccagataccaacgccattctcacccaaatcctagcccagcaggccgacatgatggctgctttcctccaccacatccaaaatccgccacaacataatgctccaccaccaccttcccaacactctaaactcgccgagttcctccgcatccgcccacttaccttctctagctccaacaaccccgtggatgcgttggattggctgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagagaattccgagagttgaagcaaggcaaccgctccgtgacggagtatttgcatgagttcaacaacctggcccgttacgccccggaggatgtgcgggaagatgaggagaagcaagagaagttcttggcaggaatggaccctgagctgtccgtccgtctagtctccgggaactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctaacaactccagacgtcatcgttggtacgttcctcattcattccatccctgctactattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacatggatgtgatccttgggatgaattggttggctcaattccaaggagtagtggattgtgcgagacgcactgtcactctgtactgagggccggaacaaccggttgttttctttgcaccccaacctctgtcagtagttccgaacttcatcagataggactatcagaaatccccatcgtcagagagttcggagacgtgtttccggacgaactacccggtatgccgcccaagcgagagattgagttccggatagatcttgctccaggaaccactcctctgtacaagcgaccctatcgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatatggactgtatgaattcacggtgatgtcgttcggtttaaccaatgcacctgcctttttcatgaacttaatgaacaaagtgttcatggaatacttggataagtttgttgtggttttcattgatgacattctggtatactcacaatcagaggaagaccatcagcaccatctctgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactaccggaggttcatcgagaacttctccaaaatcgctcaacccatgacacagttgttgaagaaagaagagaaatttgtgtggagcccgcaatgcgagaaggcgttcaaaactctcaaagaaaagctggttgcctcgccagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggtcgccgacgccctaagtcgaaaaagccattgcaacacccttaacgtccgtggcattccacccaaacttagtcaacagatggaagccctgaacctaagcatagttggtcgcggattcttggctgcgttggaagccaagcctaccttgctcgatcaaatccgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagcccacgaaagtccttattccatccaccctggcagtacaaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaagacccaaggtggatatgattctatatgggtagtggtggatcgattaaccaaggtagctcgattcattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcctgtgggatcaagttggggaaagccaagtgttcgggactgatatcctgagagaagctgaagctaaagtcagaaccattcgggataatctaaaggtggcacagtcccggcagaaaagttatgcagataaccgtcgccgtaacctagaattcgcagtggacgattttgtgtatcttcgggtcacgccattgcggggtgtacacaggtttcagacaaaagggaagcttgcacctcggtatgtgggtcctttccgtatcgttgcccgacacggagaagtcgcttaccaattggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcatgaagacgagctgaaggcagcccatcctgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccgtaaaaagtcctttttccccccccttcccctcttgggccggctcggtccacctccctccctctctctcctctcccccgcggcccaatcggcctcctccccgcgcgcgtgccgctgacgggcgggcccgcccgccaccctcgctgacgggtggggcccacccgtcatcccctacctcccgccgctcccgccgcctcgcccgtgccctagcgccgccgccgccgcgaatcccgccgcctcccgctgtccccgcgcgcaataaagaggggaaaatcactccccgtgattccctctccctttccccccatttttccctctctctctcgcgttcaaacgggcagatttgcccccgcaaatctcgccggcgccattgatggagcccgagagcgccgcgccggtttccttctcccccggccgccctctctcactcccaacactatataaacgctccccgtgcctccctccaccgtttccgccactcgccgctctctctctccgccggaatcgagctcgcgccgtcgctctctgtttccgccgtcaccgccgagctccggtccgccgccgtcgtcgcctcggaccttctcccgcctcggcgtcgcctccttcggctccgccgcgtcctcgccgacctcgtccacccctccgtttcgcccgccgaccgccggaacgccgccgtccccgacgacccgtgccgcgccgccgccttcttccgctccggtcgccgttcccgtcgtcgtcgtcaacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccacactcccgtggacccggtccgcgcgctcctctctcccggctgacgcaataaatatgtttttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattgttgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacactttggaattgttggtttattgtggaattggcttcacaccgctcgttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggagttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaatatgtacacatctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtactagaatcgtgtttgcaaaatagccctgagcaactaatgtctttaaatgctgtttactgcaatcctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgagacaaggattaatgcacgcacgtaaggaatgcccgttgggttatttccggtcgtgacattgcataaggtttaatagtataggcaaactcaaagtttgccccccgaggagaaattataaccaagccgataccacatccatgagtgcacaccgatccgtcgaaaaataaagtccaaggcacaatatcgactgagccgactaaatcatcacgatgctctacaataaaatcggctatagcctgcccctttactgccttaggtgattcatactgaagatcaagttctgtcaatgcatatatccactttctgattctcccctttaaaaccggagccgatagcatatatttgatcacatcggctttgcacaccacagtgcattcattggataacaaataatgcctcaactttgtgtaagagaaatataaacacaaacataacttctccaccggagaataccttgtctctgcgtccaagagcctgcgactcaaatagaaaataactctttccttggcttcgagttcttggattaaaaccgagccgattgacttctcgccagccaacaaatatagtttgaaaggtactcccttctgtggaggaatcaacaccggaggagagctaagatattccttaatattgtccaaagccttctgttgctctgtcccccaggtgaattcttgatcggctttcaatcttaacaaaggtgtaaaaggttccaatctcccagataagttagaaataaaccttctaataaaattcaccttgccgatcaacttctgcaattgtttcttgtcttctggaggtagaattttcttgatcgcattgacactcctctgagttacttcaatccccctctcatgaacaagaaagcccaaaaactgtccagccaatacaccgaaagcacacttcataggattcatcttcaaaccatatttccttgtcctctcgaaaacccttttcaaatcggctatgtggtcctccacccctttgatttatttaacaaccacatcatcaatgtagatgaaccaacaagccgatcagatcgatgaatatataattcatggccctctgatatgtagacccagcactcttcaagccgggagtcatcacaacccactcatataaaccgatcgcaccaggacacctgaaagcggtcttgtgaatgtcttcttctgccataaaagtttgattgtaacccgcattgccatctataaaactgataatcttgtgccctgaagcagcatcaaccaattgatcggcaatcggcattgggtactcatccttaggggtagccttgttcaaatcccgaaaatcgatgcacaccctaagcttaccattcttcttgatgaccgggactatgttagaaacccactcagcatatcggcaaggtctaataaaaccagcatcatataagcaagtaacttcagccttgatagcgtcatacatatcggctttacatctccttggaggttgctagtatggcttatatcctggcttgatagggagccgatgttcaacaatcgatcggctaagtcctggcatctcgtaatattcccaagcaaagcaatctctatactcttttaaaagctctatcgcttggttctaaactttgccgataaattcttgctgataaacgtcggccttggcctatctcctgggcctatgtcaatctcctccaaatcatcagctgacataaaaccctatcataatttgccatcaagatcatccaccgtgtccttggtgtagaaatttgaaccctccacgacgccctcaaaataataatttggggtctccgtcttcaattggatgtatatcacaatcggacacttttagaaaatctccatcccaagcttttccagacatgcaatctatcccatccatctcccaaagagctaaatcggcactagcaacatacaatggcttgagatgccgattttctgtcccctctagtttctcaaaaattgcttgttctggcgacaaaatcaatctagcagaggcttcttcaacatcattgacatcggcttccttgacttcatattctgcaggcaataaaaacaccatattcaccaacgtagatgtaacactttttcctttagctagcccctttgccttatcagcttcaacctcatctgccgtcgctactttgctcttaatgcgccattcttgcttagtcttcttcagccaatggttgatctcctactgcacctcctgaaaacgctccctgttcctcatccgctgaacccttctcttctgattctttgtgaaaataccagaaggacaccattgtgtgttcctgtcctcctcctcatcttaacgacgatcttgattgaccgggcccaacctctgatgaacatacaacctcttctgacttagccgatttcctcattgtaagatcggcttgaactccctacattgtcactacatccagggcaatcctcaattgacggtagcatcattccctcattccaacagaacctgaagaactcacaatcccaatgaggatcaaaaccaccatcatcttcctcatagtacttctcctgttgcttatcatgccttctctgataataatcctggctgaattcaactgagaactccgatttttccctccatcggctgctcttccagctgtatgcaccatattgatggggaaattatgtccatctaccttcatcggcttctttgattcatcaaatttgatttttccctccctcaatagctgcttggatctgctgcctaaagactttgcaatcattggtagcatgggaaccagtgttatgccacttacaatattttctcttccctaactcctcagccgatggtattatatgactagcaggaagttgtatctgtttctcctgaagtagcaagtcaaaaatattatcagccttagtgatatcaaaatcatacctctcttcttttccagaactcttcacccattgacacggtacaacctttttgcttctcaccattcagctgctgccacttcggagtcatcttcctcatcagtgtcatacatataaggatacacgtgattgatcttcttgaaattcttcttagcctccgcaaacctttgctcatgcagggtcaccttctatgcaagatgagaccagctttcaaactcctgcgacaaaaatttctccttgatcggagctatcaaaccctggaatgcgagatcggctaactgggaatctatcaaggccaaaatgtcacacttgttcctcatatctctgaatctctggatgtagtcttgcacggtttcatcatgcctctgtctaactgctgtcaaatcagaaagtttcatctcatgggttccactgtagaagtagctatggaactgcttttccaaatcagcccaaccatgaacagaattataaggcaatgaagaaaaccatctgaatgctaacccagacaaagacaaaggaaccaacagaactctgaacgcaacgacagccgatgcttctctacactgagccaagaatcggctgacatgctcatatgtcgaaacattgtcttgccttgaaaattttgaaaaatttggaaccttgtatcggttgggaagcggaactctctcaaaccactaaggataagggtgccgatacaaatttccagtgtcctttggcttaagcccaaactgctccctcatcacatctgcaatcatgtcggcccagggcttctgctagggcactccttgcatctgctgctgtatcggatcaaattggttaagctaaggaacaaactggggttgaggagatccccctgtttgatattggatgtgaggtgaccgaggtgtatactgaagagtgaaattaccaccaaggtagttctgaggggtctgttgcacattgtacatctgctgttcaggtacaaacggggttccaacaagtggattttgctgagcaataggtgttctctatcctgttggtatctgttgcaccgtctgttgcgtaatcggctgaataatctgctgcttgatcggcgtcgactgtactggttcgacagtcggctgagtcggcgcaaacattgcagcgacctgctcctgagtcagccgattgatgttctgtccaacatgttgtggttgctccctagtcaagacacggggattaaccactcgcctttgcgccgcgatggtgcagctagtgctagagctgaaaccgctgccgttggctggactagtggtgcattggtagtatgttgctggttgtttgtcaccaaattcctatactgtgggaagacgccacctggtagaaagactggccccgtgttttgatgttcagctattgtgccatcaaccatagacttaatcatatttgttaaggtattgacaagcacccccgattgattgatcaaggcatgttgaacagcataatcaacctagtcttggaaattgttgcatcctggagattcttgctcctcagtatcatcttcatcaacatcctcgaccacaccatcttgaagcccctgacctttatcacccgaaccatctgcaacacctttagctttaccaccttgggatgagctcattccaggttcatcggcagcaaccaccttcaccttgtatttttgaataacttttccctggcgggtttctccaattgagttcatgaactgctcctgagcactctttatcattagttcaaactccttcttctgttctggtgatattttttctatagtaactgggacaatgttttcagtatcgacttcagatgataattgattggttcccggaggttttggatgcttggtccccggagggttttgagatttggcccccggaggatttggaggcttgcctgtcgatgccggtgattgtttctctgccatgagaaaaagttgtcgcaactcagtcccactgggtgtgccaaaagcgtgttgatgcgaaaaatacacacaggcctggaagatctgcttaacttcagtgcaggtccaaaatcttgcttttaggttcgtgagcgtgccagttgatttgatcctgcaatcaacaagaaagaaagacaagaaaaccgcggttaaatccataaacggtagccgatcggctagttgccgatgacgtatcatttatcttcgagccgatgtcatattgggatcgatcggcaattataggtaactaagataagactaaatctactcgatcagctgtagatattaacgatatataatccttccatcgatgtataattaaaccaagtgaggtctcctctactccgccggcccctccgctctacccgcggcctgctgccgccgctccgctatgaggacgagggagagctgagatgaagaagaggaagagccgagagtgtagaggaagaggggaggggagccagcgagctcgagctcgccatcctgcccgcccgtcctcgttgaccactaccgcggacgcttgctctgcccttcttccgctgcctcaatgtcgaccccccctccagttcagcttaggggcggtgagggcaactgggtcgacgcttgtggtgcctgcgggcgagccctggcggacggggaggggttgacggttgggggagggtcgtcggcggcagtggaggggcggagatggtggcattgatgtcgagaacgggcgaacgaggtgggcggcgacctcggcagtggcctaagcggcgaacagcttccatgaactcgcctgccactactccgcccgccgcccgccaccgttccgcccaccgcccgccgccgctccgtccatcgcccgccgccgctcgtttactccttgtagtgtaggggagaaagaggggggatagagagaatagggaggctgacatatggatcccacgatttttattattttttcgagacaaaattgctacataagcgccacgtgggatgaagacctagtcaaaggagccacgtaagcgccatgtcggccaaaactgccctccatactaccgaggggcctcatttgctcagtttttgtaagttgggggataggccatacccagttttacggtcaagggacgaaaatcagattgactgaaaaatagagggacctaaagtgaacttattccattttaaaaatccaaatgttatttctaacaaatcaaaggcccaaatatgccctgcgaagcaatgacaggccgaaaacatgtcacaccctgattttcgtttcaggatttataaattatttaataaattattattagaatttatattaaatgtttattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagcagttcagcaattatttaaatattaaattaatcattaaatggtctgattataattttgttaagtactttgagtgtccaagtattttcaggatttttcttgaaattatttgagcattggaagtatttttaacaattcaaagatcatttcagtgattaatttaattggaaaagtaattaaaattcaccttttccttttcgggccgaattaggaaaagtcctctcactctcggcccagtctcctctcagcctgcagcccttctcctctctttcccgaagtctgctgtgcgtccctcctttaatcagtccttggaagtagaagcccagcagaaagtctaatttgcctccctggcactgttcatcttcaagcttggacagagccgagccgcccgtgctgtgccctgtgcagccgccgcttcctccgttaaatccgcctcatccggagctccatttgcaaaattagttgaggggaaatattccactcatcttcctctatctttcccctcaagaatcggagcaagaggttgagtattttgcccgaatcgaactcgttttcgagtttatctccaaaaccgagttttgtttttcccggatcgatttcttgcgggaggagtccgatctcttcaatccaaggctataaataggaccccctagtcctcctctttcgtttgccccaactcccgtcctatcccgtgcctcctagccgccgcgccgccgttgtttagcctcgccgccgccgccggccatctccggcgccgccgcgcagccgcctccgccgtcgccgccgcctgccgccaccgccattaggtgtgttggagcgacgagaagctcggccgccccttccccgaagccgccggccgtcgtagcccgccgtccccgtgcaagccgagccgccgccgccgcctcttcgtcgccggccgtcgtcgtttgtcgtttgactcgagggtgagtaccgttgggttcgtctcgtcgtcctctacgtgtacatgtcctccaaaatcccggccgaccaccctagctccggcgaggtcgccaacccgggccggccattgatgatgtcatcatgacatcatcggtttttctttttcccgtttttctaatagattaaaacttcagaaaatcataactaattaaccgtaactccgattcgagtggttcaagttgctaaatttttctaaaatcaagatctacatgttaaaaatattcacatgtactgtttatgcttgttttttactgttttgttgattttttattcttttgctttagtttccgacgttctgaaacagagcgttttcgttgagcaaggttcggaagtgtttgcggaagctcaaggcaagtcacacagatcccaaacaaccctttgagcatgttgaacccgtttaaagctattattttatttcaactatgcattgtttttgaatgtcatcgggtggtgaacctttcccaattaattaatggccgaagatgatcttattttcctatgggttataatttgattagcaggaaccttacatattggattggttcagctaaatgttatatgtatgtttgcttagccatgcttagaaacattagctaattaaaggggattaaatataaattatattatattattcttattaattatggttatatttaatggtagctcacgatgattaatcgtgtgatgttaattaattgataattaaaatctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgagaagcggcgagaagtccgtgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagctgtgcccgcggttatgggcgagttgagcaatgtttttcgtgattagtctcacactactcatcaatgttaataatgtgataattaatttgactcctggtttggaatggataattcctggtttggaggtttgatcagtacgaccggggttggttgttcaggtttggttgggcctgagcagcatgggtgtgctgttcagtgttgatcaaaattgatgattaactactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttagcttataccccagttgagctgcctgtgggagtggagctgaagccatcgctagaccgttaattccgctgctgttttcttttcttttgtaagtatgtaacgttattattatgatgggtttgtatattaaaattgtcagtttgtgtacctcggctgattcctggacgaggattttatgcacaaataagttcggaaattactagtgaatttccgggcgtgacaaaacacaacttgtaacgccaaatttcagatctattaaagcccaaatatcaaatttaatataaagcacaccaacaaaattggaaaacttgatatgcaagttgatcagcagtcacatgattccaacacatatgtgaggaccactcctttcccaactctaactccacgctagatcaaaccacaaaaatatcaccacacttcttcccatcaaatcaccacttctttaattatctgaaaacaaagattaaacttgattattctagattaaattagatcaagtaaacttagatgttgaaagcaacagactattatactaccatacaatagatcaaatcatatattatctgaaaaccaaaattaaacctcattatttcaaactttgattagatcaaatagtcttagatcaggaaatgaggcaaactattacagtaccatacaacatatcaaaaacaaagttagcaccatccttgagattaatatgccaaatggatacaccatgtatgaatttgaaaacaaattacttaatttagtaagcaatatatgattcaaaagatgtaagaatacaaaaaaatttaaaactgcaaaataatacagaacttaatgtctgaaattgcatttagttcatgtttaaccacaatgatctgcaaaactaatcttgaaaactaatgtaaaataaattaaggcagggtgaactcatacattccaaaatcttctaatctacaaataatgtgaaaaacatttggtcatgtcatttgtgcaaaatcttctaaaccgccgcgagcccatgccctggcctctgtccggcgtagatccgtgcgcggcggcgcaaccaaccaatgggccacgcatgcgaccctcagcgcgccaccactccattcccacgctgaccgccacgagccccaccccggcctccgtctagcgcaggtccttgcgcggcaacatgacccagccacgggccgcgcacacggaccctctgtgtgccgttgcttcctgcccatgagcccccacatcgtcttctgtcctctgaaggtccaagtgctgcggcgtgacactccgtgccggcatcgacaaggtatcagccccgccgcgaagataagaagggtcagaccctgttttggcaagataaatgtgtactaagggcattttggtcattttgaacaagatgaaatgaaatcctaacggtgtagtaaaaataaggtcaaacggcgactttgattttgaaaagtaaggttgaaaggacttgatgtcgcctggagggggtgaataggcggtttaaaaatgaatgcggaagctaaaaactaaacagggtcggattgtctgatactggtcagatagtcctatggatcggattgtctgaactgagatcggattatctgacctgcacagcaacaatcaaacaagcaacaacctaaaaactctagatccaatccacaagcaaggaggtgagctcaaccaacaacaagattagcatggcacaaagcaatgcaacaagaaggtaaagagagtgaggatatcaccgaggtttacacaacgatgtatttcccggagttcaaatccttgaggggattctagccttcgttgaggagctcgcaaagagccgggtctttttcaatcctattctcgtgaggttgcacaaatgcactcttccttccactaagggtatctcttttcttgtgaaggcaagatccggccttcacaaacttctctcgaccaaccacaagtaggtcggtgtcctaagaacgacaagttctcaacctccaagagtaataaacaccacacaactcttggacaaatcctagtgctcaagatcaagaaaaacacacactaggctcccaaactccaaatccacacacaaagatccaagtcacaaacaatatgggggatttgagatagagatggagagagctcaaagatccaaagcactaagcactaagctcaacccaaaacaagatttgaatgaaatgaatttgggcaaccctagaaaagggttggtggggggtttatatagatccccaaaatgtgagcattggaggggaatctttcagcccaagacggatagtccgatattttaaacctcaaaggaaacgagagacagatgtcacgccctaaaaattgcctaaattaaaaatgcattgtttaaatcatttttagaaatttaaattaaaagcctacaagctaaaccctaattatctaggaaaattttcaacataaaaatgagctagataaaattttattaaatactatacttgctcctctattttctagatttttctgggaattatttgagcaagggaagtatttttaataaatgaaacatcatttcacgaattgttttaattggaaaaaaatcttaaaagtcctctcctaggccgttgggccgtttccggcccaacattctctctcccgcgcgcgccaaagccggcccacgccggcccaacccacccagccgccgccccccctcaccggtgaccgacatgtggggcccacatgtcgggcccttctcctacctccggccggcctagccgagcccgagccgggcgcgccgcgccgccttgccgccccaaatcccacccaatccggccccgtttcttccggatttttgaggggttttgatcctctcgttttcctctatctttcccctcaagaatcggagcaaatcgttgagtattttatccgaatcaaactcgttttcgagtttatctccaaaactgagtttttgatttcccgaagcgatttcttgcgggaggagtccgatctcttcaatccaaggctataaataggaccccctagtcgtcctctttcgtttgccccaactcccgtcctctcccgtgcctcctagccaccgcgccgccgttgttcaacccgccgccgccgccggccatccttcggccacgccgcgccgtcgcgttcgccgtcgttgccgcctctcgttgcctccgttaggtgcacacgggagcgaggaagctcggccgccacctctcctttgccgccggccgccgtagcccgccgccaccacgcaacccgagccgccgccgccgcctcctcgtcgtcggccgtcgtcgttcgtcgttgggctcgagggtgagtaccgttgggttcgcctcgtcgtcctctacgcgtaggtgccctccaatcgcccggccaaggtccgtagcgccggcgaggtcgtcggccgacctgtggctgccttggatgatgtcagcatgacatcatcatcctttctttttcccttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttacggaggagagcgtttccgttgagaatggttccgaagcgtttgcggaagcccaaggcaagtcacacagatcccaaacaaccctttgagcatgttgaacccatttaaagctattattttatttcaactatgcattattttcgaatgtcatcgggtggtgaacctttcccaattaaataatggccgaagatgactttattttcctatgggttataatttgattagcatgaaccttatatattggattggttcagctaaatgctatatgtatgtttgcttagccatgcttagaaacataagctaactaaaggggttaaatataaattatataattattattattaattaaggttatattcaatggtagctcacgatggttaatcgtgtgatggtaattaattgctaattaaaacctggttaaggtgggttgtgagcatatggttttgatggttgtgctcatgacaattaaggaccggttcacgagctactgttgtgaaacatttatcgtgccaaccacaagccagcgtgggcaacggctttatcttgtgtatagcatgattcattacggggtgccagactgagaagcggcgagaagtccgtgggggtcgctggggagtccatgcctctggttgtagagggggtgattatgatccaggtacggtgcactgtggtgagttgtgttgtgcaaggggtattgtcacagttcctttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgttttttgtgattagtctcacactactcatcaatgttaacaatgtgataattaatttgactcctggtttggaatggataattcctggtttggaggtttaatttgttcaaccggggttggttgttcaaatgtggttgggcctatgcaacatgggtgtgttgtatggtgttatttaatattgattaactattcaactgtttttaccattctcttaaatatttattaaatgctgtttctgcaaatgagctatattatgccatcctttgttatcctgtgcacttgcatatttgctgtgtgacttgttgagtatgtcatatgctcattcttgcaatattcattcatcagaagacgagtatctcagtgaaggtgatgatctggaggattaggcttgttcttggttaagatgcctgtggagtggagtcgccatagctgttccgtagtttgttatagttttattttttttccgctgcgtagaaagttattctttgagaggaactatccacctctgtaataatttatttatttgcgaatattagaaagttatttatttgtactctattatcaatttgttattgtgtgcctcggttgattcctggacgagggtttaacacacatgtaagcgtttggaattttggatagaaattccgggcgtgacaacagagaacaaagttccatgaaattttggactttctgatacatcggactatctgatgtgaaatcgaagagtccgatattttagaagtaaaaacttcgtcctcaaatagagactcaagttccatgaaaattcggagtatttgtgtcataggactatctgattcaaaatcggatactccgacacttagaaaaactcactcgagaggatttttcaaatcaagacagagagtgaagttctgagaaaaaagggatagaccaatacatcagatagtctgatgttgcttaagtaaaaaggcaataacttttttactccggagtccgattttcaagatcttggactctatggaaagcttgtttcataagctatcaaatacatcataaaaatcagccaaaaccttcaagagatgttgaaaaacttgcaaagaaacccagtgtaagtgttgtgacatgtgaaacaacccggagttcaaattttggtttacgtttttcaactcacacaaagatgaaaaattttgagtactagtacttgactaattatatgcatgtggtatccctcttaataatatgacataataaactcaaatgtaaaaaggaaagttataccataggaataccttcacaccattttctttcttcacttggagggttaccaacgtcaaggtcatttgatcatcgggaaaatctcatcttcttgatctttgacatttcatattccatttctcaaatgattggtgtagataatccatggcttcaaatggtctcgcacggtccatcacgacaaagtcttcgctcgtccttcaccaccggtttcagttcgtcggcatcaagccccttgcttgccatttaccaccgcatggtccatcgcagctgagtgtcacttgcgcttcaccgtcttgccataggtagtcacttcatatcacgcatcttcaacttcttgccttcaattctcatccatcggcaaagttcgtcttctagcttctcacaccatctttatttctaacaatcttgaaccatggtgtatattcttcaacatatccatcaactaatgatgggatctcatcaagtatactcatcatcaacatttgactcttgtttattcccgatatgtgaggtatcatcctttttgtcattaatccacaattctatcacttgattctcacatatgagccatcaacctttttttcttgatgccgtaacataatctatcatcacaaacttatagcaaaggttagttccaacaaccgttgtcattaatcaccaaaactcctcctaacacaagattagagaacttgacctttcaaaggttaaataagaaaactcaaaaaagtatggtcaaattgatagttaggcttcgaaacagggtcaaatgagcaattgtacctaaatttatgtagggcctgaacttcaactcgacgtcttatcattcacactttacgatagtgtttatgtagtcttcaattttttaacctttacagcattgactataaataactttaaagtaaattttacaaaactataagtactttggctaaattatcataaaactgcatttaacaagatgtatcacaaaactacatatttaacactaaatttatttcagaactatagatttagggtgaaatatcccaaaactacatatttagtaacaaatgtattacaaaactaaaggttaatgtcaatttaatcacaaaacatggatatttataactcaatttaacattaatgctaaggatttataaccaaaaaatctatagttttgtgatatttttattatcaaatctgtagtttttgcgacacttagtcttaaacttatagttttataataaattattgttaaatctgtatttttttacattactttaaatttgtagttttacgataatttggacaaagtatcagtcgtttgtgaaattttctctaaattttaaaacacatagtttggacattttaaaaaggtatgtgattaattatcttaaaagacacttttataatattatatagctcattataattttacaaatttattctaataaaaaatttgttgatcaaaatatactaagaaaaaaagtcaaaaatatatgacccgtatttaagtttttaaccatcccactggttacttgtagagaaaagattttagcggcacactaatattttagagtaaattttacaaaaccccatattctatggtgaaagttgtagaaaatcaaaggtattataacacgtggcatatagcttcaggtattatggttgtaaagtttcacaaaaccctaaacttatgtatgttgagcacgaatttacttaaaattttaaaacataaagtgtataatttttttaattattaaattcttgaataaggatgataaggctgatgctttaattctttgttactttgaaaaaaaatattcaaatatgcttaaattaatcaagtttttataaaggtggagtcttatgaaacatatagacataaaacctatgattatgtgccacgcgtcataatacctatggtttgctacaactctacccattctctaaaatttactcttatttttttagagtaaattacactagcgtgcgcggccggcagccggcgagaaaggagcggcgcgcaggtgccggctggcaggagtagaggagccgcggcagtggggcagcagggcgagctcgagctcggcggtgcaagcgcgacggcgacaacagccatgagggggccaccgccgaagttgtggggtgaagaggccgagccgcacgcggggggaggtgtcgccggccatgctcggggggaggggtcgccgaccgcggccgcgcgtgcggggggaggcgtcggtgagctcggcgcgaggggggcgggagcgagctcgacggcggcagtggggcggcagggcaagctcgatagcgatagcagccatgtgggggccaccatcggagtggtggggcgaagagaaaggcggcgcacttcgttgggtggcagcgcgtcattcatgcgtcgccagccacgccggggggagaggtcgctgaccgcggcagcgcgtgcgggggaaggcatcggcgagatcggcacgggaggggtaggcgcttgctcgacggtggcagcagggcagctgggcgagctcgagctcggcggcacttgctcgacggcgttagcggggcgaccgtagccgcttgccgtgcgcgcccgcggccgactggagcgaggtccttccccttccccttcccctcctccttcttcccgtactcgcccatccgtccctcgtcgtcactgtcttccaggatttctcctccaccggacagccgccgtcaacgcgcaggcccgggaggtgggaggcggcgcaggacgcggaggccggagcagcaaactccacagccggcggcggcggtggcgagaggccgagggcctgcgggtaggtctagctcagcggggagaggaggggagcggcggccgtggatctcattgccgtcagcagcaagaaaaaaggaggataaaaaaggaagaggggagaaaaaatagaaaaattccatgtcatcatccacgt

SEQ ID NO: 35251 - DNA, 15506 bp, Oryza sativa
aactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttacttattctatgcataattttgaggatgtattttagagtcgttttgggacgcgacatgcaactaataatcaggctgagtatgaagcagttctcaagggtttataattgctaagggaggttgaagccgatgctgttgaaattatgggagattctttgttggtgatcagtcaattggcaggggaatatgaatgcaaaaatgatgtgttgatggtctacaacgagaagtgccgggaattgatggatggatttcggttggtgactcggttggtgactctaaagcatgtgtcccgggagctaatgacttggctcaaggggcatccggatataagccgatggtaaaagatattgaggttgaagttgccacagtagcagccgatgattggaggtatgatgtgtatcaatatttgcaaaatccatcacaatcggcttctcggaaattgcgctataaggctttgaagtacaccttgttggatgacgagctatattatcgaacgattgatggggtgttgcttaaatgtttgagtgccgataaggctaaagttgtgatgggagaggtgcatgaaggtatatgtggtactcatcaatcgtcacataagatgaagtggttgcttcggcgtgcagggtatttttggccgacaatattagaggattgcttccgatattacaagggatgtcaagattgtcagaagtttggagcaattcaaagagcaccagcgttggctctgaatcctatcatcaagccgtggccattcagaggatggggtatggatatgatcggtcagattaatcctccttcaagtaaggggcatagatttatattggtcgcgaccgattatttcaccaagtgggtagaagctattcctttgaaaaaggttgatttaggggatgctatacaatttgtcaaggaacatatcatctaccgatttggtatcccttggaccataacaacagatcaaggttcaatctttgtgtccgatgaatttgttcagtttgccaatggtatgggtatcaagttgttgaattcttctccatattacgcacaagctaatgggcaagccgaggcatctaataagagtttgatcaaattaattaagagaaaaagttctgattatcctcggcaatggcatacaagattagctaaagcattatggtcttatcggatggcttgccatggatcgattcaacttcctccttataagcttgtttatggacatgaggcagttttaccatgggagattaaaatcgactcaagaaggataagcttacaagatgagttgacagccgatgaatattataatctcatggccgatgaaacggaagacctagttcagtctaattgagagcccttgtgaaagttactaaggataaggaatgagttactcgtcattataacaaaaaagtggtacataagtccttttcagaaggagaattagtttggaaattgattctaccgattggaacacgtgataataaattcggcaagtggtcaccgaattggaaggaccgtttcaaatccataaagttgtatccaaaggagattatatgttacaaggacttgatggtgaagtttatggatgagcgcttaatggcaagtacttggtggtgaagtttatggacaagtgcttaatggattaattcatgatcggctgaggtttgccaatacatgcaaagccaatgtggttaacatcgcctttagatggccgatatatgttatatcgccctcagttgtttttaattatcataatcggttgtgttctgccgatgtatgatggttcataattgacatatcacccttagttcaaattataattttatcaatgtcttcaacattgcaaaattaggggggcagagatatagaaaacatggatttcaaaagcgaaatttaaaggcaggagattaacatggaattcattacagcccaaaagtttgcatgtttaaagttaattttacaagatatagctcatccagatatatttctttggatggctgatattgccctttgtctaatttgatccacttcatctatcatcttggcgtcggccgcatcagtgccagggatcggcttcagagattttgtcaacttagttaggtgtttgatagaagccttcaacttggacttttgatcttcaatggcttttggcaaatcggcaagctttgcttgttcgagagcaagttgtgcattgcattgctctagttcagccaggagctctatcatccgattgtttagctgatcaatgtttgtttgggttgcacttggactggcttccaattcatccagtttagctgtttcctcattgatagaagctctgtttgcttggatggttgcagttgcttcaagatctcttctttcatgtcgatcggcaattctattctaggctttttgaagcttaagccgatgttgctcaaggtatgctgctagagtaatggcttcgactagctcatctggaattttgtcatctatttcatggagcctatctctaatagggaccacctgcgattattccaggcggtctatttatgtggtccgcctatgaagctccatcttcgcaggcgcccattttttgccacctgcaaaattcattcacggcaacaccatttaccgcctataaaaatctggccgactatatagtcttcttcctccccgagctcctgttcatactcgatgattttctctctcttaaaggcaccaaaatataggggggaggttttgaacttcaaatcttcgagggatttttctactgtagttagatctatgcctttgcactctatatacataattttttttgtaatttaaacccccatttgactatggatctacgtatgcaaaatagtgaggggaaaagctagctcccatgattgttttttttttaatttgctttgatatgtgtgctagatttatgtgtgtttcttgatgctatggggttctctcatcttctagtgattttataatgtaatataatggactaaattatatactttgctcttatgtatttgcctagatctagataggagagagaaaacttcatgacatgaagaaaccaattattatgtttaatttcgtacattatgattttgttggatttatgtgtaatctttgatgtcatgtggtcgtcccatcctctagttggttaaatataatatgttaacttcaaaatgttacatttgatttcattatagttatattttgtagaaataagactagtatgttctcgaaaatttataggttccaattcgttgtttacaaatatatttgtaaaaaaaatttattaatataaattttgcagagatatggaaaggctcgaatggatgtatcattggccgatgtttttatcgctatatatggaacaagtgtctaaatttattgatattgccaaggagcacgctaaggagggtgttgacggtcgttatcgatcagttttgaccgtcaatattaccaaaataggagagaactagtgatgctagcaatgcatatgtttgctagaataataatattccactagtattaggtatactaacctttttgtagagaataacactaaagtggaggagaattgacatcaacatagacgataaatcaatcggacgatgtcgagaaccagacttatgtatgaatgggccaagaactcagaattgacacgatgaattgggccaaaattcacaagtctacaaagtgaagcaatagaggaggtcgccagccgaagatgggctggtttgggccagcccatggttcagccgaaccagggggttcggccgaaccccatctctaccgttgaggccagggtttggcatggatgtccaagattgcatcccaatgacggttggagggtactttggacaattccccttccaaaaccgtcataaccacctctatataaaggcttcactctcttcacttcaacacacacctcaagcaatatctaaactaccagatactactctaatatcatcgtcatgacgtagagtaattgcataagcaaacactatacccgcaccaaagcatctcccagataatctagccgtatattcagtataacaagaacataatgtaaagtaggtactcatatattcggagagtatttcaataccataaatgtatatagaagagtattctaataaaagtacaaatcttacaaaagagaagagataagctactagagccatacccgaactcttccgaaggcttcgaactttccatttttagctttaagtaatcgatgctgcgggaagtcgtcatatagaagaagaagaagaagaaggagaagaagaagaagaagtggtagcaccatctccggccatccctgtaagtttcaatcttcatcttctcaaatcatatcggctatcacatgactctaactgcccatattattttcagactttagccgatatgtttatggatgaagaagaagagaccacgagcacagctttggcacctttagccgatgatgtaaaagcaatcttgctagatatttcaaattggctagaaggttccttcactggtggagaaaccatctttcgtcggtcggccgaattccacaatagtcccggttgcaataaaaaccggggctaaaccctttttaaccgggactaaaaatcatctttagtcccggttcaaatgctgtcagggcctgtcaggcccccccgggatctttagtcccggttggtaacaccaaccaggactaaagatcgtaattttagtcccggttggtgttatgaaccgggactaaagatcccggggatctttatccccggttggtaacaccaaccgggactaaagtcccacccctatatatatgtcttcttcctcctccagctgcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggtgctatgttttgcacacttttttgtctccaaaatttagttgtaagttgatgagagaaaaaatttgtatggggaagaaagaatatatagaaatttagtttatttgctaaagaaggttttataaaatagttgagaaggaaaatatagtgaaagttaatcttaaataatagaaaacaaactaaaatgaaaattaaaagaagtaaaacacattaatattagtttaaaactttagaaatagtaaataagaattatttggtgtaatattttataatttttgtatgaataatgatatgtcattattgtatgactgttgaaagagtttgtaattattttataattattgtatgactatcattattgtaagaataattatttgtgtatgattttttttatgtcatgtagatggattggtaatggttgtacgctgaccggcggtccaaagagtttattgacggcgtgcattattttttgagagtggccaaagctaacaggcataagggttttatttgttgtccatgcaataagtgtaagaatcagaaggagtattctgcatccaggactatttatttccacttgtttgagtcggggttcatgccaagctataattgttggacatcccacggagagcaaggtgttgaaatggaggaagatgaagtggaagagaacaatattccggactttgctcagtacgttggatttgaaggaaatcaaatgggcgaggaggaaagggatgctgatggtaacgacgctgcggatgatcttggtcatatgttgcaggacgccaaggaggactgcgaaagataaagggggcccataaattggacaagatgttagaggagcacagaatgtcgttgtacccaggttgcgagcaggggcacaaaaagttggataccactctggagttcttgcaatggaaggcaaaaaatggtgttagtgacaagacatttggcgatttattgaaactcgtcaaaaacattcttccggagggaaacaaattgcccgagacaacgtacgaggctaagaagatagtctgctctctaggactggaagttcagaatattcacgcatgtccgaatgattgtatcctatatcacggtgaggagtacgagaacctagaagcatgccctgtttgcaaagcactacgatacaagattagacgagacgatccagcagaagttgatgggcagctaacaaagaagagaattcctgctaaggtgatgtggtatttccctataataccacggctaaggcgtttgttcaggaacaaggggaatgctagaatgatgagatggcacgctgaagagcgtcaacaggacgggatgctgagacaccccgccgatggctcgcagtggcggaacatcgatagagaatttaaagactttggaaaggacgcacgaaacatacggtttggtttgagtacggatgtgtcgcgaccgagaaaaataccttttcccgaacgctagtgtattaatccccgtcccaggaaaagccggggtacaccaaacaaacatgatacaaaaggcacatctttattatatcgataatatatacattattacaaaggcgcttcaggcctgataaacaaaaataaacagcagcggaaaagcgggcctacggctccatcttcacaggcgctcaactggggtataagccaggactccacctaagacatcttctccgaagcttctcttactgaaggggggaaaagattgagcaagaatgagtacaaccacagtactcagtaagccacaccggcagatgcatgattaatgcaagggggtacaaggggtaataatataggggttaagttttgcagaaaacagcatttaaaagtcacttagttgcccaaagccattttataaagacgatcctagagttacacagtattattaatcaaggccgtgaaccctcacgaacctgccttaacccaaggcctacgatgattcagaccgaactagcaacccgacccttggtcccagctcgtcccaagccaacccaggccaaccattccacattttagttgttaagcaaattttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatgtcacgcccggaatttctatccaaaattccaaacgcttacatgtgtgttaaaccctcgtccaggaatcaaccgaggcacacaataacaaattgataatagagtacaaataaataactatttaatattcgcaaataataaattattagagaggtagatagttcctctcaaagaataacattctacgcagcggaaatataaaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcatgtgcacaggataacaaaggatggcataatagggtttcatttgcaaaaacagcatttagcaaacatttgagaatttaataaaacagttaagtaataaacaatattaatccaacgctatacaacataccctgttgaacaggcccaaccattctgaacaaccatcccggctacacagttctatctccaaaccaggaatataccattccaaaccaggagctaatcaaattattaccaattaaagcatcattcactatggtgagaagggtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggaatccccagcgacccccgtggacttctcgccacttcaaagtctggcgtactataatgaatcatgctatacaaaagataaagccgttgcccacgctggcttgtggttggcatgataaatgtttcacaacagtagctcgcgaaccggtccttaattatcatgagcacagccatcaaaaccatatgctcacaacccaccttagccaggttttaattatcaatcaattaattaacatcacacgattaaccatcgtgagctaccattgaatataaccatcattattaataatataatatattataatctatatttaacccctttagttagctaatgtttctaagcatggctaagcaaacatatatatagcatttagctgaaccaatccaatatataaggttcatgctaatcaaattataacccataggaaaataagatcatcttcggccaataattaattaggaaaggttcaccacccgatgacattcgaaaacaatgcatagttgaaataaaataatagctttaaatgggttcaacatgctcaaagggttgtttgggatctgtgtgacttgccttgggcttccgcaaacgcttcggaaccttcctcaacggaaacactctcctccggaacgtcggaaactaaagcaattaaacaaaaatcaacaaaacagtacaaaaacaagcttaaacagtacatgtggatatttttaacatgtagatcctgattttagaaaaatttagcaacttgaaccacctgaaacggatctacggttatttagttatgattttccgaagatttaatctattagaaaatcgggaaaaagaaaaaccgatgatgtcatgatgacgtcatcaaaggtggccggctcggattggcgacctcgccggagctagggtggtcggccgggattttggagaacacctacgcgtagaggacgacgagacgaacccaacggtactcaccaaagcgtccaacgacgagggacggcggccgacgacgagcttgtgcggcggcggcggttcggtcgacggcggcgacgggtctccggcgaccggcgacagcggggagagggcggccgaggttcctcacctccgtgcgcacctaacggcggcgaggggaagcggcggcgacggcggaatcgacggcgcggcgcggctgggcgtcggccggcgacggcggcggcttgctcggcgtggcggcggcgctacggagcacgagagaactcgggagatggggcaaacgaaagaggaggactagggggtcctatttatagccttggattgaagagatcggactcctcccgcaagaaatcgattcgggaaaaatctaaactcggttttggagataaactcgaaaacaaattcgattcggataaaatacccaatgatttgctccgattcttgaggtgaaagatagaggaggatgtggggataaaaacccctcaaacaatcggaagaaaaagggccggattgggtgctgattcggagcgggagacggcgtggcgcggccggcttgggctcggcttgcagccggcctgaggttagggaagggtccgacatgtgggccccacatgtcggtgacccgaggaggaggggcgggcggcgtcggctgggccggcttgggccggttcggccgcgcgggaaggaaaaggatgttgggccggattcggcccaacggcttagggaggggtttttggaactttttaattaaaataatttgtgaaatgttgtttcatttattaaaaatacttcccttgctcaaataattcccagaaaattctagaaaatagaggaacaagcaaagtatttaataaaattttatctagctcatttttatgttgaaaattttcctagataattagggtttagcttgtaggcttttaattttaatttctaaaaaaatgatttaaacaatgtatttttacattagacgatttttagggcgtgacagtccatctccatccgtgtacttttgtttataaccagactgagccacaaactaagccttacccactagacatgtggaagtacggtagtgctttacatcagaggcctgagcttaatccttatagtacccgaggtacgactaaccaaacccaaccacgcacctcgagcccagcctaaaaccatttttgggggttttgaatagagggggaggtgtgtgtccaattccaacaaaagccatccattccatagcatccaagtgatatgaaaattcccaaagtctaagttataaaaaccacctaatgttgtcctattaatcagcgaagcatctacctaaattcatactagtggaaccatgaatagagtacccactagttggggttttgtttatcctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacagaagctacgcgaagcacacaagcaaagctacaagcctaaaaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaagctttgcaactataaaacatgtgtaagcgctagcctggaaaagacaggaaggctgcgccgttgacatgcgcactccacatgtcaacctaagggaccaccgtagaccgagtacacagagacggtccacgggtcgacagaagtggaccccgtctgtcaaccgaggcgagtggccgacaaacgaactccactagacaccacgcgagctgcacacgtggaaaccacgcggctaccgagcgggcacactaacacggtcaccacacgcacaagcgaacgactaccgacaccggtacacgggtaccggggtcgacaaccgcacaacgggtacggggcgacaccgaaagaacgaggacggggcagcgagaggagagatccttaccaccacgcgacgaggcgtgggaacgacaacgacgaacgggcgcggcggagacagatgggcacaacggagacgaacggcgaggggacggcttcggcggcgatccttggacgaaggcgagacgcggccggcacgaggcttgacgacgcggagctgaggacgaagacgacgacggggctgcagcggcacacttgacgaacgcggacgacggacgagaacggctcgacggagggacgaacgccacgacgatgaggacgacggacgacgacgacgacgcccggggccggcgaggagacgacgagggcagccggcggcagctgcacggagacggggacgacgtggaacgcgccgctgcaaatccgatgacggaggcggcaccgcgagacgacgagccggcgaggatgaacgggacggccgaagggacgtcggcgacgatgaggatggaggccggcacgggcgacggcgttccggcgaaacagaggagcagctggaggtgaggacaacgctgcgacgtcgacggaggagatggcgacgtcgatcggcgcaccggcgacgtacaggagccgaccggagaccgggaggtactggacgccgacgaggaggccactccggcgagcttcgggcgaggaggaggtgacgccggggaaggagacgatgccgcggtgtcgaaggaggagacggcggcgtcgatcggcgcaccggcgacgaacagcagccggctggagggagtacagtggcaccaatgccactggttgccggcgggggcaccgttccggcgagtttccggcgaggagacggtgaggccggtgaaggggacggtgttgcagagccgagggaggcgacggcacagccggacggcgcacgggcgaggcgggaaaggcggctggaggcggccagcgcgggggaaagagaagggcgacggcgggaacgagcctccggcggtcaccgcgcgaaacggagggcaggccgtgggagaggaggcggctgcgaggccgagagaggtggtggcgcggccagccgacgcacaggcaaggagacagaggcggctggagacggccggcggcacgggagagaggggacgacggcggggaggtggctagggaccacgggagatcgcgggagggggctaaaacgatataacggagcgaggggattccgttttataggatgggggagggagccgggcatgggagtgggcggaacggcgacgggaaacacggccggcggccatggaaggtggccggagaagacgcggccgttccgggcgttagagggcacgaatcaagggggaaaatgggggaaatcaaagaggatggaaaggggattaaaagcccccacttaatttggaaataagggaattgatttgcgcggatttgagggaggaagaaactagggttcacgggagagagagagaagctgggcgggaggaggacgacgaccgggcggtgggacccacgcgcggcgcgcggtcagcgcgcggcaacggcgcgcacgcgcgcgcacttgcgcggcacgggcgggagggcgccgctcgggttgggcccggaggcggcccaggtgggagggggcggggaggcttgggccgagaggcggcccaggaggagaggagggcgaggaggcccgggagagagaggggaggggagggagctgggccgggagggggagggaaggcccaagagaaggagggagagaaggagagggagagaaagagagggaggaagagaggactttggccgcgggccgggagagagagagggaggactttgggccaaatttggcccaaaagaaaaggaggattatttttaggtttttctttttaataaactttgataattgtttttgttgcttaataattgtttccggtgctctgaaaattcaagtaaaatttgagggctccttttagaccaaggagaatttaacaaaaattctccgggccatattcaaatttttcttctacgtattttagtgtttgccaatttcttttcgaattttaattaattctattattccttttagcgaatgatttttaatttcgggatgaatttatcaggacgtgacaaatccacccccctttacaagaatctcgtccccgagattcgaggaggctagcatgaagataggttgggcggtcttctcttcttgtctgacttcttccgtcgcttcttctataacgaacttgcctagcaaaacttctccactctggactgcttgtctcgatctcctgttgcagatggaatcttctcttcacccgacttgtccctggttgcacctttaactgactcagactaggctgcggtagttgaggatggggtttcagttccagaacttcttatccttggtgtcaatcctcatacaagttacccacttcacgtcatgcgtcgacaccagcttgtcattactaggataccatgcttgtcatcatgagattaccatgcttgtcatttacttctaacttgccaccaactgcctcatatgagctttcctgctctccgggtgctagctacttctgctattcgatgcaagggtcgataactttgcctttgaattatgtttcttaacagaaccaacttatcccccttgacatgctttgacgtcttcccaaatggctttactgctggacttcttattgtctgatcgtgatcctgccaaatctgaagcttcgttgttagatgtgcttttaatctaacatctgtagattatctttgaacatatcacttggttcataactgggaatagctctcacgaacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaataaacatctttttcgatatcttctatcaatcatcttttgacctttgtcaactaagtactcttcactccgagagttgtggatgcttctggtgacgatgtggtacttgagcctgctgcctttcagagcaaccttcaagtggttcgtcaaaagctagactggcggttgttgcctttgatccaaagaggacacatctgaaactctcagtccaaacaaaagtctctttggctttttaatccaacacagtttaattggtttttttttccatcaacaaggttggttattaactcgagattagaacatagttcctctggaatgagaccctaggtctcctttgacagtaaacaattatacgcatgatcccatatcagcatcttccaaaataatcctcatagaacttgtttttatcacacatgtctcccttattacatgaatacaaggccctaccttaaacaaaaagggaaggtgcttagcatcggtacattgtatcctcgacatgattcatccataaacataacaaactcattgtttataatcatgaatatatttatttattacatgactgctgaaactcccggttacagtgataagtagcgaactgaaaatcacaaacatggctactcattctagttctggagagatatagctggcattgttctagtgactgcatcatccttgattggttctgtgatgatgtgataggactgcatattgctatcattcacaggagaagcttccttctgattgctggttgaagcgaataacggtcttctgcttggtatcgccctcctgaggttgatttcccttcgctcggcctggagtaggtcggggagagaaacaacttcttccatcgacgacaataaaaataaaatatgagtaatattaatctagggtgaattcattagttgagataatacacatattgagtaaacttcatttatgcaagatttagaaactatagaatcaaattcatatagcaaataatctaaaatcgggagaattagaagaatacactattcattag

SEQ ID NO: 35252 - DNA, 3582 bp, Oryza sativa
gggccaaatttggcccaaaagaaaaggaggattatttttaggtttttctttttaataaactttgataattgtttttgttgcttaataattgtttccggtgctctgaaaattcaagtaaaatttgagggctccttttagaccaaggagaatttaacaaaaattctccgggccacattcgaatttttcttgtacgtattttagtgtttgccattttctttttgaattttaattaattctattattccttttagcgaatgatttttaatttcgggatgaatttatcaggacgtgacaggatggcatgaatccttttggagagatgagcagcggccatagcacttggcccgttacgatgtgtatccacaacctcccctctggctatgcatgaagaggaagtacataatgatgccgattattattcaaggccccaagcaacctggtaacgacagcgatgtgtacctaagaccactggtcgaagatcttaaactgttgtggaagaaggaaggtgtccccgtgtgggacgaggataaacaggaggagtttaacctacgagcgctgctgttcgtaaccatcaacgattggcctgcacttagcaatctatccggatagtccaacaaggggtacaaggcttgcactcactgtatggatgaaacagaaagtacgtatcttaagcactataggaaggttgtgtacatgggtcatcgtcgattccttgcagcaaaccacccgatacggaagaaaggcaagcactttgaacataaggtggaccaccgtatgaaacctaaatatcgcagcgggaaaacagtgtttgctatagttaaaaatcttaaagtagtgttcggaaaggggactagaaactagcctatagagagcgaagatggttacgcggcgatgtggaaaaagaactctatattttgggagttaccctattgggaattcttggacgtccgccacgcaatcgacgtgatgcacctcactaagaacctttgcgtaaaccttcttggcttcctaggtgtatatggaaagtcaaaagatacactggaagcacgtaatcatctgaagcatatggaacaacgcggcgaccttcacccggaaccaaaggagaaaggaagccattacttgagtccagccagctacactcttagtaaggcagagaaggaaagtatgtttgaatgcttggagagcataaaggtaccgtctggatactccatgaatatcaagcgaataataagcacgtaggagaagaagttcaaaaacctaaagtctcatgactgtcacgtgttcatgacacaactggtaccagttgtaataaggggtatccttccagacaatgtccgggcaacaataacaaagctatgtgcattcatgaacgcaattttgcagaaggtcatcgatccggatagattagaagcccttcagaatgatgtggtgcagtgtcttgtcagttttgagttgatatttccaccttcatttttcaatataatgacgcatctgctttgtcaacttgtcaaagagatcagtattctcgggcctgtgtacctccacaacatgtttcctttcgagagatacatgggcgttctgaagaagtatgttcgtaaccatgctcgtccagaggcaagcatcgccaaggggtatggaatagaggaggtcattgaattttgcgtagaatttattgaagaccttcgcccaatcggggtacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctacttcgcaccagaaacatcggtaagtccgatgcatggattacacagcatcacattgatactttccccgtgtggctacgacaacatctcatgggtaacgagacgatcaacaaacaactggccttcctggtgaggggaccatctgggtcgatcgcgacattccagggatatgagatcaatgggtacacattctacatgagagcccaagacatgaacagcacgaaccaaaacagcgctgttcatatcgatgccatgggacgcgatggaacaactggcacgtattatggtgccatcgaggacatataggaacttgactatggtcctctcaaggttgactggtcgaggcgtaatgattgatgacagtgggatgacaacggttgaccttaacaaggttggatactcggacgaacattttgtccttgccaatgatgtaacgcaagtcttttacgtgaaggacatgtctagcaaaggaaagaagggcagagggcctaacgagtcgaagcgtcacgtggttctcccatgcaaaagaaaaatcatcggagtttaggacaagactgacgaggattacgatcagtttgatgggcaaccccctttcatggtgacgattgaccctagcatcctcctatcaaatgaagataccccttactcacgtagctatctcaaggagggaacaatagtgaggagaaagtacgtgcggtcaaccgtcaccgccgatgtattgccgtaattattgtgtatacgatgtaaactattttagatgtattgattatccatataaatcaatttttgtatggcatatgttaattacttatgattattagaggttttaacaattttaaatcatgtaattgctagttacatgcgataattagaatttttaaaagttttaagtcatgcatgtggcatttacatatgttacttagagtttttaacaattttaaatcatgtatatgctagttatgtgcgataattagaatttttaaaagttttaagtcatgcatgtggcatttacatatgttactcagagtttttaacaaattttaaatcatgcatatgctagttatatgcgataattaggatttttaaaagttttaaatcatgcttgtggcatttacatatgttaattagagtttttaacaattaatttaatatcattcatatgctaattatatatgattatttgaatttttattaattttaaatcatgcatgtcgtatgtatatacatatgttaattagagtttttaacaattaatttaatatcattcatatgctaagtatatatgattattagaatttttattaattttaaatcatatatttgcttattacgttttatccacttaatttactacaaacaacaataatttttcgaagtaattgtcattaatttttcgactttaaataattttaatgcattattttctattttagaaacacatatgtaatggatattaatattcagtgagcttatcagtagtcccggttcttaaccctaaccgggtttaaaaagaatttggaaataacgggaaaatatctttagtcccggttgatgagaacaaccgggagtaaagatatctttactaccgggactaaaaatctaggggtatatatattcccgatgcgcgccctcgtcttctccaccaacacttagaagttttttccccgatcgatctctctcggcttctccttcgccaccactgcctagggcatccccgcaccgatgctgccg

SEQ ID NO: 35253 - DNA, 962 bp, Oryza sativa
cgtgccacatacaccacggtatacggacggaagtacgtaacatagtttccaacccatcctagccatagacaagagtaccgacccaaccccacttacggccgaaacccccgggacaggtaggcaggattgagcccctagcagcaggacaccggccttgtgccatgacatctcgactaccgggccgcagctcgtgtagccttcatttgtcctagagatgtccatcgaccccggacttcgtccttatatggccgaggtgctactatcaaaaccatacaccccgagcccagcctaaaaccattttgaggattttgaatagagggggaggtgtgaacccaattccacaataatccaacaattccatagtgtccaggtgataagagtattcccaaagtctagagttgtaaaaccacataatgttgcctaattaaccagcgaagcatctacctaaaatcatactagtggtaccatgagtagagtgtccactagttggggttttgtttattctagggtgaacaggggaataatatcaataccaataataaggtcataacaaaggtaaataggcatggctagacaaaacagtgataacgtgagaatttaaataaagcgataatgcaataatttaaatcaaaataattttataaactgggattcaatgtgttcgaggatgatgtgacttgccttgctcgctttcccaaacgtcggcttcaacctccacgaagagcggatcttccgaagctgcagcgtctacacgaccaacggaaaataaaaggcttttactctaataaactccatataacccacaagaacaaagaacaaaaatgggttcttgacttcttaaggaaaaattaaagacttgaacggtccaattccgagttcaaatggccaagttatggccatttgaagtttatatgctctttaaatgaatatttacgaatttcttcatttaaattttaatttaa

SEQ ID NO: 35254 - DNA, 864 bp, Oryza sativa
  unsure (1)..(864): unsure at all n locations
tcttcctagatttcaaccagcgaatctcgagaagaatgctgaaatatttgagcgtgttaacgcaatggcagccagaaaaggatgcacaccgtcacaactcgcattggcctgggtccatcatcagggaagcgacgtatgccccatacctgggacaacaaaaatcgagaatttcaatcaaaatgtagcagctctatctgtgaagctcacccctggggaaatgactgaacttgagtcctatgccagcacagatgttgttcaaggtgaccgctatgctcagacggccggcacttggaaggattctgagacccctccattgtcgtcttggaaagcagagtaaacgttttcatatgttcaaatacaaaatcccggttcaaatttagctcaaatggcagagcacacaccagattttgtataagtgttcattgtatcagacgcgttgctcgctcttgttaaaccatcgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35255 - DNA, 9971 bp, Oryza sativa
cgagacattaactcctcaaatgtaggcttcgcatgaaacactaactgtctaacaatcattccctcaaattggcttccaccggtactttcatctaccacacaaccaccataatgaagccggaccaatctatccatctacaatatttaacccatacataaacattaattaattgaaaataatctctaaataccatagcaatcccaaaacttccaaacctatcaacatgtccaactttttccataaaacataacataattgtttcaactcatatactacacattattcacaaaaaaaatttctcttctcctacaaagtgcctagacatcaccacaaatcaaccccttgcaaccatttcaatcaccacacaacaatccaacaaagccctaaccatcaccacacatgaaccaaatggagcaagattaatatgtgtcttccgcactacatccccacccacattatccaattaacatcgcaatcggagccaaatattatcaacccacggttggaaccaaacaatgcgaaatatccaataaaacatgggggaaattagggtttctagaggagtttaccttctcaatcgatcctcaactcaatcccgacgaaatccccttcgatttgagttgatttgggggagatttggtgaggggagaagagagggcgacgaaccctagcgcagccgcggtggggagaagagaggagaggctggctggggcggcctcggccggcctctaagtaccaaacctcagtgccaaacccggtggcgctgaactttggcatctcagcgccgaagtggttggtgctgaggtagctaccacgttagctgggggatcggcccggccgccacggtggcacgatgtcagcgccagcctcgttggcgctgacacggccaaccccaagcgcatgcgcttggcgctgcgccgacggcctatctttggttgaagtttttcgcaggggttagtttcgaaataagtttttaaaaagagtcaatttgtcaaaaaaaagggtactcctcccaactacgcagttgccatcgcacagcattatatgggtacagatgtacagtggagggaaatcgatcgatccgattccggccggccatggcacctgctgctccggcgacggcggcggtgcggcgcgtgaagctgggctcgcagggcctggaggtctcggcgcaggggctgggctgcatgggcatgtccgccttccacgggccgtccaagccggaggccgacatggtggcgctcatccaccacgccgtcgccgccggcgtcaccctcctcgacaccgccgacatctacgggccgcacgccaacgaggccctcctcggcaaggtacgtataggaccttcctcttccttccactggtggggcctctctttctttgggttgatttgcgccatgcgcgagtagtggtgcgctgaaggtgctcgacggaatgcttgtttgcatatgggttggaaaaaaggcaggcgctacaggtcggcagtgtgcgcgacaatgttgcactggccaccaagttcggtaaatttctcgccgacggtaaggtggggatccgcggggacccggcgtacgtgcgggcggcgtgcgagggcagcctccagcggctcggcgtcgactgcatagacctttactaccagcaccgcgtcgacaagaaggtgcccatcgaggtcactgtgcgtgccccttccctttctcaggtctctctttctgtttttttcttttcttttcttttttctttttgcctttgtgtttattgttttgttatgagaaacataaacgggtgagtgatgaaaagctgattatgaaagggaaagttggtggtggcctggtgaagggtttggcaaatggttggtgtcaaggttcataattattcggacagttgttggaaaaacggataattaactcttaattcttttatgagtaaactgtactcatggtacaacaacttggtagataggtgcgataaagtatgagaacttgagaaatgaacgtataagtgtaacaacttgacaagtgggtgtgttctagtacaagaacttgacaatttaatattttgatgcatcaacttggctaagcatatgctagttgattttttttttcacgatgtcaatatatcattaacatataatcctacatatattaccttataatattagatttaatctttaaaaattatactgcacatacagtttacatccaattaacatttaagaatttttttttcttcaccttctcaaatatcaaccgaaatataataatttttacatccagtttaattgacttttagtaattagttattaggataaaaatataaatatgcttatacaaatacacgctagtatattatcaaaataagtacttaaaaattgaatctataaaaaaaatctccaaataattaagttgtctcataacttcttaatttattgtatcaaaattgtacctaccttacaagttgttacatttatataattacttataaagttcttatactaaattgcacctacctaccaagttgttgcactagaacgctcatttctcaagttttttcaccaaattacacccacctgctaagttgatgcaccgtgagtgcaatttactcttcttttattaatgaagagcaaaaaaaaggagcatttgattatttatcgatttcactatataattaatttcatattctttcgggaaagaaaaaactttgattgaaggactcattttttccttttggaacatctaactacaaactagcaataattactataacacgccccacagtatatgcgtgttgatcattctggtgtgctatatctttctaataacgcatacgagctagcacacatttttgaattgttgctttaaattattgtgtataaactgcactaccttcccttgtatttttttatcttgagagctatgcatgccttttaagtaatgacctttcttttcaagtttatctagttgatctactagaaaaataatttgttgccatgaaaaaaatcatggcatcgatcaatactaaaattgtggcgatagatacatgctgccacaattttaaaatcgttactagccgtggtaataaatagcgtggtaataggttattttaacgatttttatttagcggtaataaattttgatgtttccacggaatggatgtggccaaaaaattatattgcaacacttcacatcgttgtaataaataattattgccaccactccatatgtggcattagttctacatactaaattaaaagtttaaatattaactaattttgttctacatcataactatttattatttgataccttgtctttgctaggattcgaacacaagacctatccttcacgtgtgctctcctttaccaactcacctacgcatcaattctgttagaaaatgcatatcgttccatttgagcatatctaactaagatttgaatcacggatttaaatatataaaagatttcaaatgaaaaagttatcacctataaaattgtagatctcgttgagagctataactttcatataaaatttgttctaatccatgtccatatgaaaaaaataagttaaattatgagatgacaattttttattgcaacgaatttgttgatcgtggcaatagaaaatagtaaaaagtaacataccacagccatgtactatgcaaattgccacaaaattaaaattgtgatgatagaacatgttttttcaacggtaatgttttttttggcaatatcttattttctattgcaacaaaaatactaaataaaacaatgatggtaagtcgttgcaataaaatatagttatttgtcacagaaaaattatcgttgcaatagtacaatatattggcacgaattattttttgttgtgataatttagtggaatagctcaattatcttgtagtcctttcacattattagagcatgctcaatgtttcttactaaactcggtatcagtgtgggcccaaacaatagtgggtagtaggtctttactgcatctgcaatgcttatgtgtacgggtgatgaataaggtgggggccacttgagaaaaaaattatccattgctgatagcattgtgaccgggtgtgtcggagacattgttcacataagattgttttttccttccatccggtagtataccacctttaaaatatttactaccaagtaataaggtgatatttaatacttactacttggtttctactcacattgtggatgccattagattgatgaactcaaaaaactagttgaagaaggaaaggtaaaatatattgggttatgtgaagcatctgcatcaacaatcagaagggctcatgcggtacaccctatcaatgcagttcagctcgagtggtcattatggtctagagacgtggaagaagatataattccaacttgcaggtagtgaaaagaaaacaaattagtttgtctattgagaaaaaatcatatgctccatcttaactattgtttgttaattctgtttcagggaacttggaattggaatagtagcttacagcccacttggtagagggttagttcttttctggtggagctaaactagtggattctctaccagaccatgattttcgcaaggtaaattatcatatgcttactactcgctcagttttctcgaaacgtggactatcagacaaggtagtcatgaaatgtgggactgcaaaaaatgctgaacaatacataccacatgatcaccggacaaaccgtcggataaacaggatgacgtacttggatgtggagcggtgatggtgggagatccaacaggacaacactcacctagatatggatgcgctcccttctgcagtagccgacgctactggctatcctcctagcgttggttatcccgtcatggcctcatgtcgtgacaagtgcaaatctggtgggcagcggctgtgttggcagatctagtgggcaacagtggcggcgttgacgatttcggattatattttccaattcatggagttagagctttgaatcactcttggccatttattatgtctaaatcatttttacaggcggcgtcttcagatatctgcattggaatataatttttccaagcggatgcaagtcgccgcctgcgataacaattttcaaagatttgaaaaattcatatgaactctgattgagataaacaacttatcactatgatccccactacacatgtgtaatgtgttccagctatgttaggtttcttcattaaaatatctgcattactagggttacttactatcgttatatgttgcataccatttgactttaatttgtcagatatcatgatattagtggtaatccctactaagtttgtagttgaaagagttattgactgaattaaactaaaggaattgtagcaaggatcactctgaaattctgttaatttcaatcagccttcatataaaattattatgaaattttgaataacaagtagacctggttcatatgcagtggcttatgaaagccgcttgggaaaaagttgggaccacatttaagtgagacaacaaattgtccacctgtcaaatgctctggatactacattagatgaaatatttaatatatattgatttggatgaaaaaatgatttaacatatatttcaatttctacaaaagatttaacctagaaaacacagtactataatacaaatcaaaaatttgcccctaattacatactactgaggctacttgtcgtactttgggcctatactaaaaaaataatatgtacaattagttgtggcggcggcgcttcaccatcgttgtggatcaaacgttgacagttagcccagtgtcagagctcgcgatagggccagcgcaatggggaagggccatgcattctcctcaatctctgcttctgttgacggctatgcttgactctagccagtggcccatccttcgcctcatcctatggtgccatagccacataggtgccctcctcctgcaccttggccaagctggggatcagcttcggcacctcagccatgttgggtatgcctctggcatcggctctagccgtgcctcttcttagatggtgtcatcctcataggctgccatcgccgccatgaccatggtgatcaaggaggttatctctttcttcgcacctgcctctgctgccctcatccgagtcgtcagcctcgttgccacttttgtcctcgttctattccttcagcgatagtgggccctcgttgaagtcctttgataggacctgttgtaccaccggtcatcctcgctatgctaattatccccaggaatttcgcctgacaatacggccagtgacgataaggaggatgagatgtccccatgctcctatatatcattgttgtcctcctcgctaatggcgatgtactacggctgacgcgacgagtacattattgtcgtagatagtggaaaaagttgggagattatggagaggtttctcattgctctctaatagacatggcatgggaggtgaggaggcgtagtgtggtagtggcgggcttgattggcatccgatggttcgtcttgtgaggagttcgcatgataatcaatagtagaaaagacaagacataggcgggcatttaagagcaatgtctgaaaaatgtcgtggacatgggtagctatctgaatggagctgcttgtgtaaataaacagattttcgtacagggtaaaatcgtgttaccacatgtggtcactggtacctgtaaaaatcaagtggctgctagcacccacccgtgaaaatcaagtggctggccgtgaaaatagaaatgatctttatgacttccttaagcggtctcctatagggatggaaacagttagaaaaccaactctaccattttcattttcattttcatattttttaggaattaaaattggaataaaaatccctatatacagaataaaatattatcaaataaaaaatggagcgaatatgaataaaagcgaatacggtaactaatatttatgggaatataaaaaactgtcaaaatgagcttccaaatctttttaaaacaacagataaaatttccaaattttagcaacaaaaaatagcactatcataagataataccacagttcagagatcacattgtcaaatctaacttatcatctttttagacagtagacattattaggaaaaaacaaatccaaaaccgttccaagaaaaaataattccaaatttgttttcgttattgaaaagttctaaaacaattccgaacgctttacatttcaaaaacaggtctgaaatcatgaaacttttttgttacaaaccagccccgaaatcatcattgatggctaaacaagaaagaaacacctgatgacgacaccgagacacgatatttgataatggagttcagccgaagcctacatcttcgaggcactttacgtgcacccctccccgatccaacatattacagtgaactagagttataatgaccatcggttggatgccacctgcagccgctccttctcggctatgctaagtcatcatatggttacaacatgttcgtctctctatctaagagagagtctataatagcgtctaattcttactctctattcttttacctcctacaactccaagttctaaactataaccgactacgtacaaatattttgacaaaaactctaacattttttaaactcctttgagcaatcaattggcagcttaatttgctgagtacgacctttcacttgttgcagaatctgcctagattccaaccagaaaaccttgagaagaatgccaagatattcgatcgcgtcaatgcgatggcgatgaggaaaggatgcacggctgcgcagttcgcactggcttggattcaccacaagggggacgatgtttgccccatacccggtaccacgaagatcgagaatttcgaccagaatgttggggctctgtccctggagctcactcgggacgaaatggctgagctcgaatcctacgctgctgctgctgatgtgcacggtgactggtacgctcagatggccaacacctggaaggattgtgagacccctccgttgtcctcatggaaagaggagtagctgcttgggtctctcttcaagaagtagtgctcctggttgcacatgaatagcggaagaaaatatatattcttgtttgctatggtttgctcttgcatgtttggttcatgatgtgtatgtaacttgacgatgtgctgtacgttgctgctgcttacaatgctctacttgcatctttggttcgtgatgcacatgtaacattatgatatcctatatatacgttgctgcaggaaaacttgtatgaaaagaaacaagccatttatataaggaaaagtctgaattaacatataaaccttggtagtctgatttacgcccttaactgtaatacctggacgtccgacgtttccgaacttatcaaaatggatgaattaccccctcttactcaattcgaagaagttttaatcctatgtggctcatgtatcaattaagtcaaaggaaataaaattctatggggcacacatgtcaaggcctttttctcccctctcctttcaaccacctcccttttgcaacatgagcacggaggatcgaagaggtggcggatggcctccgatccatgaggtgtgaaatcaaagtgttttttcttattatttattttgtcatgaataatcgacatatgagataattgattttaatatttggtgaataattggtgagctgactgtgttggaccggtcaaactaggtagagaaggccagtcagaccggcgtatagcatgctatcagactggctagctcgacggtctaatcggctggttcctgtttggagttggtttcgggttgtttatttggatactcatgattatttcatgattatgacttctggatgatttctatatatatgtaatactgttgtgtgctaatgttgagtcaagttgggaaaaaaattatgctcggatatggtttcttctttgattcatgtgtaggtgtgtcttgatgcctcgggatagtattgttagtgatgattgggagtcaacttgggagaagatgacgtccgaacattcaggatatcatgtggtatgcttaggctaaagaacaatgtgcgtggttggtgaagattccatgcgacatatgatgggagattgtgtatgtatggaaagcagagtcaaatttgagaggaggccaaatttgagaagattagagtttgaattgtaatgagataagttacatatttatatgggaaagtttccttgtggattaggatgacttgtacaagttggattcgtggcttttaggcttctacttcgggtatatatatatagaagagtggttgagacctctcggtatcgattttttgagagttgagttgaaagaaaaagttacggtttcgagtttagtcaattttttagagatgagtgttgttgtgcactttgtaaacactaatagagttctttgatttgtatttgctcgggttcggcggtaacaccggtggcataatgggttgttggaccagcaacggcgacaagcatcggtggtgcaaagtatggttggagtggccgatctatttcggtcagaactgcgatgcatggcgataggcgttggcaccacaaaggacagttggaccggctgatttactctggtcagaccaatctccttcagatcttgagggtaactttttccgctaaaagttttggtttttggtggtaagacttgcttagttcttatgtttcgatgctatacaaaggtgatggtaggctccatgagcttgctgaggaaggtacctgccctatatccacattgataaactacaggcaggaagatccgtagaggatggttagaagcccagggcatactcgcatgtggtgggtggcacaccctgcgttgtccacaccgttcaagccaaataactccatctgctatcgtactcgtactcggatctatagaggggccttgatgtgcgtggcacgagagcggtggaagaagttgtattaagggagtagcaagcggaaatgctatagggcgatcgctcgcctgggggt

SEQ ID NO: 35256 - DNA, 2286 bp, Oryza sativa
ttatatatccgattcaaatttgaatttgaattcaaatattttttcatatatagtatttctatacatctaaagtttatacacctaaaatttatagacctaaagtttatatatccgattcaaatttgaatttgaattcaaatattttttcatatatagtatttctatacatctaaagtttatacacctaaagtttatagacctaaagtttatatacccaattcaaatttgaatttgaattatatccgattcaaatttgaatttgaattcaaatattttctatatatagtatttctatacatctaaagtttatacacctaaagtttatagacccaaagtttataagtcaaaagtttacatattcgattcaaatttgaatttaaattttttatatatagtatttctatacataaatttttctaacttttattttttttaaaattttttttgtggtgtactgtagtaggaagagaagaagggaaggaggaagggggaggagtgggaggaggtattgcctatagggggaggggggccggatctgatcgcttggatcgatcgctggcgattgatcgcccgttagggccccctagtagcaagagacataaaaaaccgaggctatacaaaaggaaataataataataataataataataataataataataataataataataataagggaaaattacaaaaaccaccccacaagtcacccacaagtcacttgaagtttgacattccatcccataagtcattttgttgcaaatacccacccgctactaagttttgttgaaaaaccacccaatgctagggtttgaaattttggttcgaaatttccgaaatttcgccatcccaccggcatgctcaagtctcgcccaaaatttttggatttttgcattttttaaaaaaatttggtcaaattttattcaaattcagtcaaattttcaaataatttcagccagaaatttctgaaatttcaggaatccccggcataaaatccaatttcagaattgaaaaccctacccaatgcgcacgtgcttaaccaaatcagtttgttattgcggatgtagggttaccacatgctaagctagccaagtcaatcttgtctaagtgcttaaattagacttattttccatatttgattgtttttttttcatatagcgaaactcagtgcgacaatgtttaaactctcgtccacaattttatttgtggaatcttacataaaatgtatcaataatactctagaaatatttagttttggtaaggaccacattgatagatcacattttataaaaacatgttgattcggttaagcatacgggggcgtcccgggggcccgtgcggactgtgcgaccgaacagggcccccaaattttaagggcccttaaaatattaagtatgccatatatataataatattagaggctttaattttgttaacttgcagtccaaatagtatcaaacacaaggcccaaaacgctgcagaaggtgaatcgatccatcttccatcgtgctcccatccaggcgttcgcgtcgtcgcgtatcgccaaagtcccgatgccgcagccacttcatctcctctccccagttccctctagcctccgcttctgcttcatcgctgatgatcagctaatcgtcacgcccgtttttaattttactataaaaaaatttactaggctactatggcctattttaatatttcgcacggggacctgatttgaccgggacgcccctgaagcatgtgtttactggggtggttgttgtaacaaaattgagtaggtgggtgggcatttgcaacaaaataacttacggggtggaatgtcaaacttcaagtgacttatggggtgatttttgcaattttccctgataataataaccgacacgcgtaagctcttgaacacatgacacattccttctcccaccaaccactaacgattgctctgcactgtatttgtatgtactccaccattatataagtgacggagtgaaccaagaagcggcggagagaaatcgatcgatccgattccggccggccatggcagctgctgctccggcgacggcggcggtgcggcgcatgaagctgggctcgcagggtctggaggtctcggcgcaggggctgggatgcatgggcatgtccgccttctacggcccggccaagccggagcccgacatggtggcgctcatccaccacaccggcggcgccggcgtcaccctccttgacacctccgacatttactgaccccacaccaacgagctccttctcggcaaagtacgtacctactttcctgct

SEQ ID NO: 35257 - DNA, 11557 bp, Oryza sativa
aatgcctgcttggatcggaacggcaggcgctgcagggcggcgtgcgtgataaggttgagctggccaccaagttcggcatcgcgttcgaagacggcaagcgggacgtccgcggggacccggcgtacgtgcgcgcggcgtgcgagggcagcctccggcggctcggcgtcgacagcatcgacctttactaccagcaccgtgtcgacaagaaggtgcccatcgaggtcacggtgagtgccacttccccagtctcctatccttctttcttttagaaaattttgtgatgtgtggatgcaaaagatacacgtgtatctgaaagggaaagtaggtggtggtgggttggtttgtcaatgggttggtgtcaatattctacaataattattaggacagctgccggaaaaatggacatcttttattgatgaaaagcaaaaaagaaaaaaaaaggagcatttgtttgttacccacttatctagatgattaatttcatattcattgggaaaacttactagagggaggatcatgaagttgttgaaattttttttaagagaggtcaattttgaacagaggaaattttaacccagcttaaggtacacttaaattcttaagtttgtttggctgtttgtacattgacctttcttttattcagaccaatttggtatgagttctgaaaggacagggtatgtaatggagagaaaggataaaaggaacctccatttcatggcacctatccttttattgttgtttttctacctcatcttagggctgtaccaattaaattttgactaaacatactagggcatttgtaaagatacgtggtacaatattatttgcattaagatctttctgtttggcataactccctatttgatcgctggtttctataattcaaaaatgttttcttctatttaaatattatacttagtttagatatatagtatttcatttactctagacattagctgtgaaattttgatgggtgacgaggcaaagtaaagattgagccaataattttcatttacatgtcactgggcagttacaacacagaatgctgtttttgtaatagcttgggatctgaagcaccaagtaaaccaatatttcaaagtttaataaaccaatgcacaaatatcaaaacaagtaaacatgagaggactgaaaatttgtgcaaatatgtttgctgaagaggactcgttctctttctgaacatctaactacaaactagcaaaatttactataacattttgataatgtgttttgattattttggcatgctataaactgaactaccgtccattgtatttttgtcaagtttatctagttgatttacattttacattgttagattggcgaactcaagaaactagttgaagaaggaaagataaaatatattgggttatctgaagcatctgcatcaactatcagaagggctcatgctgtacaccctatcactgctgttcagcttgagtggtcattatggtctagagacgtggaagaagatataattccaacttgcaggtattgaaaaaaacaccaaattagtttgtctgttgaagaaaatcacatgctccatttgaactattgttcttatttccatttcagagaacttggaattggaatagtagcttatagcccacttggtagagggttcttttctgctggagctaaactagtggagtctctatcagatcaggattttcgcaaggtaaattccatggtttactactcagtttttcctaagaattgggatgaatgaggtcatgaaaatagcagagcatgacagcgaaaacactgtgatatctgtagtgttattgtctttcagattaagaagaatagaataattaatttatttcctttcttgaaaccaattttgttggtgtgtttactcatacatcgtgtagagatgaatgatcaatgtagagaaaaacaagaaaaagatcatcaaataggcattcatgccttatattgggaaaccttctagtttaattctatgccttgtagtttgaatgatgggaatacccattaagtacctcttctgtattctcattttctgaactttctacattggtaacacgaaatacttatgttcaatagaaatatttactctgcatttatcggactcaaacctttattaaactcatctttgtgctgtgttgtctatttgttctttgaaaaattaaatagaactacaatgagttctcatttactaagaacttgtattgatacttttgcagcatattcctagatttcaacaagagaatcttgagaagaatgctgaaatatttgagcgtgttaacgcaatggcagccagaaaaggatgcacaccgtcacagctcgcattggcctgggtccatcatcagggaagcgatgtatgccccatacctgggacaacaaaaatcgagaatttaaaccaaaacattggagcactatctgtgaagctcacacctgaggaaatggctgaactcgagtcttacgcaagcacagatgatgttcgaggcgaccggtatcctcaggcgatggccaacactacttggcaaaattctgagacccctcccttgtcatcttggaaagctcagtaattgttttcatctgttcaaatacaaagtcctggtccaaaatagctgaatggcagagcgcacacaagattttgtagaacgtattcatcagtcgctggacgctgcttgctcctgttatacatcacgtatatttggaatgagatgtcctgtctgtctgtattgtgttatgttctatgctttcgtcatgtttgtgcctacaacctacttgtgtgaagtgcggttctataagcctgtgcactgcacgcagtacgtgtgctaataataaaataatgttttgcaatcactaattttgtgttactaacatgtttgttcaaattaagcaatgtcatgtcttattctatattcatatggtctgttgagtgctgactgccttgacaaccttgtttgtttcttaccttccccaaagaaaagttcgaccggaatttggttgtgaattgtgaccggtgggaggattattgagtggggtggtgaaattagcctgaaaaccgttgccatgactgagctaatgccatattgatgaggacacgactagctcggatataaccatgattatcttatatattaatcaaccaaaggtgcatatgttctatatttgatttacttgctatatatttgaacaaatgttgctacacaatgagttttgtgtattttcgtttgcagaggtactttcttgggcgaaagaaaagagaccaagcgtaaggaatgcatggatgattgaagaagttgattgaggaccaaaccaagaccttctccaagtcttttttcatatcaccacgtcacttttggtccataggagacaagagataaagttttacacgttttggattcggattcgggcctcctaacagcattaacttcaaatggacctagccgctgatctagaaggaatttagggacccatgagtacttattggaaagcttatggagtctacttttagatggtttttgtcccacgtcaaaattcctaccgagctaccgggaatctgcaaaacaagccatgtaccttatccagtccgaatttgatttgtgttttgggccttataattatgtcatgggcttaccccaagggggtgtgtgccctagggcaaccccagaacgtccctaatcatatttattcagtacccgtcattgtttagagtcgggttttgcttagattgttctgttaagaacagtttcgccgctagatcggtttgtagaaccataaattcgagtgcttaatcattcatatgcaatttggttgcaatttatcttgttcttgattgtgttcttcaattcacatgcagtgattagccttctcggcgaggttaaccaggttttggcacgattgataaccaaaggagacgtggtgctgcgcttgcggggctcagtagcgtgttcgttcagaagtcggatcgagttgtgtagcgactccgcccaaatcgactgtttattaatacatttcgaaagatcaggacctaacaccttcatcacatctggacctgtattattttataagcagtgatatatatttaaatactttgttccgctgaataagaccagtgataacctgattttaacactctgcgtgtaaaggtgttcacacgtagttttgaaaattaggcaagttttttttaaaaaaacaaccacacaagataaacacggctttacatgtacgaaaaatgttaaaatcggcacctataatgcttttggtatctgaatgcgcgtctatgggatgccattttttaaactggcacctatatggtgacatagatactggtttttaagaaggactggcacgtatatgttatatcagacgtatgtgtcggttgttaacagaaaccggtacgtttaattgatacctgttctatcaaagtagttctttcggacccactttaaaatcgacatgtttcagactgttatataaagataccggttctaattaaaacccgacacctttaagacatatcacaccgaagtgaccgaagtcatcatcagtgcggtttgcggggtgccggttgagaaatccgacatctaaaagggtttctcaaccgacaccaatctaatatttttatagtagtgatagcacgatcaactcgacaagtaactgccacccccaagaaatatagttaatgcagataatgaggaagtagatgaaacctcgcacacacggaactattatcaggaagtacttagtagtaattagcaattcccattaaataaccccacaagagtttttccacaaaaagattttgatccatacatttataaagatatgtagtataatactatttgcaataagatctgtatttttagcataattgtgcaataatttagctatatatatatcataaacacatacatgcccatctgtattatatacccactcctttccaaattggtcatcatattataaaattcaacatttcttaaattgatcatcatataaccgcatagacacggattttatcagaatacaattaatgtagcatgagagaatgtgtgcatgtaattggcatagtgttttaatcgatgcatacattgtgagagaatgtgtgcatagtgtcttgatttatgtgatttaaattatttttcgtctttgtgtataaatagatatgacgatcaatttaggaaggagagagtaactcttactccagattggtagtagaaggaaataggaagtacggtggctagatgttgggcttgaaaattggcccataaattacatgcagattagatcgatgttgggtttgaaaattggcccataaattacatgcagattagatcttaggatctaacggtcatgatatatcatgatattaatcaatggtcaattttttttgctgattaacatgagagctaatagaaagtgtatagatatagatagatatagatataatatagatatagatatagatatagataaagatacagaaatagatttagatatagatatagatatagatagagatatatagattggctcttaacattattttttatatactttttgttaataaataaatgatggaggtcccagcgacagagcccaggcggccatttgtccggcctgggagctttattcgccgctgtgcgggaccaagatattgcattttacgaattcacattccttttccaaaatcccagctctctgtacaattagaaaaaaaaacctacatctgtccactcactgattatgaagttgtatattgggggttacatggtttggaaagactcgcgtattattgtattattaaatggtatcgtagtgttaccacggcatattactatgtctacaaatgaaagcattatgttgctttcatcccctttttacctaaaacaaagtagattaactaattaagggatgacccctatgcaatattgtttagaaagagaaaacatctatctgggtaatccgagtttaagtccctagccagaataggtgctcatatttaagctaattattctatcatcgatagacgatgtacccgttgatactgagatgcattcatgtggttaattacttcgtcaatattaaaatattataacagtccagtgtttagaggtactcgtaaagatagcgtgtgcgtgtatgttatatatatggtgagtgagctcgtgcgtattagcgtatatatgagcatctggccatctgctattatcgtgaggggaaaaaaaagaaaggaaagcgacacagttggaaatttaaggcagcacgaccaccttttgtggcaaaatttgctacaaaacacacaaaaaattttatgtaatttattgatagacataaaaaaatatgtcacaactaaaagacatccttaaaagactggtaatttactagatgacactggaatgataaattcttaataaaacgagaaagcccctaaaatcacatgcttcaaacatgatgttaaagtaaaaatttagaaattatgaaaaatctaaatttaccatcaccccaagtacatcattaggatccattatattccatcttcactctagtcttaactcaaaagcttttgtcccccaacaaattaccagttctttagtgtttttttagccgtaacgcgtttttatgttctttagtgtcttgtatgaaattttgtcctttgcaaactgaaacgttcctttcatctcttacgttgagaagaataaaaaaaaacttggaactctttaccttatttttttttctcgtattatccaaaactacagggggtaatatgctactgtattaatttgccacggataatgcctgagaattctcgcgcgaagaaagacggggctgcctacggctcggacgcccaatgattcggagaaaaatcgggcgctgacgtccgcgcctgatttacgtgcaaaaattactttaaactgatttttttcttaaattacttatccaaatcatgatccgattgcaccattaaatttgttgcaattaaatcttcaaaacaagaccacacatagatatattccggcgacaacttttttaagcttattattgaattatttttaaatgttgtacgatgttccaccagatatatcggaattgtttcgctaagtagatcgaaaatgtttcactcgtttaaattgggtgttgtttcaccgtatataaaaataatgtttcagcaaatagcgaaagattgtttcagttcattgcaacatttgatccatacatagtaaaacattataaatgcactaggcgaaacattttttggtggaacaacaaataaaacgaattctcttaataggggtttctaaaatatgtgggttttttttgttgcaatggaatatttcaattcactgcaacgttacatctatacatagtgaaacattatgagtacactagatggaatatttttggtggaacaaaaaataaaccaaattttccttactagagggtttttaaaatatgtggttgatttgttagaggtggaggcaggtattgtggtgggaccagcgacatcagcgtgcgcgcggggacagggttgggggtagcgaacgatttttcctcccccgcccggtcgcccaacgaccatcattatccaagaaagacttccaagtcttcgaccgcgacactccttacccgcacgcgcggccatgggaatgtgaatccgacgtatggccatggaaaaactgatactccttggtctcggtaactatatgatgacatctttttaaataaaattaaactcgttaactttcgactaataatcatactaactatatatactatatactaagtattatacatactatataatatatcactagatttatattttaaaatatacttttatatgacactaattttatttttttaagaaatacaatatgtaataaattgatggtcaaaaggccctatttggatccaagggatattttttagtcctctcttaaatagcccaaaaagatccaaaagggtgagctatttgagggctatttgaaaataatccaccaaaaaactatcacatccaagaagtgctaattgaggatatttcgggtgaggtcctctgaaaaagtgtcttttctctctatctcttttcatgggaaggtacattaaagccaaatagctctcaaaataacacttgatccaaataacttagagctattttattaaagtgttattttcttgtgataaaaaatagctctcagagtaactcttggctaatttaggaacggagaagcacgtgcgtaagctcttacgcacactgtgcagcgacgcttgcagtgagttgtatggtactagcattaacccctatatatgtgagtggccagagcccacgtagcatcaccaccggaatcgcgcgcgcggcggagagaaattaatcgatcgatcgatcgatccgattccggccggccatggcagctgctgctccggcgacggcggcggtgcggcgcatgaagctgggctcgcagggtctggaggtctcggcgcaggggctgggctgcatgggcatgtccgccttctacgggccacccaagccggaggccgacatggttgcgctcatccaccacgccgtcgccgccggcgtcacccacctcgacacctccgacatgtacggcccccacaccaacgagctcctcctcggcaaggtcagttataataagtttcttcgtgcacgcttcggttgtttttttgggtactgggatacgcgctgaaggtgctcgacggaatgctcatgtgcgccaatatgcatgcaggctctgcagggcggcgtgagggagaaggtggaggtggccacgaagttcgccgtctcgttcgccgacgggaaggtggagatccgcggcgacccggcgtacgtgcgggcggcgtgcgagggcagcctccggcggctcggcgtcgattgcgtagacctttactaccagcaccgtgtcgacaagaaggtgcccatcgaggtcacggtgagtgcccccccttccctctctcctgtctttcagttcctttctgcttttttttttactttttttctttttactactttctccgtcacagaaaaaatatcacttatatggcctaaattaaataagggctgtttgtgaacaaggttataagggtaaaaaacaattgaatgattggtgactaataagataaatataatattataaaattgttacttattttgaatagattttaaatggaaagtggtttgattttttttacggaggaaatatctttttttttttggatgaaaggcatacatgtgtaagtgacggctgatgaatccgaaagggaaagtaggtagtgatgtgttgatttgtcaatgggttggtgtcaagattatacataaccagatgcgtggtagtggggaaagtttgcatgataatgatagaaataaggtttgtaaataagatgtaagatgggtttgttttttagctggactgaatatttgatcgatcatgttaaaaaagttataaataattcagatgatatggtttgtgataatttaaatcttatataaattgaccatttaaagtaaaactaaagttacgtaacttcatgagagaagaaaaacaagggaaataatatagatggatcatccaaagacaaaactgcggtgttgtggattcatcggagaagaaaaaagaggaagacgatttcgcctatagattaatcatccgtgggttataaaaatttgaggtgatgtggtatatactccctccgttccaaaatataactgtgtgtccagattcatagccaaaagttgttacattttagaacggaggtagtagtattattgggacaactgccagaaaaatggacatctttctatcaatgaaaaaaaaggcatttagtttgttttctagatctcgtagataattaatttcatattcattagtaaaactagaatggagagaggattaggaagttactgaaaaaaaatgtaagagagaattttgatcaaaggaaaacttgaacccggcttgaagcacacttaaattcttaagtttgtttagctgattatattatacatttgacatcctttctttcgttcgcagcaacttggtctcttaattctgaaaggataagttattaggttttgttgtaatagcaacatgaagcataaatttctttttcttttttctcgagaagaatttggaaccatacatttgtaaagatatgaaccatacatttgtaaagatatgtagcacaaaattatttgcattaagatctggactgtgtgccataaatcataattgcgtggaaaaccttacatgaatatctttcactgtcgatgacatgtgactggacggttacattactccatatttggtctcgatggttttctataattgataaatgttttattttcatttatatagtacatttatcttagatacagaggagggcttgttttattagacaatagctgtgggattttgaaggtgaagacgtaaagacaagactgagccaataattaattttcaccgacatgcatgtctcactcggcagttgcaacatacaatgctgttcttgtattagctgagatgttaaccacaaaccaaaccaacatttcaaagtttaacaattttaagatccaatgcagcaatacataaccaaaataaatagatatgagaggactgaaattggtgcaaatatctttgccgaagaggacttgttttcttgcagaaaatgtgagaatccaaaataggacctacagaacgtctaactacaaactatcaatacgagcacatgaactactgtgtttctgaaagcggatactagcacctgaactactattacttatgatatttccaaaccgttggatggaattattgtgtacaaataaagtgtactacctttcattgtatttttgtctgccttttaagtaatgacctttatttcttcccaatattatctagttgatgtttaccttttcattattagattggtgaactcaagaaactagttgaagaaggaaagataaaatatattggtctatcggaagcatctgcatcaacaatcagaagggctcatgctgtacaccctatcactgcagttcagctcgagtggtcattatggtctagagacgtggaagaagatataattccaaattagtttatccattgaaaaaaatcacatgccccattttaactatttttcttatttccatttcagagaacttggaattggaatagtagcttacagcccacttggtagagggttcttttctggtggagctaaactagtggagtctatctgttcaggatgttcgcaaggtaaattcttatggatactactcattcagttttccctaagaatggggatgaaggaggtaatgaaaataggtatcatgcctcttattttgaaacattgtaatttaattatattccttatatatagtttgaatattgggagtttccactaaataccttcgtgtgtactctcattttccaaactttgtgatgtatattaacgcctcgtctatttatttatacttttgcagcatcttcctagatttcaaccagcgaatctcgagaagaatgctgaaatatttgagcgtgttaacgcaatggcagcc

SEQ ID NO: 35258 - DNA, 30190 bp, Oryza sativa
agtggtgttgtaaagtgtggttttattagtttgtgcgcagtacgtgtgcgaataataaataaagttctgaggtcacattttttttttgttgccgacatgtttgttcaaaatttgaaattaagcagtgtcatgtctaaatctatattcatgtggtctgctgactggcttcacagccttgtttgtttattaccttcacctaacaataaatcgactgcattatatttggttgtgaactgtgtgatcggtgggaagattatattaaacggtgcgtgttttgaaaaaaaaaatctatagaaaaattgctttaaaaatcatattaatctatttttgaagttttttaaactaataattagttaatcatgtattaattcattactctgttttccgtgtcaaaagtgagggttcctgaccctcaagccttacctaagaacacagccttaaggcatccacaatatggtgtaaaagtagtccataagcaatagaatattccatccaaccacctataaccattgtgcaactagtccatatagaaaaaataacaaaaggtatccatatacatatggactacccatatggaataaattatattatctatctctactcatctctcttctcctaatgatacattgtatccatatatattgtggagattgtcataggtaaaaactatttatataggtcccatctatatggatcactttgccatatacattggtgatgctcttaggacacagactgtgtcacatcgacttgagaaacatatattactagaatatcaatgcgccaaaaggcacactaagtaatttaacccgtgtataattatttttatgaagcatgtatttaagaaaacggtattttttaatggaattagtttaacaatcataaattgtctataagcatcatacaatttaaagcatactttaatttttttaatggaattattagttgtttagttttaaagtataccgagaagaatcaaattaagacgggtagtaattaatgataccaacaaacaggtgaataagttattgtaatgacaaaaaaagtattttatgaatattttatcgtacttttgtacatttaaatctattacaatttgtaaaattagcagaatatttttttcatttttcatttgtatttgtttatactcgctattgtaaatttacttttactcgctatttttgatagtcatatttcatcttggaacacagaccaaggataagtaattctacttatcatccatttaaaatgctactagtcatttctcgtaaacaagcaattcattaatatttacatttctcgatgtccatatagctgatcttgcgtggaagaatgaaaagtcatgcattaaatccgagaaagttattaagatgatatgttgttgaattgaaatatgcctatcaaaaataaatttttcaaatttggaaatattactatcaaaagtagatggagggagtactatttaaataattggttttcgtttaagaaatcgcgtgcgtaattatattttaaaatggtattattgttaaatctgataatagttgcttttataatactatatctttaataactactaaaataataggaatctaaacactatttatttgtcacagagatttttatatgtataccaactaatagatgcatagatgtatgcatgtggccggtttagcccaaagcacacgcatgtacatgcgctggcttgggcgaactgtgcacgtattgccatgggccggttagtgtggatttggatcgtctgacttcaccctgcaaaggcatgggcgtgcagtcatcatttttccactgttcatgcaatcaacgactcacgcgtcacgtgcacttaacttttgttaaaacaatccatggcagccaacaagacaaattgataaggcaatccgatgaggtctcgtcgtcgctgccgccgccaccgccgtcgatgtcatcgatggcggtgactagctagcttagagcttgtttgccggtacgcacgtgtcgtcaccagccatcgcctcggcccaactatttttttttgttgttcttcatttttttggccaaagtatcaaatttgctaagttaatttctttgttcaactgttgatggtactaaagacatattttagctatggagactgtagtttctagtgtgttgcttttgttttgtcaatccttttttatttacgatctctattcactatctgttttgatttatgatgtggcttactcttcattgtactccacttagtaatgaatggtgttgtttgaaacttatgaattgcctgatgggatgcaatgatttatgctttgcttgctgagtagttgaatcgaatgcattctttgctctgctctgctcattgtaatcatgttccataatccaaattccaagtagcaagcatgctgcatcactgccgattgatacatccaatcctagcaggaagatggaatggcaaagcttccatatgatgcctaagacagcggcggtggcagcacgtagcgaaagacgagctccaggctattcgtcggcggcggcagcgatggcgggactacacgtctaccaaactgaccctgaagtctggaaaacgtgcctcttgttgggcggccataggtttgtgtggacaggagccgttgcattgcatggacggtggataagtgatgactacacgttcgtgccttcacagggtgaagtcagacgatccaaatccggttaatgtggctcagccgtggatgattagatgggtatttagcaaaggcgcatacggcgtgcggaggaactcggaaattctatcgttattaggggtgtaagtggataactcgtgaaacccatttatagactaaaataagttgcgaacctacttattttaacctataagtgggtgtgcagctgacccacttacactcctgatcgttgcgcacaacactctttctcacattgctccacgtgtcgctagattatagggacatctggaccaatcgaatctggaccgaatgaccggctttagaaatatagatggtgtaaggagcgatatatattaaaaatagtttgttccactgaataagatgagtgactagtgacaacctgacaaaagtacgaacatgtcaggtgtaaagatgtcgacgcattttttgaaaattaggaaagttattctcaattattatgcttgtcctgacaatattgcatttatgcatttctttgattactctaaagatatgcacgcgagcatggtacactatacttacacacctacgaatgcgtccatagcatactctcaaaaaaatggagacatatggtaaattcctgaactcattaaaatcatgttaaaagcgaatctatgtgcgattttacatgagaagaaactacagaggaaggctgaaaacttgaattctctagcggagttgccaattcatattggcatctattttgtcaacatggacccacctaaagatttacgatgttaatggagtcatgagcccccttaatttagaaaaactcttgacttcgatgggtttacaaaagattaaaaccggttagcgaagccaatttagagatgaaaccaacactagtagaaatgtgcccatctacgaaaacattattgtcatggtagatactgaatttgtcattaagaaatttctatgatgaatttgtgtgctcttaaaaaatggagcgtcacattagtttctttatgacgaatcaacaaatttcgtaatagaacttgtgtacatccatcaatattcaccttatgaggaacccgctttctgccacttgcatcttcctatatagattcaaagcaatttgggcatgcatcaaatttccccacaagtaatgggaggcactctccaatctgaaaaatagactctcgctgctggtgggccaacgcaggttgccggcggggaaattgatggccgagacatggcggagaaaccctagtactagggccaggggtgtgccacagttgtgatacctgtgcagtgaaggcgccctcatagtggaaaggtcagctggaggtgagagaggttttggcaaggtggatctccttgtgtctggaatctttggggcagcggcgagtgaggttgtaggggtgcttgaatgaaatatgaattgctagtcaagattagttatatgaacgtgaggctgtaaaaatgctaacatagtaaagatgcatgcttggaggaacttggacaatactgtgcgatcaccagacaaactaccaggtaaacgttctgaaatcagatttgtacgcacatgatatataacttatttgtaagacaaatgaacagtctctaagtactgatgtggatagttgtcctatcttctgataggtttgatttggtgaggtgaagatgttcacgcattgaggcctgcgatcagccgatcgtcacctcacaaccgctacagccacacgtatagtcgttatcaatcacgctctcatgcaatcaacctttctagaaggattattgctcctgcaaacaatcgaagaagttcaggcttccgcctccctcaaggagaaggttgcggaggaggtcactgctgtttcctccgtccctgctgccgcgggaggcagcgggatcaagaggataccctgggcctgggcgagcggcactgccagatatcggcagaaattcagctgctctgaggacccatcattctcatcttgtcggacttttcttcttcgcgggataatggaatgaggtcgtaatttactatcttactcaggacacgagcggtctccctcctcgtccgaagaggagactactgaagagggccaccgacaagtaagtgaaatctttgaccccctttgttgtcatgtctacaagtttattgagggtgtttttgatgtcagcaggaaggcctcaacgatctccgcccaaagcggtgacgaggtggcgactagcgggactcccgctgtcgtcctagatttttcacaatttggttcttttgaaaaacttattttgcaaatagatccctagaaaaacttattttgcaaatagacccctagaaaaacttatcccataaatggtcctatttgaggcgccagagtgcctggcgccgtcgtccaatgggacagcgctagcctctctggcgccgtcctcttgccgacattgcggggtggtgctgaggtggcagggggagcatgatgacatttttaaatactaaatgatttcaactgaaaaagtcatccacaacaaagttctggctcggacgcggcgacgatgacctcggcgacaacgactgcagcgggcggcgcgcggcgaggttgggcgcggcggatccggcacggtggtgaaacctatcccgccgccgtcactgtcatcgtctctccctcaccctcactcaccctctcctgccgccgccgctgctgccacgcactgcctccggcgcctcgcgctgtctcctccatcgtgccgtcatcatcatcatcaccgttgccacgtgctgccccctccgcctccacctctaccgccgccgccgtcatgtcgccgtctccgagcgattccgcctctgcctcctcgtcgcgccgttgccgtcgccaagcgcgggcttcaaggcggacgcggagaaagcggggaggtgagtgctcctctcctcttcccctctcgtctcccctatgcctacgaggaccggtgccttgtcgccgttgtcactgtcgtcccgctggttggcgtcgccctttcccctctccccatggtgtcatcctctccgatgccgcgccttcctcctcttcatcggatggggtgaggtgctcagcggcggcaacgagctcgacctcggcaggctgggcaacaacgtagacctcggtatcagcacggattgagctggaagaagggggcttgctcaattcgatttcccgggagggtgatggggaggttgccagatgagtgggggtgtgtgagtggcactgcgacgaagcttgtgcctagctatgatcgagtaaaaatttatattagttgaacccagttttttgggttaatactttctctggtagtacaagcattaagattcgatggaaatatcaggtgctgattcagatttcacctttgcatgcaatctatttctaatttcgtacttctgtgttagtaaaacttatataagtgatattaccatttacttgcaacaatctatcagtgtcagacctgaaattgttcaagcttggctcttcagttccagctgcacaattttttttgtatgggctttactgatgatgtactcaggtgacacaattgtacgatggttaaaaaaaggcctaggttatgatgttagacagttcataataagataagggaatttggtaggagtacaatttactctgcaagaaacagagaatttatgcttgttaatccctgtagatcattgagccatcactttcttttacagcagtagcttcgctcaagaaaatgtttgccttttactgaaaatttttttgtcctcgcagtgcgaccatcatcactgtcgacatgccctgtgggcgcatggctgaggccatctgcatatgctgcatgaactcaagctccgtctgtctctagtacgggatggatgttgctggtcaaggtagggctgatggtaagggaggttggagccgactgaggtaagtgccagttcacacatatcttgaacttggttttgaaatgaaaaattggatctgaatgctgatatttgggtggttggtttagtaatctaccttgcccatcgttgtcttctacagtcccataagattctattataaagtttaattataagagtgttgaaccagaggtctttccctcgtgataaagtagttgtataacctttaagtttagcaggaaagttgtctacagcctacggatttcatctctaggttctataggctgcgtttagttcagcgcaaagtttggattttagttgaaattggagatgatgtgactgaaaagttgtgtgtgtatgacaggttgatgtgataaaaaatgacggaagtttggatccaaactttggatctaaacacagccataatcattgttgccagttgttaagagcaactctggtctcgtggatagctttcaatggaaatatgtgtttcctatattatagagctgttacgctggcactagagttaagtaatggaaatatgatatgtgcaaaataggagacttaattcatacacttaaatgatacaagcacacagtttttttttatctcaagctttgcatgtatgttcttgccgtgtgttactaattatcttttggtgcatagctgcatataattcctatttggataccgtacctgatggtgctccttcgattaattcacacaagttacttgacatcgaccactgctgcattgatccttacgatctaaacatatgccacaaaaataactccattaacctatatttattcacatttagaaaaagaagattaggagggaggactaatattgttgagttgtttagtgacttaatattgttgactcccagtattgacactaaaattgtatttttgcagctatgtataagatgtagcaaaaaaaatccatttgcacatcaacaagaaggccttgctgtaattcaatcctctatttgctatgagtggaggacgagaagcaaggagtgattccattgaatgtttgaaagatttgttttggttttctgttttcagatttcctgtaactaggttgaatctaggatgaactattgtttgaattctgttgtattcttattgtatatgttattagttaaatctgcgatggtatctgtaattaggtttgaatctgaaatggtatgagaaattggattgaatttggtaggctcaaatttaatgggtctgtttagtgggctttgatttgatagttggttgacaaaatgggccagttctgaaatgggcctagctttgaaatgggcctattttaaaatgggccagtttaaaaaaattaatgggccgctgttaaaaaattaatgggccgttaaaaaaataatggggccatataaaaaaatttgctgacgtcagctgccacgtcatcacacacgtgtcaacgaccacgtcacctgccatgttggccgccacgcggcaaccatctatgacgttaaatttcgtcacaaaggttgggcctgggctagactacacgagcccaaaagcgtttaatgacggttaaaaaatgtcatagattgtgctgatccatgacgatttcggagaaaacgtcggcagatttaatctgtgatgctcaatagatgacgataagtagaatcgtcacagacaaattcctgtgacgaattttctgtgatccatgacgaatttttttgtcatagattaaatagattcttgtagtgcaatgatggcgttgtacgcgttgtcgaattctgcgacaccaaaggtgatatgctctgttcggaagttattggcctatccaaaggtgacgggtaacgtgacgttacccaacggtttagacgatcattctggagtgattacatggaagggctgatatgtgggcgtcagctcgcttcgaggtatccccataacgtccaaagtgctggcgaagagcaagttgattggactcccgccatcaatgagaacctgtgccaccttgatattccgaatagtgggttcgactacgatcggatatctacctggtgtggttgcgatcttggggtggtctgccttcgtgaactcgatcttatgctgagaccatttcatcttggcagtagccgcctgcgatgtggaccagacttcgtgttctacctttttgtactccctctttgaggtgtacgatgtagaaccgccgaagatatgagagacatggaggtcgtactctgggaaagcggagtcagagtcaagagtggcggcttccttagccgtttcgacgacacgaactggcttccctctctagatcgctagttgtctcgcgagctccattttgaaaacataacaatcctccgtggcgtgattgttagtcttgtgtatcgggcaccattacttgcgtgagtcgtcgttctgggggtttgggcgcctgggtgggtccgtttgctcagcagcgaggacctctcccgagagtttgcgcttcccacttttgcgacttctctttttgctcgactctggtgcgtctcttttggttgacttcttctcctcacccaccttgctctttccctccttttctcttaaagcatcatctgcatgggcacatctgtcgataatctcgaacaacttccgagcagatatgattcgtcgcgtcgccaactcctaggtggtgttatcgatctcggacgcctgacttgaatgcgcggataacagaagcatcggtgatctcgaggatcgtattcctgcactcattgaatcgccgaatgtagtccctcaatgattctcctaggttctgagttagggcatgtaggacatccttaatcgcgtggcgcttgtaagttccctagaagttagcaacgaactgctgccacaagtcttcccatgaggagattgtgcgggacgggatgtggaatagccatgagcgagcagatccttttaatgcagctggtaaataatttgccagtgcattgtcgtctgcaccagcagcgtagagaattgtggagtagacttgcaaaaatttttctgggtttgtacttccatcatatttctcgatttctcttggtcggaacttctcgggccatcgcacatttcggagtgagggtgtgaatgctctacacctgcctcctgggacggaaggcggcccatggttatgacgtcgtaggggaggtatatctgatgaagaaaatgacgaagacgaggatgaggggtcgcttggtttaggagcccggcttctcgaacaatgattgtgtccccgatctcgactaggcgcgggagattgcgaattgtgatctcgttggtcgttgccgtctcgctcctgatcttgggcatcgtcctgaactcagcgattggcccccctgatcttgctggttgttgtagttggtgtcattgcggcggtcgctgtgggcccgccggccttggtcttcgttaggtccacctcctcggtcgtcgttccttcctcgttcgcgaaggagagcagtgacgatgtcgtcaatgaacaatattctctccgcggcgagaaggggaatggtgtcgatgacgatcattattgttccgatctcttctgtctctccgtcagtcatccaagtgttcgcggagatcgcgattctcgcgatgcggttcaataggttcacgtgtcgcccgaggtgatcgattaccggagggatgttctctgttggcgttttttgcctccgcattctcggcggttggctcgccgttccctcagggctgatctcgtggtgatggctcattggccgacgtctggatttgttacgggatcaaagggactttccctcaatatcgcatctaggtttcacaactgttgacaggcgttctcgctgctgcggacggacttgtctcgatgttgtcgaccacgttcacatcccgtggtgactccgaagagaattcatagtcttccagcaggtgtaacacatatggctcgtttggattagtgccaacatatcctacaaaccgatctggagccggctccacatctcgttccttggcaacacacagagcttgaactcgtggctgttggacacgatgatgcggcactttgaaggtcctgaggaagatcttgcagcttgtgagatcgtgagatctggatttgtgaattggacagtagatggcgcccgttggtgaagtgcgttgaattccacgttcccaacaagcgtagagtttagccttcacatggactatcagtgggtagtcctcgagagtatgtttggatgtcttatgaacaggacaccaagatctcggtttttgtgttgtcatccttgtcggctctgatctcttgtatagagaacataattcggccgcttgaggattcctcccaggtgttggggccctcgatgttccgttctccacttgcatgggaggaatcgtcggcggggtgtcgtttctcggagtcgtagccgtgcctttctcgttcccggtaatgattgggccattcgagattggcgtaatggtatagatcggaaacacaatagatccgacttgagtccacaccaacgatgtcgaggtagaggctccttgattgacactggtgttggtactgctgtcgtgaaggcttgaagtcatactggcagaaccttaagcaccaagtccctctacctggcacgccactatcgacgagtaatactcgtggaccgaatgagctgaatattggggtacgttggaacgagggtctacgtagtacgacatcaagcagacaaaagacaaggattatacgggttcaggccccttgtcaggtaatagccctagtccagtttatatgagattgatgatgaggaatcacatattacaaaggaagtagacgaaacagacggtaccgacgagatcgtagttgatgaatccgatgagatctcccggcgactaggctccacgtactctggcttcgtaactatggtgtgtgtgttggcgatgaaatttgatgccttgcacccctccctgggggtcccttttctaccgtggatcatcttgacccttaagtaaggcctgttaatatctgatctggtacggtataacagaaactctacccttccgagtaggactttagaaatcacttgactcgtagagatattttccgtaattttgaacgaattccaaacggtatacatgggaacgatccgtgtgcgtaaaggtataccttattagtgtattccataagtcgtagggtaggaggtatgctttatccataaccctgacaataagtgaataaaatgagggagttaatttggaccatatattaatcatctaatgactaaaagtaattaaggtgacatggcttaattagaaaaaagagaaataacattaaacctataggacggactttatttatatataggatatattggatttcacctgttatcctgttcttttgttgattatttttctcactcgcatcctgtatgtataacgaaaatcaagctttaattagtagtataatggagaggcagcgtggcagcgctggctttgttccctgccatcatgctataaactaataatatataagcgtgtcacatcaatgaaaacataatgttgtacgaagtattcactactctactatacgagcaactagtaccaagatgaatctcgatgagatattatgttcctttttttttaaaaaaaaaacactgtaccagctattagtaccatgaagccatgcatgaatcaagggcaaaatgtacttatctactctctctgttcgaaagaaaaaaaagacaaaccctaaattttcgtatctaacgtttgactgtccgtcttatatgaattttttttataattagtatttttattattgttagataataaaacatgattaatactttatacctgacttgtctttttttttcataattttttcaaataaaacggacggtcaaacgttggacatgtaaattcagggtttgcctttttttttatgagggagtacgtaagtatcgtgcttcctaattattggtgatattactcaaacacgcgattcaggcatggaaagtttaatcgatcgagcatattctccgtgttaatcattaaattaatttagtgtgttcaaccctgacaaagttggatccgatcaccgctgttgagcccatatcggtacctctgacaggtttgatcctcatcaggtaacagtggttagtcatgattgcacctcatctctaatcggtggaagccctttagtgatgattaacatctttaatgagccatgtagtctagtggttacagtgacctgagtaatactctaaggttttgagtttaaatcttttatagagcgaattttagattgggttgtttacggggttaagtaccttatttcaatggtcgtatatatccggttagatatagaggctgatacttttttttaaaaaaaaaatctctaatgggccattttgaaatatcccgttgcaggtgagattcacctgtatgacatatggctctttcttgcctgtcacagatgacagattgtcattcatcaactgtcataggtgtgaaaattaaaaaaaaaaagcctcgcccccctagctcacgatatggaggaaaaactgtaggataaatatcaagatgcacgacacatcaactttctattttaatggcagatccaataacatcagagaaaaattaatggtttttgccaaattaactaatttgggcaacatatcctaattactcccttagtacctttcaaacacagtcactatccaactttgaacatccgtcctaattaaatttttttaaattagtatttttattgttcttaaatggtaaaacacgaatagtattttatgcgtgatctgtgtttttttaatttattaaataaaatggacgatcaaagtttgagacgaaaactgcaaaactacacttaaaatgagatagagggagtattatccttgcatggctagctagctactcccttcgtcctaaaatattagagattttggacggatgagacacttcctagcacagcggatggctctctagattcgttgtgctaggaagtatcccatccgtttaaaatctcttatattttagaacggagaaagtagctagcagaagtagtatgtccattgctctatatataggatgggtggcagcagggtggttaacttaactggctataagcattaattagcagaagctagctagatgatatactcgatctatatgtactactacaccagatcgatgcatatggatcaccgcttagcatgtgctttcaccatttcgcagccaccgccgcctgcatgtgcctgcatgtgcctgcaggtttcgcacaacgccaccaccactgctgcagctaggaataatagaagcactatcatcgtgtgcagcccaaacgcaagcagcaagcatcacagcagcagcaagcgtttacgatcatcgcgtgtggtgtcttgtcatgcagcaccatcgtctgctccagctgctgcccaggctcccggtttcgagccctcggtgtggggtgattttttcgtccaccatgaacctcggccaacgcaggaaagtttatactgtattatccgtacctcagtgtgtgtgaaattttctcaaccacagacaatatactccctctgtccaaaaagataattcttaggttttcgtgtccaacgtttgaccgtccgtcttatatgaatttttttataattagtgttttcattattgttagatgataaaacatgaacaatactttatacacgacttatctttttaatttttttcataattttttcaaataagacggacggtcaaatgttaaacacggaaacccaggaatcgagtcattttggggcggagggagtactacataaatatatatcattgtcatgcatgcatggatcgagttatgcattgagtgtcggttcaagttttacagaggttaataattttaaccgattaccatcgaatttgcattcctgcatgaaggttactacctctgtactcacttgactagagaacattttaattttttgtattgtagaaaaatcagcaaaatacacattttttctcgttcaatttttttaatattttctttaataaatattaaattagtatgctttaaaacataaaaatatattttatacataagagctctgtatggcaaattaacctatacaactgaaatatatttttcaatgtaaacttattctattgaaatattaaccattagattaatttgcatctagattggatctagaaaaagccttaaaaattggcatattggtcaacaacttagctagcgtgaacatttaggatccatatgtcacacatgagtcttttagccatggaagctggccatctcaacaaaggtctgcaggttttgcttttgattgctagttttcatcgttgcatccaggctagcatgtgcaaggaaagaaaccacagtgctacactccataacaatatattaaatgttatcgtctctcgacaatgcagttttgtcatgattcatatctccagtccttgcctaagtctcgtgattcacaacttattgttttaagactgagaacatgcaaactaacataatttccaaccaattcgactcctcaaacatatcttctatctccaataatgaacactgcaaaatacaaaacaatctagctgatatgtttagaatgcagaaaaagaaaacagaatgaatcatcagtaacactatctttgacaaacgcgggtgattgccatgtccatgtaccggcatgcttatttttcaagttgttgtactagatgaccactgcctactatattcttgtactgagggtataatttactcaaattgttatgtttctctttgtcatatatagcttctaaactattgctactgcttttgacgaatctcttcaagtctatctttttttttcctgcaatccaaactaacaaatcagtacattcatgcagcaatcgacagaatggatgagggatagggccgacaaattgaaagaggatgtatgcacactatttacacccactaaggacatcttaaggaggatgtacttagtagatgaaatagtgcatctaggaatcgatcacctctttgaaaaagagattgaaactgcattaaaagacatacatgaaaccgaattcactagctctaaccttcacgaggttgctctacggtttcgtttgcttagggagcgtgggttttgggtatctccaggtatttctctacttagttaatggattgtgcatagttattttggaactgttcattactacgacgattgaggaccatatatatataaatgttcaaaagagattgcgaataacgtgcctagctaaaccttggaacttcacaaacatttttatatcaaatctcacatgcagatatattcaacaaattcaaaggagatgatggtaatttcttaaatgaatttgctgaagacccaaggagcctactatctttatacaacgcagcccacctcttcatacatggtgagccagaactcgaggaagctatttcttttgcaaggaaccatctcgaatcaatgagttcgcatagtgttttgaaggcccctttagctgatcaagtgaagcggcatcttcgcttgccactgccaaggactcacaagagagtggagatgctacattatatgtttgagtatgaccaagagaatgagcacaatccggttcttcttgaactagcaaagttggatttcaacctactgcagcaggttcacttgaaagagctcaaggaaatttctaggtactaatatgaatgctaactttaatttgttattttgaataaaataaaatcaaaggctaagacaattcatggtgtacgaaattaatgaaagaaatatgcaataattaaaatcaataaaaatggtaatctataatatagtctagaacaaaagatttgatgaccattactgcaaatagctataactgtcagttgatttagaaaagacatactccttaattactacttacgtgcaccgtatagagtgtgttgcagtttttatagaataaatgatctaataacacaagcataagtttcgcggaacatgaattatgttttctatatagaaaaagaaaataacctgaacattaatataacttttattatatgatacatgtaccgtgctatgctacgacctttaactgtttgtgtgtatatatttaagaacctgaaagtaataactagtattaatttttttctcaggtggtggaaagatgttttggcatatatgggtctagaccatatccgagaccgtgtgatcgagtgctacacctggtcctatgctgtataccacgagaaagacttggcacttgcacgaatgatctttgctaagctagtcgcgctaacttccgtattggatgacacatacgatgtccatgcgtatacctccatcgaagagtgccggatgctaaacgtagccattcaagggttggacacttcattaatttttatgcatccaattaatcttaagttttggataattaattaaatttcccctgacgtaactgctagattatttaatcctgccctgactaataatgttataccgttccagatgggatgacagcgctgccttgcttgtaccagagtacctgagaaagttttatgaaataatcttgaggacctttagggagtttgaggatcaaataccaagaaatcagaggtaccttgctgctttctccaaggcagaggtatgactcactccctctttacttctgacccagaaaaaaacttagaccgtccttgtttatttactctcacctttgatgaccaatattttaactttgaccgttactccctccatcccataatataagggattttgggtggatgtgaggacagatggagtaattaataaccttcaaacaatcaatatatgattaatcaaaattaatcatatattttaatttgatgaatgacgtatcgtagggtggtgtatactttaggaaaaagtatgaattaccccgtgaacaatcgtggtagaccgaattataccctgaactcgaaaattggacattcgataccctcaactattgttttgaatggttttgacttgaaattacacacgtggcaccaacgtggcagcccagtcagcaaaacaaaaaaaactgggcccacttgtcatacttctccctcaatcccctcaacccagtcccttcacattcccccctgctctctcttgccacgtgctcggttggccggtggtggaggagaaccacgcccgagcgggtggaggaggcggaccgggcagccggcgacggatgcggacctcgcctgggcagtgggcaactaaggtggagctcgcccgggcagctggtggcggaggcggacccgacgaccgacagtgaatgcggatcaggctattgacgacggaggcggactaggcagccagcggcggaggtgtagctcagctggtgccttagatccagagcccgccgtgggccggtgggggacgagggtgacggcgatgaggtcagtgctggcataggaggaagcagagccctgggaatcaaggcgacggtcctgacagcaatgacgagtgggctcaagctcctcctctcaagccatggcactaccgagctcctcctcctcgagttccctcccttggttgtgagctccacaactctcctcgctaagctcgagctccgcctagtgcgagtccacgtgcacgtggctccggcaacaagcacccccttctccgagcgacggcaaaccaccaccatggcaccaagccacccctctccttcttcctgcctccactcaggcatgaatcccatccccttttgttgagctcagagaagacggggtcagcagcgagcttgatgtaaccggggcggcatccaactccatggcagcatcgaatcaaagcaatccccttgctgaggtcaaggaagatggagtcgtcggggtggcctcatgcccatgacgagctccacggagacggatccgcataggttgccattggtagagcgccggcggcagcagcaatagctagccgagctcgtggagccccttcctccccctccctgttggattggccctggccaccggtgctctctcctctgctcaccgagagagagaggctgagaaggagggaaaaaaaagagacgctgacaagtgggccccattgttttttatttgttttctgactgtatcgcgacgtgtgtgccatataggctgaaaatcgtatcgaatagagttacaatggtaatttgtccggttttaagagtttggggtgtcaaatgttctgtattgtagtttagggagtaaatcgtactatttcaatatttcgggagataaattatggggtatatatacaatacagtacatatgtccgcgatagaagaagtatttgaaagtgttttaaaccagagggagtagcataaaacctgctgcatatatatactaatttttattgtatattttgtagtaatgaatagtattggagcaattgatatcaattagtagtacgtactatatatttacatatctatctatgcagttagttttgtttcgtgaatacatttgaatccttaatttactagcttgcatgtgtgcatgccagttccaaaagctgaccagtaattacctggaagcagcggaatggtaccaccggaatcacaagccgagcttcaacgatcaggtggctctgggaaccgcaaccacaggcacaagatcgcttgctgccggcctaatgcttggcatgggtgatgctgcaacaacaaaacaagcattccagtgggctgttactagcactgacgccatcatctcctgtggaaaaattgggcgtttaatgaatgacatttctggattcaaggtaacagagagagttgaattaatttaatttactgctggagtagtattttactagttaccaagtaattaattaatctcaatttagaactccatgtcaacgagagagctagcatcaggtttgacagaattttccacttaacataacgctcggagatatcttaggctagtgtgtaaggacatgcatgtttgacacggctagcttcgaatccaatttttttaaaagctagatattttgattgctatctagctctagaaatccatagagctttaactatgtcgatagcatttgaattaattatcctttttcttgccattttcaaatccggtccttattgagaaatatatatagctttcaaaacatggtgtatttgtttctgaaataaaaaaacgcaagtactccctccgtcccaaaatataacaacttttagctctcaagatttgtcccaaaatataacaacttctccactaatccctaaccaatcacaaccccccaccattcaatttttccacttaactccactactcaaccaataataactctccaccattcacttatatatactttcttaataactgtgccaaactctaaaaatacttataatatgggacggagggagtataagggaaggacctaatattaaataaataaaaggggagaggcttcgaacccaggccgtaccaccttatgagaactctggccgtttctctatttctttctgaaatataactgtttaattattaatcactattcatttatacggatgcgcatatgcagcttgggtcgcagaacaaagctgacatggcatgcgcagtcgaggcctacatcgaggagcacaaggtcacagccgacgtcgccatcgccaggataaacgaggtgttggaggacgaatggaaaacaaccaaccaggctcgcgtcgaccaccgggctgttcttcctgtggtgcagcgtatgatcaacatcacgctgggcatccagttgttctacggcaacgactgtgatgctttcacgttcggcaaacagcttcaggaggttcttgaggatctctatgtcaagcccatgtccttattatagaggctgaaactaggtgaaaccccgcgcactgctgcgggaatttagtataaagatatacattgaaacattatgtgagttatgttggatgataatttaacatgtttgtgtttgaaaagctcttaaattataaaaactatgaagatatagcatgtttgcatgatgtttaaatgtgatgattgttagtggatgatgatgtggcatcttgttaattagtgaatgatgatgtggcatctttgcatgaagatatacattaaaacattatgtgaattatgttggatgataatttaacatgtttgtatttgaaaaactcttaaattataaaaactataaagatatagcatgtttgcatgatgtttaaatgtgatgattgttagtggatgatgatgtgacatcttgttaattagtggatgatgatgtggcatcttgttagtggatgatgatgtggcatcttttaatgttaagcttaaggagttagtggggataactttacagtaagataggattagttattgcatgcatgggaatgattaatgccaaatatatccatctgtctcgtagtttgctcaatcagtaccatatatatatttttttatctaattcacatgatgatcgatgtacgtgtccatgaactttttttgggcagcaactttcctctatttatctatatggacaaataatgctagtgttagctgctaatcacccgatcgaacactttgtgcgcacaaggcacacgtccggcacggcaacagacgagaagactgaagaatgctaggagaaattcagaacagataaacagagtatttcagagtttcagagaatcatgggagagagagaatttgtggggtaattttctggtttcttccattcaactgaattgtaaaaacttacaaatggaaaacttagctactgctacttatactccaataacagaaaaaaggaatccaagcctacaattgcgccatcccacgatccagaactcctggatccaatgccgtgcaaaactcacgcccacaacgcacgcctgacgcggtcgtcgactcctgcagcgcaccacatctctcgtgcacgcataacaaactcaaacctgaattattcatccagccgttgcaactgccacagtctggaacaccttggggccatagctgaaataacagtcaacaaattcccccttaattctgctatgacccaaaatcacgaacacctagcaggtgccgtgctgtcgccaatctcgctgttggcaacccagttaacacatccgcccactgctcctcagtccggacgaactcaatctaaatcttcccactttcaacacactcccgaatgaaatggtagcgggtgtctatgtgcttacttctcccatgaaacacaggatttttcatgagtgcaattgctgatttgttatcaacatacaacttcaccggcctagcgtctgcaccaatcatctcaatcatcaatcccctgagccacaaagcgtgacaagctgctgcagtggctgcctcagcctcacaggacgaaagtgccaccgttttctgcttttgtgaacacgaaatcagactattgttgagataaaatgccatatcgctagtactccgacgatcatcactgtcaccagccagatcactatctgtgaatccgatgatctccactgcacctttaccaccagcaaacgtgagccaacagttgattgtacccttgaggtacctgagaattttcttcatcgccttgaaatgcatcacagtccgatgctcgatgaacctgctcactacacccacagcataggacaaatccgaccgtgtatgcaacaagtaacatttttttgaacagtttaaatttgaatttaaaaatatgacaacttcaaacaacattttcaaatactaaatgatttcaattgaaaatgtcatcaacaacaaagttgaataactcatcaagatctaaaacttttatttttgttatttattcatccgatgaaatgttagtaatattattcataaattttacatatatgtgttatagtttataaaaccagataagagatatgtcaattttgtgaacaatgttactatcactttgtcgtatgaagaaatgaccaaaataaaagttgtagatcttgatgagttattcaactttgtttttgatgactttttcagttgatatcatttagtattcgaaaatgttgtttgaagttgtcatattttcaaattcaaatttaaactcaaaaaatgttatatagaaaaatgaccaaaataaaagttatagatttttatgagttatataactttgttgttgatgactttttcagttgaagtcgttcactgatctaaaattctatttgaacttttcaaactttgaatttcaaatttcaaattgtttaaatagagtcaaatggagaaatgaccaaaataaaaattttgcacctcgatgagttctacaactttggttttggtgacttttccatttgaaatcatttagtaaccctaatttgatatcttggcctagggcataataggattaatagaatactcataccaacatgttacatctactttttcggaagccaatcttcaaagaactttgatgtcaagcgtgcttggtctggagcaatttcagaatgggtgaccgatcagtaagttcccgcgtgggtgcacacgagtgagggctagccaaaaaataaaatttttatttttgtattatactcatctgtgacgggcattcacccatgctatagctaatgcccgtcacagataagggtcatctgtgacgggtgctagttgtggcccgattgagataggtaatctgtgacgggctatagtttgactggtcgtctggatcaaagttatcggtgacgggctttacttagggcccgattgagatagaatcatccgtgatggccgtttgtccgattgagataactcttcacatcagtgacttctagcctgtgacggacgccatgcccgattgagatggggcttaccgtccgattgagatgagggtatccattctagtggtggtccatacaagtactaaactgaactttcaacttatgtgtgtatgccgacaaccatcaatcataaatgtttggttcgtatgcggaatccattttcgtttatcattgacaagaattaacagtgcttttccccatagactggttgcaatattatgaatgaaatagccaaatcaactttaaagtctgactgcaacaacttgtaaaaacttatttcattacttccttgaggaatatttcatcacaatatgatgcttgttaatgttaaaaataaaagatataattaatttattcatgggtttggtttagttctagacgttctttctctcctctccaattctcaacttatactttgtaggtcgatctgaccaataggtgatggtgagagcatatgagaatggagctggcctaggtgagacctgtgcaattcattcctcaatccaaaacttcttatgttgcttttcttaatcctattcacatgaacggcatatagcatttttatccattaaagggtaaatttaagtatagtagttagcagtcattttgttatacgatttaaagtcagttttgtggttttgttatgcagaagagtacttagcagttctttattaaagttgactgttatgcatagtattaaagtataattgatatatggatggattttgtttgaagttagtaacaaaattagtaaagttcaggggataagagggttgttgacactgaaaaagttgtgtgatgtgcaactaaataggtgtccatttaaattgaaatttatattctgcatactggggcttaattcctcaaattatttttgtctcacagatgcctaggaggactacattcaggttgctgcggagtattttggtttgctgatttcgacattcattttggtgagttacttgtggctcgacatagtgtggacttggccagtgaacctagtttcctcttgtggttgcatttggtcagttaacataggaccttattttgctatctaggatatggtggaattgctaaaaccaaacctagtttgcaattgtagctggatttggtgaagatgtactaaacatgttattattttgctatggtctgtactgatatgaggtcagtgatcacctgtatatgtgaatgggctttgattgtaagtactggtttgataaatggacttgtgctatattgaatgttaattgggcttatatatactctgttaaatggttgttatatctcaagcttatgcaagcttttgtaatgggcttatgagctaaaatagtgtttaaatagctgtcttatatgggtcattccaatatcttattggacctataattgggcttaacacataaacatattgcctcgtacatggaccataaataacaataaataacagcccacaagaaatttcatcacgattaatatcgtcacaattaacatgccatgtcagatgggacattgtactacaattttatgatgtttcttgtcctacatggcaactgcaagcctagtgatttgtgacattttctaggcttcgtaatgacgaacatgagcatcataaagcaatggtgaaagaaggatcgtttctaggttaataacaaattaaatacgttttcgttacaaaacatgattagagaggcatgataggtgacgatcgacttttcgtcacgcgatcatcacaaagtttgaaacgtgacacaattttcattctttgtgacacaaatgaaacgtcacctagctatcataagatctcttgtagtgtgggtgatagtgctcggtaaaaatgtgagccccagttttctaataggtgccctttttttaaaaaaaaatcggcacttatacttattttaaaagaatcgtcacctataatacaagtatatgtgtcggttctatttaaaaaccgggagtattgatgccggtttttctttagaattgacacatatattgcttaaaggtgtcggttctactttttttcatcgtgctgaggtgagaaaatgctatatttgccggttttaaatgaatcggcacctataaggccggtccctatgtgggttttttaagtagccttaacttctataaggcacacaaccataggtttgttcaatgaataaaaacatacggtgatgatggaacaaaccctcaactccatcttatttattaagtagccctaaatcacatagatttagctagcaattttaagagtatagcgccaataaatacagtaatattatttggcgcacatagataaaaaatagagcaacccaccatgataatcattatgagaaagatggatttgcattacccccatttgggcatgcagtaactaattttggcctctatatgggcatgggcttgacatagagattctcaagaatctcccgaagttgctcgccgaaagtgaaagcatcactgtcatagccgtagaacatcgggatggccatcgttaagttgataaggcgctgcgccactggaagaacagcctggttgtcgatccgagcccggttagttgttttccactcatcttccaccagctcatttatcttggcgatggcaacgtcgaccgtgaccttgtgctcgttgatgtaagtctccaccgcgcatggcatatcggctttgttctgcgacccgatcgagctgcaagcaattcatatgcacgcatccgcgatatgtaagaggctataattaatttagaggagggatataacaaaagtaaacttcagagaggaaaaacgcacaccatgttttttgttttgtttgaaatagaaacagagaggaaatctatatagttttagtttctagagctagaaacagacaatcctaagaaatcttagatctgaacctatggtaaaatatggtccagtgaagattaattttgtcaaacctattgcatggttatatatgttacattattactctcaaaacatgcatggtgatttctgaaatttacttcctaactaaaatactacaggtgaatcaattcgagcctatgcatcgatcgattaattaccttatatccggaaatgtcattcatgaaacgcccgatttttgcacacgaaatgatggcgtcggtgctagtgacagcctactcgaaagcctctcttgttgttgctgcatcgctcatgccgagcattacacccgcagctagtaatcgcgcgcctgtggtctcggtcgcgagagccacctgctcactgaagcttggcttgtaattccggtgggaccattccgctgcctccagataataactagacaacttttggaactatgcatatgcatatatgcacagaacatattaaattaattaacgatcggaatgtagctatccatgaaacaaatgaactccctcagttttaggttataagatgttttgactttggtcaaagtcaagatgctttaactttgaccaagtttatagtgaaaagtactaacattttcaacccaaaacaaatttattatgaaaatatattcaattattaatttaatgaaactaatttaatattataaatattattatatttgtctataaacttagtcaaacttaaaatagtttgactttgaccaaagttaaaatgtcttataacctgaaacggagggagtactagctagctagtaattgatattgttccaatatatactatatattaattacgccaaatatacaacaaaatatagtgtgtgtgtatatatatataggtaggtaggttttatgcgtttacctctgccttgttgaaagcaactaggtacctcttattgcttagcatttgatcctcaaactccctaaaggtgctcaacattatttcataaaactttctcaggtattctggtacaagggagacagcgctgtcatcccatctgcatgatattatatatattagtcagaacggtattaattataagttaatctgtgtggattatattttcaaatgtaaacttaacaaataagttcaaacaaatggtctaggtaatacaatactagaagaattttcttgtagaaaatatgtttcttgaagctagcgtggaataaaccattacacaataacatatactgcgaataagttaaattgaagaatagaacatatgcccttaattaactagcgcgaggtgttaaccagttaatacatatccatgctcaaatatcatacaataatgagtatattaagattatattgagatcgatgtgagacgtagaaataccccacccttgaatggctgcgtttagtgtccggcactcctcgatggaggtaaacgcatagacatcatatgtgtcatctaatagggtaattatcacaactatcttagcaaagagcatccgtgcaaacgacaattcttcctcatggtacactgcgtaggaccaggtgtagcactcgatcacacggtctcggatgtggtttagacccatatatccagaaacatctttccaccacctgaaaaatagttattccaagttttcttatatacataattaagctgacgaactaattaaataggacgataattaccaacatatatatagggaatctatctagcttggacaataattgcaaactaaaacctttattaattgttgtcatcataatttactaagcggtcagtatgatatatagcacggtacatacatgtatcccataatgcttaaaaaatatatttgtcatatcagatcgatttctataaaatgtgcaacacattctctccatagtgcgattattttctatatctttccgactattctggagctacctatgatctatcgatgatatacatatttgaatccattggcagttgtaacaatttataataaaagattgtcatttgtattgattttattgcatatttctttgagttttgtacagctagccatgaactgtcattacctatccttagatattatccttatacaaaataacaaagttattatgcatattagtacctagaaatttccttaagctctttcaagtgaacatgttgcaggaggttgaaatccaactttgctagttcaagaagaaccggattgtgcccattgtcttggtcatactcaaacatataatgtaacatttccactctcttgagagtccttggcagtggcaagcgaatcgcatgcttcacttgatcagctaaagggcccttcaaaacactatcccaaatcattgattcgagatggttccttgcaaaagaaatagtttcctcgaattctgctcaccatgtatgaagagatgggctgcgttgtataacgagattagaccccttgggtcatcagctaattcatttaagaaattaccatcatctcccttgaatttctggaatacatctgcatgtgagatttgatataaaagtgtttgtgaagttccaacatttagcttggcatgttatgctcaatctctttaatttgaacatttttatatatatggtccttgtgattgtaatcaacagttccaaaacaactatactcaatccattaactaagtagagaaatacctggagatacccaaaaaccacgctccctgagcaaacgaaaccgaagagcaacctcgtggaggttagagctagcgaattcgctttcatggatgtcttttagtgcagtttcaatctctttttcaaagaggtgatcgattcccagatgcactatttcatccactaagtacatccttcttaacatgtccttagagggtgtaaatagtgtgcatacctcctctttcaatttgttggtcctctccctcatccattccgccgattgctgcatgaatgtgtattgatttgttagtttggattgcaggacaaaaaaaaagatagacttgaagattcatcaaaagcagtaacaatagtttagatgcaatatatgaacaagggaaacataacaattagagtaaattgtattctcgtacaagaacttagcaggcagttgtcatatagtacaacaacttgaaaaataagcatgctagtacatggacttggcaatcacgcgcgtttgtcaaaaataatgttaccgacgattcattctgttttctttttctatattctaaacatatcagctagattgtttgtattttgcagtgttcattcttaagatatctttgaggagttgaattacttggaaattatgttagtttgcatgttctgagtcttaaaacaatagtaagttgtgaatcatgacttaggcaactggactggagatatgaatcaatgaatcatgagaaaactgcattgtcgatacgataaaatttaatatattgttatgcaggagtgtagcacgctgtgctttctttccttgcacatgctagcctcgttgcaatgatgaacactaccaatcaaaagcaaaagctgcagaccttcgtcgacatggcgtgcttccatggctaaaagactcttatgtgtgacatatcgatcctaaatgttcgtgctagctcagttgctgaccaatatgctaatttttaaagttttcactggatcgcatcatatccaccaatcaagttcatgtaatctagatgcaaattactctaatggttaatattgcatgcaataggataagtttacattgaaaaatatatttcagttgtgtaagttaattaatttgccatacagagctcttatgtatgatactcaacgtattgttatactcatctctgtttcatttaggtcataacatgttcctaaaattctgttccatgccatcttatctgttaattagcgcttcattgttttcgaaaatgatgaaattggtaatatcttgcacaccgataaaatggaacatgccacacatttttcgtagtggtaaccacgagatgctactttgatcacaatatatttattagagaagtgtagaaaatgattcaattttacga

SEQ ID NO: 35259 - DNA, 14306 bp, Oryza sativa
tgttatactcatctctgtttcatttaggtcataacatgttcctaaaattctgttccatgccatcttatctgttaattagcgcttcattgttttcgaaaatgatgaaattggtaatatcttgcacaccgataaaatggaacatgccacacatttttcgtagtgttaaccacgagatgctactttgatcacaatatatttattagagaagtttaaaaaatgattcaattttacgagagtaatttgcatttatgtatgacaaatttattagaaaagtttagaacatttatgcattcatttgtaatatataaatgcatttgaaacatacaaatggtgtatacatttgaaagattttttaaacttttataacaaaaaataagaatggtgtgtattgtgtatgtacatcacgtacacaagataaatgtatatatatatacgtacacaccatttttatgtttaaagcatactaatttatattaaagcaaatattaaaattattgaacgagaaaaaatgagtcttttgctgatttgcctacaatacaaaaaatgaaaatgttctctagtcaagtgagtactccctccatcccaaaatataagcatttttggctatgaatctggacaactgtgtatctatattcatagctaaaagttgttatattttaggacggagatagtatatatgtatataggtagtaatctagattactacctattcaatggtaattggttacttcctccgtttcatattataagactttctagttttgcccacattcatatagatattaatgaatctagacatatatgtgtgcctcgattcattaacatctatactaatgtgggcaatgctagaaagtttttataaccttaacggaggttgtggagattatgcatttcttctcaacagtttgatggattattgtcactgacatcatcaccagcacccctacttcatcggccctgacgtctccgccgttgctaaggggtgactacatcctcgctgtcggttgcttttgtcatcatagactttcatcgctgacttgttatttcgtcttcatggttggcctactacgcaactgccgatgggagacctcatcgttatcattgactgctacactgctattgactgaatcaatgatatgatcatcttcatcaacatcctaccatgcctatttgcctatgcctactctgctgctgttgatggtcaacttcgtcatcacagccggctatcttggttgccgccaattgtcattatcgccgattgcatttgccatcgccaattgttttcttcttttgcatgattgatggatttcgccattgctattgatgagcgtctacgtcttcaccaccggcttgcctctgccaccgcccatggtgtcatcgctttcaccgctggcttattatgcctctactgatgggcgtcttcgtcttcttcaccgggcacctcgtctgttatctactgtttatttcactgccatggctgcataactctgtcgccgttgctgggcgccttcgtcttcactgctggctgacttgactgttgccaactggtttcttcgtctccatggcaatgtgacttcatcacctttgattggtgtcattgtctttaccaccaccaacatcattgtcagctttgatgggtgatatcatctttgtcgacgggtggtaccgcgactagggtatttggatagtttggggatcgttggtaccagggtatatgcgagattaaggtaaaaaacatggggacgaggatttttatacaggttcgggcccctgaattgtcaggtaataaccctactcctgttggccgaagtcggtcgttgctcttattcactataatcacactagtacaatatttggggtagcctatctaactgttgtcgacttggcggtctgaagtgctgactcgtagtcgacaacagggtagccttcctcctcgaatctgcatccgacgagatcaaagataacgctatgtctctcctgacagtatccgtagacaccgtaggggactagccatgcttatctctgaaatcgatatccgccgtcttgtcttggcgcatgtttgcttgtatgttgatcttgtgtcttgatctattgttccgtgtcccctctcctcctagggggccttgtatttatacccataggtgtccccttgtcgaagtagaactagggaaaccaatatggatacaatccgagtagtccttgtcgtttccatgtagaactctattcatccttccttatgcgaaactcctcctatatccgaaagttgtttccgtataagacatggtatgtggtgggtcttattgagatttagtcaactaatattaggtatgtggtatccataaccctgacagtagccctcgacttcaatgcaaatgaatgagttcatattctccatccgaagacctcggaataactgttatcgatctcacgtgacctttctcggtgagttcagagataacgttagacttcccttatcatccttgtgcgggcaccgtatagggtttgtctgagtcaatctctgacgtcaactaggaatgtacagagcatacgactaagtctcccgtcttgctgtaatcgagaatttggattgaagtcaagaaattttatctcggcggatacaccatctcttcattccgtattccttgtcgagatccaccaaccattctcgagtgatcgatgttggtatttcttaacgacgttactagaaatataattctcagcaatgacgtagaaatactccaggtatattatggtcacagagtttatccgcaagcgcacggatataccattgtagcatttcacccgagagtattccaagggtattgtatttattttatcccgtgggaagatcatgtagagagaactcaattaataatttatatattacttgtgatatttatattctaagcaggggttaagataatcaaagggtagagtgacacacaagcattactactcattctcataatatattatctgagttaagtggaaagaaaagagaaagaaaatctattcctatacttctaatatacatagtatacatacattctagttaactgatatactagctaataccctctatccgatgccctcctagtacttcgagaagccacccctgactgccgagttacttacgacagcccgtcatgaccatacaaccggggctaaatatggaggaataccctccccagggaattaactttggattataaaccggcgtggaggaatatccgtacagagctgtcaccatcagcggcccacctctcatccgcaatatataaccctaaataatgatatcccgtaatctagacaccacgtctaaactaccagatactactctaatatcatagtcatgacatagagtaattgcataagcaaacattatacccacaccaaagcatctcccagataagctagccatatattcagtataacatgaacataatgtaaagtaggtactcatatacttggaaagtatttcaataccataaatgtatttagaagagtattctaataaaagtacaaatcttacaaaagagaaaagaaaagctactagagccatacccgaattcttccgaaggcttccggactcctgatttctactctattcctattccaccagctagatactactaaactaaacttgagagaaatgagagagctattgcttgaggtgtgtgagtgaagtgagaaggtgaagtccttttatagctgaactatgacggttgtgacggttggaatggtcggtaataccctccaaccgtcattggggcttcatctcaaccgtccagccaaaacctggatccaacagaggcgaggaaggttcggccgaaccaccaggttcggccgaacctggtgctggcccgatccagcccaatttcggctggtggccttctccgttgttcttctccgcagacttgtgaattttggcccaatttgttgtgtcaattctgagttcttggcccattcatacataagtctggttttcgacatcgtccgattgatttatcgtttgagttgatgtcgattctcctccactttattgtcattctctgcaaaaggttagtatacctaatactagtggaatattattattctaacaaacatatgcattgcaagcatcactagttctcctctattttggtaatattaacggtcgaaactgatcgataacgaccgtcaacaatcgagaaggggcagagtctgcgacggagccttgtcaacatttgtcgtactcgccttagtcgatcttggtatagaaccatagagacatggagtctttgacaatgtcgaatagaattttcctgaaatcaattcttagaaaagaatattagatagaaatagcccccgagtgaacgctcaaagggtgacatgttataatatgtatggaaaactgaaaatgaattaaatttacagaccaatgttttgtatatgagcgtcttctcttttaccgacttcgataagtcagtttgttgagtcatacactctccctagcccccagccttgtcatcagagataagttctcgaaggataaggctcttggacccttgaccggccttggttgaaaaagcgcttaccctagcccccagccgtgaagttggaaaacccaatttccgattaatggcttggttaatacgcacggtgagaactcttacatgaccagatcttacatggtcattcgtctctgcattacctgacaaggccttatccgctctgggcgtccccagtcgaagttcccttaggttcctcggagtccttgctagggcggcgtaaagggacagtaggattggtttcaactctaggtgttgtcgtggtaagggatctctgggtaaaacacttggcgatattgtgtacctgatatcaactttgttggagtagaggtaatgggaggatcgctacaccgctggttgaaaaccagttgtagccccaactcgaccacttgaagtaaaggtagtgggagaatcgctataccactggtcgaggaccatgtagtagttgtaactcaaccactagaagtcgatgtagtgggaggaattgctacaccgctggtggagaaccaggtgtagccttaactcgaccacgagaagtaaagctagtgggagtatcgctacaccgcttggtcgaaaaccagatgtagccttaactcgaccacgagaagtaaagctagtgggagtatcgctacaccgcttggtcggaaactaggtgtagccttaactcgaccacgagaagtaaagctagtgggagtatccctacatagctggtcgaaaaccaggtgtagccttaactcgaccactagaagtagaggtgcgagagatcgctacagcctactggtccgagaaccaggagtagcctcatccgtttgccgattgatgtcgaggtacgagagatcgctacggcctactggtctgagaaccaggagtagccttatttctcgaccaattgaagtggtgcgaggaccactacgctactggtcgaagaccactcatagtcgtacctcgaccatctgaagtcgtggtgcgaggaccgctacgctattgccgtagtcgtacctcgaccatctgaagttaaggtgcgagagattgctatgatttactggttcgagaaccagcgagtagaattatctctcgaacaccaatgggggcactagagttggtttattacatgtgcatctcatgtggccagcatgactcacatacccaacttgtagcatatccggatgtccgtccgcaatcatgtcgggtgatcaagccgacatcgttcgcgagcaattatccgttaacaacccttttctcaaatagcccagccatagccggtgctatgagatagatcattggtcttcgttggtaggttgggtgcgacaactctgcatttgtcgagaacgttctcgataatggggtgtgctcgaccacaaactactcgagtgctcaattgttcctgaaaaatattgtctagaagacaagatatatagcaaaaaatatcgagtatgtactcaaaagactgcatgaatcttctagtattatcagggtataacgagcagattaaatattagacattatgtaaaccgtaaaaaagcatgatttatacagaagaaaatagaatgagcccccagcattaaaccgtagtcggcctaatatagggaatgcccacataatagatattgtataaagaacatgttctaggtaaacataataaattattgatctgataatattgtatgatctcgaaaataggtacgataaaatgtaaataaaatattgcgtacctttttagatatatgccggatatatctacggaattagtaaattaatttaaaaaatcaatttagtaaatacctatgtatttatatggtggcttggtggacagctgtatcagtagaactccattgtggcctcgtgtattgcctctgtccatgtctcggaacgcctgctagttggggagtaccaatgcatcaatgcatctgggcttgctggtagtcttgccggggtctgttggtaacaatggacggacaggaccaggcaaacgtagcagaatccaactcccatgaaactaacatgcgtagtcggatggctctactcatgaactgataccacgtcacatactttgtgatcgggcattgggatatgcttttatccgattggtcgaagagattgctggcctggtatgtttgcattaacccagatgaaaacatgcatggttaaggctccgcgcacggctccccgatgaccacaagcacatcatcattgcttctctgcggcgtcggcatcttgaattttgttgatctccataggtcaaattattgacggcgatagctccgatcttgttggaagacatactccggttgggttagatctccccacaaccgaagtcgtcgagtagcttgttgttggagaattcatctcttaaacccatctcgtcgtaaccttgaagcaccaagaccccctacctagcgcgccactgtcgacgcgtggtaccgcgactagggtatttggatagtatggggatcgttggtaccagggtatatgcgagattaaggtaaaaaagatggggacgaggatttttatacaggttcgggccactgaattgtcagataataaccctactcctgttggccgaagccggtcgttgctcttattcaccataatacaccagtacaatatttggggtagcctatctaactgttgtcgacttggcggtctgaagtgctgactcgtagtcgacaacagggtagcgttcctcctcgaatccgcatctggcgagatcaaagacagcgctatgtctctccagactatatccgtagacattgtaggggactagccatgcttatgtctgaaatcgatatccggcgtcttgtcttggcgcatgttggcttgtatgttgatcttgtgtcttgatctattgtttcgtgtcccctctcctcctagagggccttgtatttatacccataggtgtctccttgtccaagtagaactagggaaaacaatatggatacaatccgagtagtccttgtcgtttccatgtagaactctattcatccttccttctgcagaactcctcctatattcgaaggttatttctatataagacatggtatgtggtgggtcctaccgagatttagtcaactacaattaggcatgtggtatccataaccctgaccatcttcatgttggtcatttcgtctccatgccgactgcgtcagctaacatcaatggacaattgtgactacaatagaaggataagctacatgcttaggggcacatcaacacaagcgcgaggattatatcttcaatttggacttgttccagatacattcaacatggattcatggtcatgagtcgatttctcatgctcaaacgattagactattcattattccccacgagggacatcagctgagtgcttgcactagtcgggattcaattatcacatctactttggtattcttcatgagggataattacgcgatctacatcacccaggatatttatcacttgggatcatattaattggtgtgttctatacgtcatattttaagggtatcggtagatatattttaggtctaggcctaatatgtctgcagcccatattttcaggtgtggcctgtcacgtttttttagggactaaggcatttttttgcttaggcaaaagtgcgcgtgattaagtgcccaataccttaaaatccttttataccgcagttactcaactttttagaagttggtacaatgcattttaaaaggtgccgaacagtgaagctttatatagctaccccgctgactttttatatagtcaaggcattgtttggttttataaagcaattgattggatacaatatcgttggtttttcgccacgtaagtgtgtatttttattaaccaatattatggcttaggctgattatatattatggtcattttccaggcggttggtaaatcctttatgagtttatttactcggatttttcaccacatgtgccatacatttccaggtgtggtaaaaccatgtgtcttttagggacttaagcacatcttttaaagcagtgtgcgtatggtgtgtgcccgatactttggaaatttctttattcacaacatacaagcttctttatagctgttctgctatgtgaatcttcaatgatgaagtcaactttagcttgcacgcatcatattttacaaagcagtcggtatatcacttgtatcatgttattcggggattcacactacatatgccatatattaatatcaagtcacttggttgactataattatcgaaaaccactcagttggttggattatttactccttaaatatatgttcagtttgttcaactaaccacatagtcgggggctacacctattaggtgcatctaatcgatgcacctaagattacatttaattatttctcagccctccacagtcttcagatttggtaaaagtacttgggagatcttggcggagatgattgaagcactcggctttggagtaatctagtttgagagaagattatcttttcaacagtaaaggtctcaggggtactgtggagattatgggtaccccatacacatacggcatggttatccgactggttataggagataacttatatctatgaaatatgtaacggatcatgacttgggtattatgttttcttgtatattatggaatggcctaaagtcctggtttgataatattgtaaagtagatttaggaaaccgataccgtattggttaaggtttctatcttgtaatcttgccccccatcttatataaggtggacaggaggccctctagagtgcatgtgacataaacagttcatcagatcaatatacacccagcggattcaaatccccaaacaggagtagggtattacctctcatcgagagggcttgaacctgtctaaatgcttgtctccgcatccatccacttttaggtctcgtgcgctaccccttttattattgccgaattcttgtttcggcagttggcgcgccaggtgggggtgcgtcgagtttaccgtcgacgagtgcgatggaacaaatctcagaagttgtcggcctcatcgttgctttaggccgggaagatcaatcccgacgggttcgatgaatgcaatctctctcgctgccgagttctttccttgatcagtttccatgaagagcactgcagcgatcagcatccagtttaatttgtctggcgagatcaaactatcaagcaacagatccattcccaagaatcggcgtcttttctcatcaacatcaaaactcctggcgatatccaatttttagcgtgtttgcttgaatcggagtcgacgtggaatcagccgacccaattgattgagcaattatcttgaagtgttgcactgtcccgtatgcatgtatggctcgtgcatgtacatgtatgcatactcgccaagaagtcatcaccgagcaacaggagcgctcaaacaaatatgcatgcattggttgatatgctacaagagtaataatataatcgtgcaacgatgcatgagctggatactacgaactattccgaatagctaagtcgctttattttctcattaattttatattctcatctgagttatattttatatgctcttgtctttttgacaagattattctacttattgctttctttggcatgtaagtatacgacaatcaagatcaatcggtcatccgtggctaggcgagatggtcgttaacctactgtcatgcacatgtatcacctacgtgggattcacagtagcatgtatggatcaacacacatgatcatccatgccgtcaggatttttgcatgaatttgtcaagggctgtgtgcttgcaccatcgctattgatgggtgtcctcatcgtcaccaccggctcgcctcgtccgtaaccgattggtgttctcgccatcacggttgaatggtcacaccaccgttgataggtgtcatcatcttcaccgaccggccatctcgtccggtgtcaactggtgtgtttgcctatacggttggttggtcacaccgccattcatgggcgtccacgtcttcaccgaccggcttgccttcgccgccaccgactgctgtctccatctacatggctggcctattatgccgtcgttgttgggcgtctacgacttcaccgccggcctgcctccgtcgccgccgactggtgtcctcgtctatacggttggttggtcacaccaccgttcatgggcgttcacgtcttcaccgaccggcttgccttcgctgccgccgactggtgtctccgtctacacggctggcgtattatgccgccgttgttgggcgtctatgacttcatcgccggcctgcctctatcaccgccgactggtgtcctcgcctatacggttggttggtcacaccatcgtccatgggcgtccacgtcttctgcaaccggcttgccttcgttgccgccgattggtatctccacctatacggttggcctattatactgccgttgttgggcgtctacgacttcaccaccagcttgccttcgccgccgtcgactggtgtcctcgcctacacagttggttggtcacaccaccgttgatgggcatttatttacctacatcgctggttgcctcagccgcttacacggttggtgctttcattgccattgatggacgactttgttctcacatcgactacctccgccgtcacaagcgggaatactaaaaagctaagtctttgttagttctattctttatatgtattttccttttcctctgcctcactacatcaactggttcgccttgactagtgagtcgggggctaaagatgttatatcatattttttctacaattttcatatatctatcttgattgcttgcgacataatctgagtaaaataaagtgcctatcgagttatggagctctttttccctatgctttccgttttgtttgtcgatggatagttgcctttggaccgattcctagcacccggggctcgttggatggacgaagtaacgcaaggtgctaagtattaatcggaagaaatcaaaagcatagagataagataatttattttctggtcttaacaattgcaaaagtatccaagtagtaaattctgatccgtgaaactttgttccattaatgacgaactcatgtcactcatttgcatgtctgggaagtgcctccgccgactcccgatgcgtgggagcaatgactagtcgggcaaagtgtttaaacgtaaggagtcatcggttcggggagatcaaaattgacaagagaagaaatacatatttataaacattttaaaattcttgaattttaaacattttaaaattcttgaatttttctcgagtattatatttacatcagatactactcatcctatatgtttgttctgtaggatccagatccagatatacataaaagggattcatggctttaagcttatctcctacgctctaggaatggatcagtcagaatcaccaccggcttgccgtcgtcgccgccgactggtgtcctcacctatacggttgggtggtcacaccgccattgttgggcgtcgttgtcttcactgaccggccgctgactggtgtcttcgcctatacggttggttggtcacaccactgttgttgagcgtctacttcttcaccgccggcttgccttctccatcgccgactagtgtctctgcctacagggctggcctattatgccgccgttgttgggcgtccacgccttcaccgaccggccgcctcgtccgtcgccgactggtgttttcgcctatacgattggttggtcacaccaccgttattaagcgtctacgtcttcaccactggcttgccttcgccgccgccgactggtgtcttcgcctgcacggctggcctattatgccgccgttgttgggtgtctacgtcttcaccaccggtttgccttcgccaccgccggctggtgtgctcgccttcacggttggttggtcacaccactgttgttgggtgtctatgtcttcaccattggcttgcctttgtcgccaccgactggcgtctctgcctgcacgcctggcctatcatgccaccgttgttggacgtttacatcttcaccgaccggccgcctcgtatgatgccaactggtgctatcgtcttcacggctggccacgtcgccgccaccgctaataggcgtgatcatcttcaacacaagctatctatttcttctgccgacgagtttcttcacttaaatggctgcatgattctgccagtgttgattggccttatcgtcttcaccgccggtcgtctcatctgctgctgactagtgccctcgcctctacggctggtttataccgctaccataactgatggacgtcatcgtcttctttgctggccgccttatctgacgccgactagcttgttcgcctccacggttgcacgtcttcgtcaccattgactagcgtcatcgtcatcgccggtttgccttcgccgccgcccatggtgtcttccctttcatggctggcctattttgccgccattcaaggacgtcttcgttttcgtcatcattctacttcttccatcgccgactggttatgccgccgtcgactggtgtttttatcttcacaactacgcgtcttcactaccggtttgcttatcttaccgccgacttgtattcacttcatcacggctatgcaactttgtcaccatggtggagcgacttcatctttattatcttcggcaccggcaaactctattgcctctacttcgcaagctttgctacttcaccatccacgacatctacaggagcttcgacatcttggcatgcatcaccaaatatgatgccgtgttattttattacaacaagtggtgttttaatcttcaatatttctactcggacatcttcaacatgcatcttcactcaagcaatgactactcgacgacaagaagctacagttctcgactctatgttcagttgtttcccaactaatcaaagagtcgggggctacacaaatacaagactttcaaaattcgacaaattttatgtcaagacaaaacaatcgactaatcagccaacgagttctatgcaatctacttcgggaatcaaaagttttgctccagagcaggctttccacttcagcaactccaattatttcactggcaattttggcttctccaaagtttctcaagtatcaagtccaagatttaatctacatgacctgtcagggagtttggagttatcgaccaatcagctcagtttcaacgagttggacaacagtttctactttcttccaagtgaagcatctgcaatagctacaacactaatttttactgctacctttataaatcaagaggcgttgcatcaatcttcgtcacgcacatgccaacattaagaaaatacttgagcatggttttcttctcaacagtttgatggattattatcactgacatcatcatcagcacctctacttcatcggccctggcgtcttgctaaggggtgactacgtcctcgtcgtcggttgcttttatcatcatagactttcatcgccgacttgttatttcgtcttcatggttggcctactatgcaactgtcgatgggacacctcattgttatcattgactgctacactactattcactggatcaacgatatcatcaacttcatcaacatcctaccttgcctctttgcctatgcctactctgctactgttgatggtcaacttcgtcatcatagctggctatctttattgctgccaatggtcattatcgccgattgcatttgccatcgccaattgttttcttcttttgcatgattgatggatttcgctattgctattgatgagcgtctacgtcttcaccaccggcttgcgtccaccgccgcccatggtttcttcgctttca

SEQ ID NO: 35260 - DNA, 6164 bp, Oryza sativa
gggcgcctcgtctgttatcgactgattatttcgctgccatggctgcacaactctatcgccgttgctgggcgccttcgtcttcactactggctgacatgactgctgccaactagtttcttcgcctccatggctatgtgacttcatcacctttgattggtgtcattatctttaccaccaccatcatctttgtcagctttgatgggtgatatcatgttcatgttggtcatttcgtctccatactgactgcgtcaactaccatcaatggacaattgtgactacaacagaagaataagctacatgcttaggggcgatcaacacaagcgcgaggattatatcttcaatttggacttgttccagatacattcaacatggattcatggtcatgagtcgatttctcatgctcaaacgactggacaattcattattccccacgagggacatcagctgagtgtttgcgccagtcgggattcaattatcacatctactttggtattctttatgagggataattacgcttgatctacatcatgcatgatattcatcacttggagtcatattaattggtgtgttctatacgtcatattttaagggtatcggtatacataatttaggtctaggcctaatacgtctgcagctcatattttcaggtgtggcctgtcacgttcttttagggacttaggcatttttttttgcttaggcaaaggtgcgggagattaagtgcccaataccttaaaatccttttataccgcagttactcaactttttaggagttggtacaatgcattttaaaaggtgtcgaacagtgaagctttatatagctgccccgttgactttttattagtcaaggcactgtttggttttataaagcaattgattggatacaatatcgttgttttttttgccatgtaagtgtgcatttttattgaccaatattatggcttaggctgattatatattatggtacgtcattttccaggcggttggtaaatcctttatgagtttatttagtcggatttttcatcacatgtgccatacatttccagtggtaaaaccatgtgtcttttaagttcttaagtacatctgttaaagcagtgtgcgcatggtgtgtgtgcccgatactctggaaatttctttattcacaacatacaagcttctttatagctgttctgctatttgaatcttcaatgatgaagtcaactttaggttgcacgcatcatattttacaaagcagtcggtatatcacttggatcatgttattcggagattcacactgcatatgctatatattaatatcaagccacttggttgactataattatcaaaaaccactcagttggttgcattatttactccttgactatatgttcagtttgttcaactaaccacataatcgggggctacacctattaggtgcatctagtcgatgcacctaagattacatttaattatttctcagccctccacagtcttcagatttgataaaagtactcgggagatcttggcaaagatgattgaagcactcggctttggagtaatctagtttgagagaagattattttttcgactgtaaaggtctcaggggctactgtggagattatgggtaccccgtacacatacgacatggttatccgactggttataggggataacttatatctatgaaatatgtaacggatcatggtttgggtattacgtttccttgtatattatggaacggtctaaagtcctgatttgataatattgtaaagtagatttaggaaaccgatactgtattggttaaggtttctatcttgtaatcctgcccccatcttatataaggtgagcagaaggccctctagagggcatgtgacacaaccagatcgtcagatcaatatacacccggcggattcaaatcctccaacaagagtaggatattacctctcatcaagagagcctgaatctgtctaaaaccttgtctccgtatctatccacttttaggtctcgtgcgctattctcttttattatttgccgaattcttgtttcgacagaggtagtaattattaacctccataaaacttaaccgactcaatgcatgacaattatctataaatatttaagcagtacgttgtttgtggttgagaaaaattcacacacacacacatacggtatagataatataaactttcctgcgttggccgaggttcataatggacgaaaaaatcaccccacacggagggcttgaaactgggagcctgggcagcagccggggcagatgacggtgctgcatgacaagacaccacacgcttgctgctgctgcgatgcttaatgcacgcgatgttgttatttccagctgccgcggtagtgctggtggtgttcatccgcacgcaggcagatgcaggcggcggtggctgcgaaatggtgaaagcacacgctaagcggtgagccataatatcggtcgagtatatgatctagatagctctgctaattaatgcttatagcaagttaagttaaccaccctgccacccagcctatatatatagagcaattaatggacatactacttctgctagctagctagctatgcaaggataatactccctctccgtcccatttgaagtagttttcgtatctaattttaatcgtttgtattatttaaaattgttttaaaaaaatgagacactttaagtcacacataaagtaatattcatgttttatgatctaataataataaaagtattaatcataaaatagtttaaaataagacgggcgatcaaagttgacatcgaaacttatgactgcgcttaaaatttgacgaagggagtgattagaatatgttgcccaatttagttaattcggcatagaaacattaatttttgtggtctcaagccggttacgtacgttacgtctcattttttttgtggggtttgaaattaaattctagtcgtaattagcacatagtacttaacctgcagtacgattgcatgcattttacacaactttcctttgtttttctcttcacgtgtttgattttttagcggtcgtacgctgccgtaagttagccctgcaactgcaaacatgcgatgaaccaccaaatcgcagcatgcgtgccaaacctttcgaagttatccaattattgatctttctagtacagcatttggtcagtgatcattgatctggttttacttcagcagagataatttgcgaggacagatagaaaacgtgttaataaacaaatggcaagatatatacaaacacagcacgacaagagtttgtaattggcgtacgtacgtacgttgttgaaccggcaccactgcagaaaccacctttgtcggtgtcggccaaatcccacgatagccccgattttttaataaaccaggacgactaaaaagcacttttattcccggtttataagtgcaacggaactatatgatatttagtcgcggttcacctcatgtcagaggatattaggccgcctgggatctttagtcctggttagtattaccaaccgacactgaatgtacgttggcacaccgactcagcctcccatccgcagtggcacggcatttagcgccagttgacgtggtgttaaggtgtctaagtttagcgccatacgatttgaccctgaacaaaagggtcatttctgaaataagttttggccatggttcgtttgtaaaattattttttgcaaagggtcaaatcatcaaaatttgtgtagaaccggcaccttttaggtttgccgaataaaaaaaaaagccggctcgatgcgtcagctcgatcgagccgagcagtccctccaaccacatccgcaagaaaagaatgaacacatcacacaatcacaaaatttggcaacattcatgcatcacacaatcaaatattcatcaacaagtttacatcactgaatcaaacatcaaacatcattggatcatcaaatcaaacatcaacaatgaaggagacgattgggggtgctcacctgtggcagaagagacaagggagcccgtggggagcccgatgtcgtcgttgccgctgcctgccccctaccggatctggtggcggagagggctccgctgccgccgctgcctcccctcccgccggatatagcggaggggaggttgccgccgccgcggcccgtgagccacgccacttactactgctgcccctcctgccgccgagccgtcaccgactccactcctggccagatctagcggagcggaggcgctacctcccctcccgctggatctattggaggggagggcgtcgccgccgccttccctctggcggccgggccgccgcgggctcccctccagcagccgggccgcagtgggctcccctccagcagtcgggccgccgcgggctcccctccagctccccgctgccacttcccctccagccgccgccgtcagccctctcaccggatctagcggagggaaaggcgcggtcgccgctgccgcctccgccggccagcagctggcagcgctcgggagagaagggagggagagagagagaagatcgtcatggtggggcccatcggtcggctcatccgatgctggctcggctcgatttctacaggtgtcggtgttttaaaaaaaaaacggcacctataatatattataggtgtcggtttttaattaaccggcacctataatatactataggtgtcgtttttaaaaaaccaacacaaaatataataggtgtcagtttttatttagaaccgacacctatacttagttaaaggagccggttttttacgatttcaacccgcaaaggtgggaaaaggcctataggtgccggttttagcactaccggcacctatagtggcaacacctatttgatattttgtagtagtgtgtcacgtctagaaattcatgaaccagaatttttaagctaaatgtgcattaaaacccctttccaggaccaaccagggtacacaaacgataatttttgacgtacagatccacgacttacaaaaatataaaagattataaatgcagcggaaaagataaaggcgagataaacttgaaagcttgactcctgcaacgggtcgactccactctacaggcaatccttgacggcagtgacgataccaacttctctgagaaggctccaactgagaaggactctagctctggtgtggggaagagagagcaagactgagtactacccactgtactcagcaagtcataccgggagagaaggcacgatgcaagatatatccaaagaaggctaaaggctcatttgcataaagcaggcatttaaaagcagtagttgaaagcagtaaaactgttgtagtaaattaagcaatactgatcatcacagtccaacactacaccacattgcaacaggcccaaccaaccacctgaactacaccagtccattaagccaattattaaggatgagactagtcacggtgaatctggttgatcgcccataaccgcgggcacggctattcgaatagttttactctggccagaggtgtacaactgtacccataagacatgattccacacatgtcgtcatgccccaaagtaccaccatggcactgcaaatggtggaatcatgacaagaccctttgcataaccctcctctaaccatccacacccgctaaggtttcacctttttttaggtttcacccccacccctcacaggcagtgggcagccccctcgtgcgccgcggtgaacccagcagttggacaaccggacacccagccgacctaactccatcatgccctcccttgccaccggtgcctaggaaagggtcgagctatattacaagtcaaacagttacccactcccgcttatggtaataagcacgataagtctcctagggtttcccgtgaaccggtccttaattgccatgggtgcgaccagcaaagccatgcatccacagcccaccattcaatcgcattttaattggataattacggccaatgaaacatggccggatgtctcgagcacgcagctcgtcatgaagctaaatgtctaataatataattatctaattatgtgagctagtggatctaagcatggctaagcattttctaaaccaacatcttatccgattaatacccaaattatcaatggcataaggtgaacaacatatggctgagtaataggacccatcccatatgatattgtaaaataatataacatttaatagaaaacggaacatttgtaaattgagtacatca

SEQ ID NO: 35261 - DNA, 4839 bp, Oryza sativa
  unsure (1)..(4839): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagttatctgagggcccgatcaaatccaatattgatcgacttgaagctcgcaagattgaactcttggcacaacttcaagaatgcaacaccgagctggacatggaacataaaaagctagccgatctcccacaagctgtcgaagaacagaaggcaagactaaaatcggctatcaagaatgtcgcggatatgaccaagtccctaaaagtcatccctggaaccgatgctcaagatgcccaagccatcgaagaagtagaacaaattaggcaaagagctatatcggctatccaacgatacttgtctcagtgacattctgtaataaggcttagcacattttgtaatcggctaagatgattctgtaactagtcttgacaaaccttgtgccgattaatataactccatgctttttgcttaaaaattttccaaatttgcaacttgtgaatatatgtgccccctacttttgcaatgacaaaggcattgataaaattaaaaaattgaactaagagcgatataccaatatcggccattgtacatcggcaaaatacaaccgattacagtttaaaaacaactaagggcgatataataatatcggccatctcaaggcgatgcgaatacatgagacgatggattacactagctgtgatggcgaggttagttgttaggtattcttgaattatgaatagaagaagcgccgtccttgtttttgagtatattgtcctttgtccttgcatcatatatgggtgttcgcttagatgatgcaagcatgtcggctagaccgcccgtctatttgtcttcagaatcccaacttatcattgtattgaattttgtaattcagattgtttttgtccgtccttgaatccagagcgcagccaccatcacccggagcgtggtaatttggcacaccgccacccgcgctcagcggcgcgccagcgccccgtagcagcgggcgacagctaggggcatcgagcagcgggcgacgggccgacggctagggtggctaggggcgacggctgggggcaccggttggggcagctacgggcgacagctagggcggctgcaggcgatggctaggggcgccggcggtgggctgcgtcagggcggcgaccgacatcgaggcggcgactggcgacttggcgagatggcgattttttttcgatctggatgcggtgcggcgcaatgaggggagacggagggggaagagaacggcgatttagagttaagggagaaaatcacgtcaaacttttttttggccgaaatatttgaccggacctcacttacaatcggaacccaccgaaatgtccaaaatttccaaaatttacaacccagtggtggggaacttggcgaatgagaaggctggcccaaatgccgaccccaacgattctgagacctgcaggacaatccaacagctcaaaaataaacgatgtgtaagttttgtagtaaataattgctgtagtgggtcgatatattctttttatggaaacgcatgcacagtagaggaaaagtattttctgagttcacgcgtcccaagccagatatccaatcaaggctttcatcgctagtcatctatatcagtcagtcaacattggcagatatccaactccgcgtccgtccagctctgcttcctacacaacccccttcaggactctctccccgtcagtcaaaacatggctgccctgctgcagctggccatgtccgtggccgctgttccccacctcccggaggaggagaccacgccaagcgtggacgtggaaatcgcctccccagatcagcagcatctagctgctgctgctgcaccgtcgatggccgtatttcctccggcggccgacgaggaggaggaggaggaggcggtggcggtgttgctgtccggtgagttcttcacgtgctggtcttcgctgtcggagtcgacggatgatgagacgacgaggaggacgaccaccgagtccatgttctacatcccgacgaacgggagtaatgatgttgggaggaggaggaggaaggtccggtcctggagtcgggggagcttcctgggacgtggatcctttgggatggtgttcgaggggatcaccaagtaagtaacaagtcctactcatctaattagaagtaactttggatccatcatttctattccctccatttcatctgtttactttctgctatgatgctaccatctatttctactgccatcttagttgacagtagtagaaacgtaaagagatgtaactgtcaaaaaaaaaaaaaaaaggcattgagaggtaaaatcgtcatttagcatgaactaaatctagcagttataaagctaagtgaaatgctcttcctctcaattactgtcctggggatcagtttataatttaacctcgttattaaatatcattcctcggtatcattaacgtgtttggattttctataatgtttttttcttgtttggtttcaatggtgatttcggggctaattttctaacagatactccgtggagcgagatgctcagatctgagcgagcgatttttttcatagctttttaccattcataaggatataccaccaattgctagctaccaagaggtaaaaaaaaaatctaacagttgattaggcaaggcataggtacgatggggctaacatttttcctgttccatctcagcgccacgattcgccactgactccactcagtggcaccacctactcacctagtgcctcgctgtaattccccatcatccctccccttttcgtgagcgcatacataaattcgtcttcccaatggatcgatcagagtctgcagtgtcctgaattcgttattggtgccgctagaagcttgtttcgttggatatggaatacataactattggggagcaagaagagcatgccgatgttgggcattgacatcgtccaactccagcatcggtggcgtccacgctgtcacggaggcgatgacctggggatttcaatgggtatcggcgtcaatggtggccgtccggatccgcgtctcggaatctatccatagcggggcttttgatttcaccgagcacgtgaacgatttaggcagctaccggtagggcatcagcaccaaatgcagtgacaagctagtattaggccagatttgaggcgtcctaactaattttcgatttacagcggtgtcgatgtgtgcctaatcccgccacggataaaccgatagaagccagagtgtatatgtgaaagtgtagttttaccctacaactaacacacgaaggcacgagacatttgcttagctctcgtacagttatactgcaggtcctatcaatcggatttagagtgtgccacttagttatcatgtaactaacgaaaatacatagaacagtgaattaatcaaataacttaaataatcaaataccgatagagttagggtcattggctacttgaccaatggaatagtgaattaatcaaataacgtaactaaaatgcatagccatcgactggtacggaaactgaacataaccaatcatgaataactctttatttaaaacaaccttgatagttgggaccaaaccatttttttttggaaggcactgtaggggaagcccccacagttaaatagctttattatagaaaataaattacaaaagatataaccaattcaaaagggactatctctcagaaacatttagtctaaaaactaaaagggaaagatcactcttaaagagagctttccaagaagaaattgagggtgctaaattctagaaaatcagggagttcctctgtttccaaatattccaggctgcataaaagaattttcaccataaagtgcgtagacttataagaattcattgtctgatgcagcatatctatgaaggcaagagaaatatcccagacaattccaaactatgtccagcaatcagcactaaaaggacattaaaaaaatagatgaaaggtggtttctcttgcacaggtggagcaaaggacacaagttagatccgaattattgggagggcaatgccttctgttaagcatgtcataagtattgagtcgatcaattaacaggagccatccaaaaactttaaccttcatagcacacttactcttccagatccaagctagataactaggcgcatgtatatgcatgaaattaatgtcatatattttcttggaagagaacaaaccatttccccaaacataagaccagacatcattctcatcagataattgatctaaaggatcagctgcagacattgtatcatactcatggaaggcttgctcagacagagggagattaaaacgctgcgaaatactcttggaagaggttaaactcactgaatccttcaaagaaacagcataagagtgaatccttgggtacattactgacctgactttattattccagaaatcatcccaaaacagacaagtctttccatccccaaccttacaggtggacaatcccctaaaaatgtctgcaaattgtagaacatctttccaccaaaaagaccctctagggcgatcagcatgaggaactttattaata

SEQ ID NO: 35262 - DNA, 27598 bp, Oryza sativa
  unsure (1)..(27598): unsure at all n locations
ccctatcaactaagggggcaaaatcaattatctttggcctagttgttcccaaaggcagacctaaataggtgaagggtaaagtgcccactgagcaaccaaacatcttggacaaatgctgcaccttttctatatccacattcagaggaatcatccatgacttactgtagttaatcttcaaaccggtagaatctgcataagagttgagaataaccttcaaacagaaaagctcttttgaggaagctgtcaagaaaaggagagtatcgtctgcatactgtacaactggaaagccattatcaggagttgggattggaatagtcaaaacaccctgagaataagctttgttgacaacagactgtagtaaatcagcacctagcacaaataaaagaggtgataatggatccccttgccttacaccccttttgcaataaaaattccttccaagaaccccatttagaagaactgaagaagatgctgaagaaaagatcaaatcaatccaattcaaccactttgaatcaaaacctttttgtctcatgatgtccaaaatagtagagtgctctatagtataaaaagctttctcaaagtccaacttcaacagcactatctccctttttgattgttggcacttgtgtaagtactcaaaagaccaagagagacaatcctgtattgtcctggctttgatgaaaccatattggttttgatggatgagttctgtaattacagactgaagcctatcagcaagaacctttgttaaaagcttgagagccacactttggagagaaatcggtctgtattcattaaccctctcaggtgttgattttttgggaacaagagtaatgaaagatctatttaaactttccaaagctaagttaccttcacaaaactgggaccaaaccattgaaactaacaaaggatgacttagaccctgtttgattcaacttaggattattataatctggattattaggagtaagctgaaacaaacaaatagattatcatgctagattatcataatctataagccagattagtataatctaataatctcctctgaatgagctttttccagattattgagtggctaaagacccactacccttaatgcctctaataatccagagaaacaaacaactcgcagcttattctatgtcagcttattataattcagcttagagtaatctgatttaataatctagattacaataatcttaagctgaaacaaacagggcctagttactgattttaccgatgtgaacataagacggtgccatacttttcaagactataaaaaatgactcattggctagaattaaactccgatgaaacgttgtataaaacatatcggctttcaagaattaaacatatctagccgatagatcggtcctaaatgtgtcagggttacgggttaggtataccctttaccctttgacgtacgtcgcataccgatgtagtatacccacacgtagacggatactctccgcgtatattaaggaaacccctcacggagtttacaaatggaaagagtcctactcggacaagactgggtcatcaatgtatcgggtaaggtttgatgtttccgagttctacttggaaaccgcctaacctgtgatataaaagggaccccccgggaggacctaaggcattgaatctcagagccaacacaacccacacagcctacgaagtcggagcctgcaaggagccaaatcgccagggatcgtagtcgagccaactcgaccacgatctcgccggattcgtcaagttccactgttccctttgtaacctgtgttttccatcatataatcccacatcaactggattagggctattacctataaaggggcctgaaccagtataatctttgtcttttgtctgcttgatgtcgtattacgtagatccttgtaccaacgtaccccaataccctctatatccggtttacgggtatcacccgtcgacagtggcatgccaggtaggggcacttggtactcaaggttctactactatgtcatccagcctcgtcaacaacagcgtcaacaccaacctcagccaagtattccctgcttcaacgatgctagtgtggactcaagtcggcgaaatcgtcttcccggtttacaccacaatgccgatctcaacctgtccactaatgactggaaacgagaacgcagtggctacaaaccgagacgactccatgtcgaaagatactcccaccgaggcgaagaacggaatatcgacgacatccgagctcgagaaggattctaatgcggccaaaccttgtcgttccgacatgaaccgcgagccgacgaagatgacttccgaagcaacaaggtcctggtgtcctatccacaaaaccagcaaacacactttgcaaacctgctgggttttcctcaacgtccgcgctgaaattcgtatctgcaaagagcgtggaattcagcgtatttctccaactcgtgatgtctattgtcctattcacaagacaaagaatcacgacctctcaagctgcaaggtccttctcagcgccatgaaagcgccacctcctaaggtccaacagtcacacatccccatcagggataaagacaaggaacgaggagcgacgccaacttcagatcgatttgttggggtaatcgatatcgatcctcacgaaccatcagtcttgcaccttctcgaagactatggatcatcgacaacgagcgcactgcgggaggtattggctatcgatgatgtcggcacatcagcgcgcaccaatgcagaagcagagaatcaattggccaccccggcccagcacatcagagccgtcaacgctatactgagggaaaccccctacgatcctgttctgaacgacgatctcgctcgttggacagcacgactacgggaatcagtgactaacctcagcaacacgttcgaagaggccgccgccgcagcgcacccggagcagccaccaactggcgatgccaatggtgaagagcctgaatggagggaatcgcctcattgagccacccctccaccttgcggcactagcgatctccgagatcacgtcaacggccgccgagaggcacgacgcacacgagacaatgaaaatcgttcccggcgtcatgtctcttcacggcgccataatgacgaagatcgaggagaccgctcaaacgaagaccgaggccgtgataaccgccacaaccgccacgatcacaacgatcgcgaacggcgggtgccagacgatactggttgaggacgtcgccataacgacgacgatgatggagactggcgccgggacaacagcgggagacgacgacaggattctcgagatccaggccgacatcctcgtgatcgtacgccggaaccaagcgacccatcgtcatcgtcatcatcctcggcttcctcatcatcagacagacatccacgaaggacacacaatcgccggcaacccaccgccccagcgctgggtgtagggctttcagtcgttccctgcgtgatgtctgatggcctgagagattccgacccggagcaatagaaaagtacgatgggagcaccgactcagaagagttccttcaagtctacttcacagtactctacgctgccggagcagacgacaacgcattggcgaattatttgccaactgcgttaaaaggctctgcacgttcatggctgatgcatcttctgccctactcaatctcttcgtgggcagacctgtggcaacagttcgtcgccaacttccaaggaacctacaagcgccacgcgatcgaagacgacctacacgcgttgacacagaactcgggtgaatccttgagggaatatgttcggcgcttcaacgagtgcagaaatacaatccccgaaatcaccgacgcttctgtaattcacgccttcaaatccggtgtcagagattgctatactacctaggagttggcgacaagacgcatcacaaccactcgatgattgttcgagattgttgagcgatgcgcccacgcagatgatgcgctaagatgcaagaatgataagccgaagaccgggggagagaagaaaccagccacggacgcacctgagtcaagcaagaagaaaaatcgcaaaactgggaaaaggaaatctcaagcggaagtcctcgcagcagaatacgcgaaccctcccaagcgcccagacccacaaagtggtgacacaaagaaagcatggtgccccatacacaagacggacagacactgtctggaagattgccttgttttcaaaaaaatcgctcgagaagcacattgcatctgaaaaaggcaaacgagtatgcgtggtcgaaaaggatgcggaggcggctccccaggaatcggatttagcatatccagactctgacctccacgttttacacatcttcggaggttccacaacgtactcctctaagcgagagtacaagaaagtggaacgcgaagtctgtttgtcatgaccggaaataacccaacgggcgttccttatgtgcgtgtattattccttgtcccaggaggcaaggtacaccaaaagttgatatatttcaaagtttatcaagcggaagcgtaaatagttaatttattacatgggcggcgaaggcctagcacacaggaagacaaataaaaaacagcggaagactagggcgacgaccacaggcgcttgacagcaggcacgagctagacaccaaagccttcatcttctaggaactcctcttctgggtttggaaaaaattgagcaagactgagtacaaccaccgtactcaacaagacacacccacaagtgcagaataaatgcaagggagtacaagggagttataatataaggggttagggtttgcagtaaacagcattaaaagacacttagttgctcaaagctattttgtaaatacgatcctagagctatacaagattattaatcaaggccgtgaacccacacgaacctgccttaacccaaggcctacgatgatttagaccgaattggcaacctgaccctaggtcccagctcgtcccaagccaacccaggccaaccattccacattttagttgttaagcagattttaagaattaaaacactaacttgggtacattgctcggcttgctcaaaaccgagggcgcggctattcgaataggttatactctgatcagaggtgtacatctttacccacaagacacatcttcctcacgtgtaaccacatgccacataccaccacggtatatggacggaagacgtgacatagtttccaacccatcctagccatagacaagagtaccaacccaaccccacctacggccggaacctctgggacaggtaggcaggactgagcccctagcagcaggacaccagccctgtgccatgacatctcgactaccgagccgcagctcgtgtagccttcatttgccctagagatgtccatcgacccccgacttcgtccatctccatctgtgtacttttgtttataaccagactgagcctcaaactaagccttacccactagacatgtggaagtacggtagtgctttgcaatagaggcccgaagaccggtccttatgtggccgaggtgctactatcaaaaccatgcaccccgagcccagcctaaaaccattttgaggattttgaatagagggggaggtgtgaatccaattccaccataatccaaccattccatagtgtccaggtgatatgaatattcccaaagtctagagttgtaaaaccacctaatgttgcctaattaaccaacgaagcatctacctaaattcatactagtggtgccatgaatagagtatacactagttggggttttatttattctagggtgaacaaggtaataataacaatagcaataataaggtcataacaaaggtaaataggcatggctaaataaaacagtgataacgcgggaatttaaataaagcgataatgcattaatttaaatcaaaataattttataaactgggattcaatatattcaaggatgatgtgacttgccttgctggctttcccaaacgtcggcttcaacctccacgtagagcggatctttcgaagctgcagcgtctacacgaccaacggaaaagaaaagggcttttacgctaataaactccacataacaagcaggaataaagcacaaaaatgggttcttgatttcttaaggaaaaattagagacttgaatggtccaattccgagttcaaatggtcaagttatggccatttgaagtttaaatgctctttaaatgaatatttacgaatttcttcatttaaattttaatttaaaagggatttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacctgagggcgcggtcggtgagaggtggcgcacccgcgcccctatggtcgccgatggtggccatggcacggcggagaggcggccgagagaggggaagggaagggggaaacgaggcggcggtccgcggctcaccccgaggcaacggcggctacgggggaggcggccggagcggagggaggcggtggcgcggctcgggtcgacggggacggcggcgctccggcggtcggcgaccgaaacggagaggtggacgaggtcggcaaggatgcggcgaagccgaaggaggcggcgccgaggtgggaggcggtccggggcgacgacggcggagagagagagcgacgtcgcgagctcgaatccagcgaggaggaagggtggcgagaggcggaaacggacggtagaagcgcggggagggtttaaatagggccggggcgagagagggcggccggaggggaaggaaaccagcgcggcgttctcgggctccatcaatggcgccggcagtattagggaggggttttcaaacttatccaaggagagagggagggaaaattggggggaaagggagagggaatcgggggaaacatttccccccactttaatgcacgcagggacgcggatgcggcggatttggcggcggtggcggcgcttggcgcgggcggggcggcgggagcggcgggaggacgggaatacgcggtgggcnccacccgtcagcgagggtggtgggcgggcccgcacgtcagcggcgcgcgcgcgggtagactctggatggcccgcgggcagacaagggagagagggagggaaatgggccgaaccggcccaagagagggaggggactttttttagggtttttctttttataaaacctttttaactttgtttatttcttaacaattattatttgtgctctgaaaattccactaaaatttatttacacattttagccttttaggaaatatacaaaaatcctctaagccttatttggtcttttactttgcacatttttatttttggaggctttcacacggattttaattattctaggcataatttaaaggatatattttagggtctttttgggacgcgacaaacctacccccttaaacggaatctcgaccccgagattcagaagaactggcgaagagatcgggatgggctgccttcagctcgtcttcacgctcccaagtagcttcttcctcggcgtggttgctccattggaccttgtaaaaacggattacccgattcctggtcctgcgctccatggtgtccaggattttcacaggtctctctacgtaggtcaagtcttcgcgaacttcaatctgctctgagtcggcctgctcggacggcactcgaagacatttcttgagttgcgacaaatggaacacatcatgcacgttgcccaaggaggcgggcagctccaactggtaagcaacttctccgcgtcgagcaatgatgcggaaaggacccacgaaccgaggtgcaagcttccctttcgtctggaacctgtgtacacctcgcaatggcgtgacccgaaggtacacaaaattgtccactgcgaattctaggttgcggcgtcggttgtctgcataacttttctgccgagactgtgccacctttagattctcctgaatggttctgactttaacttcagcttctctcaggatatcggtcccgaacacttggctttccccaacttggtcccacaatagcggtgtctggcatttgcggccatacaacgcttcatagggtgccatttgtatgctggcttggtagctgttattgtaggagaactcggcataggggagactcttatcccaggtcttcccaaaatttaggacacatgcgcgaagtatatcttcgaggatctggttcagacgctcggtctgcccatctgtctgtgggtgatacgcggtgctgaaatttaatcgggtacccaactcttcttggagtttcttccagaaatgagaggtgaactggcttccccgatcagatacaatttacttaggaacgccatggagactcacgatcctagcgaagtaaagttcggctagtttgttccctccataggtggtcttcacaggaataaaccgagctaccttggttagtcggtccacgactacccatatagaatcatatccgccttgggtttttggaagtccggtgatgaaatccatcccaatttcatcccatttccattctggtacttggagaggttggagaagtctggccggtcgttggtgctctgccttgacatgctggcacacatcacaaagggccacgaactctgcaatttcccgcttcatactaatccaccaatatttctctttcaagtccaagtatatcttcgtgctgccaggatggatggaataggagctttcgtgagcttcctgaagtatcaactgtttaagttcccagtcgtctggaacgcataccctatttccgttccatagggttccgtgttcatcctctgtgaaaccagcggctttaccctgtttcatattcttgaggagtccatacatatccggatcattcttctgagcctcgcggatttgatcgagcaaggtaggcttggcttccagcgtagccaagaatccacgaccaactatgcttaggttcagggcttccatctgttgattaagttccggtggaatgccacggacgccaagagtgttgcaatggctttttcgacttaaagggtcggcgaccacgttggccttgccaggatgatagtgaattctcacatcataatccttgatgagttctaaccatcttctctgccgaagattcagatccgactgagtgaagatgtatttcaaactcttatgatcggtatatatttcacagcgattcccaatgagatagtgccgccagatctttagagcatgaaccacagcggctaactccaaatcatgggtaggttagttgccttcatggggccgtagctagcgtgaggcataggctaccacatgaccttcctgcatgagcacgcgccccaatccttggcgcgaagcgtcacagtacaccaggaagtccttgcgagtatccggtaagattaaaactggcgaggaaaccagcttctctttgagagtttggaacgccttctcgcattgcgggctccacacaaatttttcttctttcttcaacaactgtgtcatgggttgagcgattttggagaagttctcgatgaacctccggtagtatcctgccaaacccaaaaagctgcgaacctgagtaactgtcttgggttgcttccaatcagtgacggcggtcactgttttgggatccacagcaactcctttagcagatatcacgtgccctaagaatttgacttcagacaaacagaactcacactttctaagcttggcatacaattgatgttcccgcagctttcccaacactagacggagatgctgctgatggtcttcctctgattgtgagtacaccagaatgtcgtcgatgaagaccacaacaaacttatccaagtattccatgaacactttgttcattaagttcatgaagaaggcaggagcattggtcagaccgaacgacatcaccgtgaattcatacagtccataacgcgtggtgaatgcggtcttcgggatatcttcttcacggatacgcaattggtgatatccggagcgaagatcgattttagaaaagacagtggcacctttaagctgatcgaacagatcatcgatccggggaagagggtacttgtttttgatagtgacttcattgagggctctgtagtcaacacacatcctctttgtcttgtccttcttttccacaaaaatcacgggagcaccctggggggaagtgctcggccgtatgtaccccttttccttcagctcttccaactgcttcttgacttcggccagttcattcgcggccatatggtagggccgcttttacataggagttgttcctggagcaaaatctatccggaactcgatctcccgcttgggcggcataccgggtagttcttccggaaatacgtcaccgaattcactgacgatggggatttttgacagtcctatctgatgaagttctgaactgccgacagaggttgggggtgcaaagaaaacagagcagatcacctttgatgtcgctgaattcgatacagcttacaacgccatcatcgggagaactgcacttgcgaagtttatggccgcatctcactacgcgtatcaagtgctcaagatgtcgggaccgaagggaacaatcactattcaagggaacacaaagctggcggtgcaatgcgacaaacggagcctcgacatggtcgagcaaacgcccagcccacccgacacgactgagccacccaagaaagtgagcaagacaaacaagacgctgaaaccggacggcgcaatcaagatcgttccgctctacagtgccaaccacgacaagaccgttaagatcggggcgatactaagcgagaaaatggaactcgcgctcatcaccttccttcgcgataatgctgacgtgttcgcttggcagccgtccgacatgccaggggtccctagggaggtgattgagtaaaaactgatggtgcgacccgatgccaagccagtaaagcaaagactacggagatttgcaccagaccgaaaacaagccatacgagaagagcttgacaaacttctcaaagctagcttcatcagagaagtacttcatccagagtggctagccaatccagtcatggtgcggaaggccaacggaaaatggagaatgttcgtcgacttcaccgacctcaaacaaggcgtgccccaaggatcacttccctcttgctcgaatagatcaactagtggactcaacagccggctgtgagctgttgagctttctcgatgcttactctggctaccaccaaatcagcatggcaaaagaggacgaagagaagacaacatttatcacgccgtttggggtattttgctatgttaagatgccgttcgaactgataaccgcagggaataccttccagcgcacggtccagggcgcacttagcgatcagctcggcaacaatgtcgaggcatacgtcgacgacatcgttgtcaaaatcaagacatgcgactcattgattgacgatctgcgggaaacgttcgacaacctccgacgatatcaccttatgctcaatcgagagaagtgcacgttcgaagtaccgtcgggcaagctgctcggtttccttgtctctggcagaggaatagaagcaaatcccgagaagatcaaggcaatcgagaacatgaagtcacccacaagactcaaggaagtacagaagctaatcggatgcatggcagcattgagcagattcgtcgctaggatgggagaacgagggcaacctttcttagctctgctaaagaagcaagacaaatttgtatggacacaggaagccgaagaggcattcgttgcactcaagcgctacctatcaaacccccctgtacttgttgccccccaacctaatgaagaattattcctctatattgccgccacgccatattccgttagcaccatcatcgttgtcgagagagagaaagtacaacgaccagtctattacgtcagcgaagctctccatgacgcaaagacaagatatccacaaatccaaaagctgctttacgcggtcatcatgacatcaaggaagctacgccactactttcaagcccacagagtcacagttgtctcctccttccctctcggtgaagtcgtgagaaacaaagacgttgtcggccgcattgcgaaatggatagtcgagctgagccagtttgatgtccactttgcgccacgaacagccatcaaatcccaggtactcgccgacttcgtagctgattggactatgcctgataacaaatcagacaaccaactcgacaacgaaacgtggacaatggcgttcgatggtgcactcaacagctaaggagcaggggcaggatttatcttgacgtctccctccagagatcaattcaagcacgtaatccacctcaacttcagggtgaccaataacacagccgaatacgagggactactcgccaggataagagctgcagccacacttggggtcaagcgactaatcgtgaaaggggcctccgagctagtcgcgaaccaagtgcacaaagattataaatgctctaaccccgagttatccaagtatctcgtagaagtcaggaagctagagaaaaggttcgatgggatagaagtccgacacgtctaccgcaaagacaacatcgagctagatgacctagcacgacgtgcgtccagacaagaaccgctcgagcccggcacttttctggacatcctgacgaagccatcagtaaaagaggttagtggcgaagttagtccggtcaccctcgatattagctcgaaggccacaaaggcagaacgcgccgttgccgacatcgagaccacagacgactggcgcttcccactgatcaaattcatcaacagcgaggagttgcccgaggacgatacagaggccgagaaaataacccgtaaagcaaagatctactgtatggtcggcaacaatctatacaagaaagcgccaaacagggtacttctcaaaagcatctcgtccgacaacggcagacacctcctccttgatatacatgaaggcatttatgggtcacacgccgccggttggacattggtcgggaaagcttttcgacaagggtttttttggccaaccacccttaaatatgcatgcgacatggtccagcgatgtgaagcctgtcaattccacagtaaacacacaaggctatccgcgcaagcgctccagactatccctcttacttggccgttctcgtgctgggggctagatatactcgggccattcccacgaggacagggcggctataggttccaattcgtggcgatcgacaaattcactaaatggatcgaagcagtacccatgggggaaatcaaggctgtcaacgccatcaaattcatcaaggggatattttgcagatacggactacctcaccgcatcataaccgacaacggctcccagttcatcagcgctgatttccaggattactgcatcgggctgggagtcaagatatgcttcgcctcggtctctcaccctcaaagtaacggacaagtcgagagggcaaacggcatagtactacaagggatcaaaacccgcgtctacgacaggctcatgtcacatgacaaaaaatgggtcgaggaactcccatcagtactatgggccgtacgcaccacaccgacaacgtgtaacaaggaaacaaccttcttcctcgtgtacggctccgaggccatgctccccagcgagctatgacatcagagtacacgagtacagaagcactccgacgaggaccaggaggagcagcgaaacgtcgatgtaaatctactcgaggaacatcgcgaacgagttgtcgttcgagcagccagctatcaacaggccctccgccgttaccacgagaagcgcatccgagtatgcatacattcgatcggcgactacgtcctccgacgggttcaaagccaagcagcgcgaaacaaactctcacccaaataggaaggaccttacacgatcacacaagtcttgcggccaggcgcattcaaaattgcagacggcgatggtcacgagttagcaaattcctggaacattaaccaactacgtaaattctatgtatgactcaataccatccgtacctgtaagacaccttacagtatcagtaaagcctattcttaggcccatattacaatcaaagtgttcccgcccgatgatcccttaccctgatgacacctagcgttgaaacctatcctcatgtccctttacgctgtcttgacaaggcctccgaggaacctaaaggatcttcggctggggacgcccagagccgataaggccttgtcagatcctgtagagacgaaagaccatgtaagatctggtcgtgtaagagttctcgccgtgcgtattaaccaagccgtgaaatcggaaattaactttccaacttcatggctgggggctaggatcagagcttattcaaccaaggcaggtcaaaggtccaagagccttatcctccgagaaaattcctccgacgacaaggctgggggctagggagagtgtacgactcaaacgactgactaaagtcgtgaactaagaacacactcttacacacgacatctggagtaagaaagatttgttttgttaaagatagatttcttttctatttcacaaaatatttcttacagtttttacacaaatccaaagctatattacacatttttcctgagatatctaccacagggtacgaagactaccaagaaggccaacgccagtccatagactggaagatcttctccgcgaacggcgccatcgacctcgccaggtggtctatctccgccggagtcctccgagaacgagcaaagccctcacggagatctcgtaggcaagccaacacgtgccctccggcatatcggctcgatcgatgacactcctgcttcaaggcctcgtcgatacgcttgccgacgccatcaagttgagcacaggctccgttcagccatgagatgtatccagctgctgactcctcgggatctccatggggtactcgaagttctctacaaaccctggccatggatgtgcagcaactcttcaagtacgagttgaaccacacctcaccacctcggagcgtttccacagcctgctctttcttcactgcaagcatggttctctcaagatccgctacttcaaattttgtcttccaatattggatacgacgatcttggccaccaagagcactctcgagatctgctcagtgtgggaacaactaagtcaagctacacgcctctttcaagaacagagctgatctagtcggaggagcagaaagggatgaatggactactaacctaaggaagtcgtcaccatctctggccccgtagcaagggtctggtctacattgtcgggcgacgcatgtggttcaaactcgggctgcccgcgttgctggacatcctcgtcatcaacatctctacaagggacaaaagttttcaagatcaacatacaagagtgaactagttttcaagatcaacatacaagagtgaactagcataacagctgcacacacaaaggcggttaaaatccaggtttacacagcatgtctagggattacaagaggtcctactcttcaaaaagggggagaacagattcccccagatcaccgacttcttccatcacggccaatgccgcgagcactagcctcgaggaggcgccccatttcgacctggagatcctcccaggtgaggacggcagccagtggaccacgaccagctgcgggatcgctgactgggccgcttggtgtcacctcgcggctcccaggcgcaagcacgacatccgtcgaggctgcagcgggagacgcgccggaagtccctccggactcgtcttgcaccgccttcgcccgcgccgccctgtgagacagctatggttcagacaacactcgaacaaaatcacgaagacttaagttcatctacttacttctcgccaactgtcacaagacgttgtcgccgtggaggcaggggagacgcgtccgaggcctgaaaaacggttgatgcgaagtaaggcgaaattcttctagctgcatgatctgacgacaggatagcttatcgagggggttgatgccttgcgacgatgtccgcttacagagaacttcctcccctttctcagaacattgccaccacttgtggtagcagcggcagcatcagacgcctccttggcgaccttctctttcagtgacgccgccacctgatggtccgcgagcggcccgatgatgttagtcagaggaagagcctacgcttaatcaagtcataaagtgatctcaaaaggaaaacgcaggatgcctatcgagaacacttacattgatggcagcatcacgttcagccgcccgcttttcacaaaggggaacggggatgttactcgctgttgtcgggctgctgatcatcacctggccgacacgacgtcccacggtttcgctgttcagacctgtgaatcgagaaccaaattttgataaatcaggaggaacgtggacatgagcatgtcaggataaatgcgagaaagataccctgaggagaaacccgggtcgcgtcctccggtccggaatagtcaaaggctggatggactcgagcctggagcggctggatccgtcttctaacgaagtctgcagtgacttcatacctcgacaagcctcgtactcggagatcatcgacaatgtcgatgaacgattggagagaaggagtcaaagggggctttgcagtccaagacgggattttgtccggttgttccgtaggaacaatgaagacagggtccgaatctttgatctgaaggtagaaccacctcgtccgccatttgctgcgagaagaagggcactggaaggggatataacgcgacttcaggccatcccgaagtcggaacccgacgcatccagacaccctgttgggctccatccaacgcagctcatagtaaaagcgaaagagatcaagaaagggctctaccccaatgtaggcctcacagagatgagaaaagatgctaagaaaggcgatggaattggggttcaggtggagcagagaaagaccgtagaagttcagaaccaagagaagaaattcggaaggcggagggataaaatcacagagaatgtagtcttcgatcacaaccatgcgacctaagacaggctggggattagtacctcctgcttccctttccatggtcccacgaccgggaagggcgccatcttcctaaagcttcttcagcgacgcgctggtggaggatgatttgccaagatccatcgtcgatcggagatcaccggagaaggggctaaggccgacgaactagggtttcttgtgggagtggagaagacgaagagcgcttgcaggctggatgttttctacacgatgggcggactttggatcctcaaaattcctttaaatagacacactaccgacggtgcgaattccaaggaaaggagagagatgctcgccggaaatttctgggtcctttacgcgcggcagttttttggacttcagtttaaattcgctcatgaccgttgggcttcaaacggtgttctcgactacgtcctgtctctacggtcctcgcatcgggaacgacaacagtctcgacacaagaagccgtgaatggttacacgagcttatttaagcagaagtcgggggctactgttagggttacgggttaggtataccctttaccctttgacgtacgtcgcatacctatgtagtatacccacacgtatacggatactctccgcgtaaattaaggaaacccctcacggagtttacaaatgaaaagagtcctactcggacaagactgggtcgtcaatgtatcgtgtaaggtttgatgtttccgagttctacttggaaaccgcctgacctgtgatataaaagggaccccccggggaggacctaaggcatcgaatctcagagccaacacaacccacacagcctacgaagtcggagcctgcaatgagccaaatcgccagggatcgtagtcgagccaactcgaccacgatctcgccggattcgtcaagttccactattccctttgtaacctgtgttttccatcatataatcccacatcaactggattagggctattacatatcaaggggtctgaaccagtataatctttgtcttttgtctgcttgatgtcgtattacgtagatccttgtaccaacgtaccccaataccctctatatccggtctacgggtatcacccgtcgacaaaatgagatagtataggattgaagacaataagaaaaactatctagtcgatagatctatacaatcgtgatggataactcatcagctaaaactccgatagaactttgaacagagcctatcaagcctgaataagtctatctaacgaataaaagactagcagatcggacttaaccaagacaatataagtttgatgaaaggcttgatagatctatattaaatcaaactagcaaagcaatcaaataaagagccaatatatcagatatattgaatcaaattaagaaagcaaagaaatcaaagaaagagtcgatatatcagataaggaacggtagtaaaatgtgattagaatatcggacttaatcgagaaattactaattaggccgatataagcgaagttgatggagcttactttctcgttggagatcgaaaccggtgcagtctaaactcgatacttagaactcatcaaaattaactttgttagaaaaggaaactaacaaacttgccttaatacgaaaactaaaaacaaaatacttctaagattggttaaatatatctgatacactttccaaccatccttgctagaatcacaacttcaaccatctctttgacttgctttgcctaacggcatgcaccaaattttgccgttaacatatatattttattagtatgtctattctatgttagaaatgttgctacgttttaatagaatcttcataaaatctaaagaaatttaatgaagtcatcttataatatgaaatggagggagtaattactactgatcaatcactttgttgtagtactgatcttttttagtttcaactctaattaatacctataaaaactcaaattaaaaagtaacagatatgtaatttaatttgtttttcttttttattaccctgagtgttattcttcgagaaagaaaataaaatttgtatagctacctatacaaccatgttacggctgacaagtattttatcgtaacagcgagggtgttttctttgctgtcaaagaagtgtacttagatgatcaagggaaatacgacgatgcacaacagtgtatttttcagcttcagcaggttggtttcgctagatgcttctcttgttgataatatatggagtatatatatttctgttggtaatggtgtattttcagatcataaagcatctactaatttctaataatctgttcaggaaattgcactcctgagtcgtctgcaacacaataacattgtacagtactatggtacagacaaagtaagctcctgatcgatcttgtgatctttgcctttaggggatcttgtggttgttcatctatttgttgaagtaatatgtgttattgtgttgtatataaattcataggttttcttatacatatttcttttaaggttaatatgatcatccattgtgtgacgactgcaggaggactcaaaactttacgtcttcctagaactaatgtcacaaggctctcttgcatccttgtaccagaaatatcgcctgcgaaattctcatgtttcgcgatatacaaaacaaatccttaatgggttgacttacctccacaacagaaacattgttcatcggtaatattcatacgtctgtttgcaccataggcaatttcaacctgtaattttgtagcataaatgggatttcttaattataaattgctcactagatttctcaatttgtcttgcaaaggaataaaatattaattatatactcatgtacttcaatgttcaaaattcttgtagggatgtgaagtgtggcaatatactggtgcataggaatggatctgtgaaacttgccgactttggtcttgctaagcaggtctctgctttctgctgggcagaatctgtatttatgtttgtgttagatctttcagttctttgttactgactttgttctactcttgatttattagttatctctttcagataaacaaattcagcatgcttaaatcatgtgaaggaagtgtttattggatggcacccgaggtataccaccatgcatgatcgatgagttttttctataaaaaataaagaaataacaaaatggacatgctaagattttttgtcaccatagctttctccccctccttcgatgttttgtccagaataaaaagtactgaaatattatcctaaaaatgagcggcacatatacattgtggacttgggtgaaagtgaaagtcagctggcacaatgtggccatggatatatccaacaatttaatgttaataaacgctaagaactggctagctagtattatatcaaatagtaaaaactgtctatgatggcaaaggtagagttttgttctcatgtactgaaatttaccagcagtacgccgcttaattcagcttaaatctatacactgaacattcaggttgtcaatcccaagaggacatatggaacggcagctgatatatggagtctcggttgcacagtcctggagatgttgacacgtcaactgccttacccaaatttagaatgggtgagttattcttcatcaggaaaattgttttccactgtagaattaaattatgtgtcaaaattcgataaattaaatgtgtccactatgatccaattcccttgaattattccttcaattcttgttcaattaaatgtgtccaactatttcttcaattgttgttttacaggcacaagctttatttaagatcggaaggggtgaaccaccagcaatcccaaaatacctttcaaaggaggctcgtgatttcataagccagtgtttgagaccatatccggatgatagaccttctgcatccaaattattggaccatcctttcgtgaataggtcagtaaggtctataatgtctgtaatgacatcttgaagctaagactcctcaataaggtgcgatgaggacatctcttcgctctcaatgtgtgtggttacagatgtggactagtgtagtataacaggcatctgtcgaggaatatgccacaatactattggtgactacacttgcaccaaatgcccttctaaaaggctgaggcaataagtcggagcacgtataaatcttctcatataatctcgtgtgggaatcactcggagtacgtaggaatgccaaccactacataagccacgaatggcgaggcgagcagcaaggagctgggagaggctttttaactacaagaacgttggggtgggacgctagtacttaaactagggtttcttcttatcgctaatcttgtagttttaagcagtaagttgtaacatgccttccctcgttctctcgtatcgggaagatttaacagtattttcttatgatgatgtgatcaagagcatatgaaacatcggtttaaaagattgagtgcgattattgtagtcaagggtgaaccaagtgcttgtacgaagaagcgaatcaatcagaatggagacaaggaaacgaggagaggcgaaactgaactaaaaggaaaagggaactcgagcgactatcatgaatgaagtgaggtttttccttctgattggatttcttaggagagcaacagaaggtataaatataattagagtgcgatgagaaaatgaagcagtgtacaacttctaaaaaaaaaaaggaaaaccaatcttctactaggtgagttatgtattctattgattttcataatgaaaagtataaaacaacaaaaaaaaagttcagtcaactcaaattgtatattacttactgcaaactagcaccagaaataaaatgcaaatttagcataaattgatttcatcttcttgactttgtaaaatgttttaaattctagattaactcaatttaatacgctaatgcagattatattatttgttgtacattggcatggttcacaccaacacataatttttttaaagctagaactttctttctctaaccctaaccaaaaagttaagtgttgtttcctaggttccgattgaactattcaaaaaagttctacatatataagaaaaaactcatatctccaaaaaataatgttgataagccctaagctccgatcgatacacacactggtatgattggccggttctttcgatgagttgagataaatacgatttgggagagaagttgtcggcgcaattacaattgtttgaggcgttgttgtgttgtgccttaccatgggttgttgatcttaccggtgcagatcagccatattcctgtaagtaaatcaaagaaacaagcaagaacaagataaaaacaatctaaattgtaaataggaattaaagatcacgataaggtggggctccgaagacaagtaattagacggtctagccgacacgcgcaaatacaaggttagtagtaatggctaaattttaatctaacaaaaccaaagaaattcggaaggggaacctatttatttaaggaggtggggcgacgactaaggggttcctagggtcatgctccacaagtttggggcgcaccccaggccggggtcccaggtgatacagtacattgattttgcaattgtggccaacttagatggaatttggagatgcgactggatccattggaaagaggactccaagagctttccatcatgggcccaaaacaaagctcttatgcacaattggtgaccgtttgaagtcactgttgttcaacgtggccgaattgaattgtttttgcttgttctccatgccttcatgtttctatagtaggcatgaacacatcgtcctccccttcttcaaaggaaaccgttctcaatttttccatatgttgttgttcatgtagtgcatgatcttgcgcatagacgtgtgtacatgaacacgaacacaaaaaacttttgtcatgcaatatcatgaattctttcgcaaataatattaacgtctaatgaaacggttatacctggtaatgtggatgcacaacataggatttatatgctacattgaaactattccctttgcagcgtatatcgctctccttctttatgaacaaagtactcgaatggtgtagttgtaatggtgtatggaagcaatattgagcaatctagtagctccccttctttagaaccaacttattctttaaattgaaatgagataaacttgagataacatgattacaaataatgtatctccctacttactattttcttctatgaatatacgatgttacaaaactgaacatatgtaaactttatgcatcaaagatatgataaatagtattattttcaccaaagatatgataaatagtattcattcgacatgccaaattagacttagctaataaattctacttcaaattatcgagtacacaaaagtcatcaaacataatatagcccaaagtctttaaagaagatagcaattcacattcctcaacttcattcgcaattatgaacaacatgcttaaaatcagcacataaaagaacactaggaatagtatgttcattcattagttgtggcatgcatataagtgaagtattataacacaactcttctttaccacaaggaataacaaataaatcaacttgtcacaaagaaaccttagtaattggctcctctaatggttgctctacagtagcatgaaaagtggacatgtgtagcttagcttaacctgattcaacaaaagaaatatatttttggtgtagtccttagtagaaaaacctcatagatatcacttccaaaaccaacaccaatataatggagctaatgatggtacttacaggtgccacttatacaaataggtgtcggttttttcaacctacttacaccgtatgtggcatttatatgtgcgcgcttattataaaaataggcacctattacttgattaaactattaattagctctgtattatctaaaaaaattaattagctctgtattttaaatcatcacaaatgagtagtcataggtgaaggattttaatttgaacgagtcaatgaggcttagttggatgagaaatgggtcatatttgtgccggttttaagcgaacatacatgtataagaacgtcacgtatgtgacgtaatgtattagtgactcattaaattataaattagatagcaagaaaccaattagatctctctttcgaagtagtcttattgattagtactccctccgtcctaaaatatattttgggatggaggaagtagtatatagacatccatccaatgatttaataattcaatacagtgggattgtggcatagctccctccaatgaatcaccactcctgcgacctactcaagccactaccctatcaacctttgttcgggtaggtatagtgtttctatcttttaactaatcatgctgaaacttttgcatcgtttcgcctgaaaaaaggtctgcattaccacggaaaaaagatgtcaaaataagacaatatcgatctatagtcctgccggcgagcttgtcaatccgttatttcatcaaatcttgtcgggtcgcctatctactaatctcaagccgacagataaattaaaggtccacgtgttagcccatgacatcacagataaattctgaatttatataagaagaaaagtaaaaaaatctatagtacgtataactagaaaatcagcgcgttagttggcgcgctagaaatttatagcccatatacattatttatcgatcatcttgaatatggaaattttgtataatattacatggcttagttattttttgagtatatgggttatttcaaattatgcataaatcatatattcaaaagaatgttttactggattttaattatctatatgtttgtcgaaaattgagatggatcaaatagtaatttatgatttgtcagtaattatttgggtagattgtgttgtttaagttcatgagtataggtgcatgtgttaggaaaaataatagtaagtgtgttgtgttaaattgcagtgattttataaaacttgtaagttttacatattcattagaacctagtagaaaataaacatatagaaaaaatggctcataagaatgtaaaaacttgaaccaatattttacattatttgcgttattattttttctatatatattgttttcttctttccctaaaatatatgatatcaatgtagtcatagtactcgcatcaatttcaacttaattgtagtaccagggaccagggacgatgacgacgacgatggaggagggcgcgggattcgccccacgagatcccccgccacggtgcgcgacgcgacggatcaaaaagaaggcggcggaaaccagctcctttgacgatgacgggcagcagcaccctaggccgcagggcgaggtgggggcggcggatcccggcgattcagtgaaggaggagtcttcggagcgaagcggaccaagcggttgtgggggagcgaccgagagagggggctgcggcggcgtcgattgaggagttgaggaggagagagccgaggggagatacggagggagcgatcgagagaggggggcgacgcgtgcattgatgcggcggagtgcggagagcacgacgagtgatggatgcgcgatggcgccgcgtcgaggtatagaggcggcagcggcggggttaaggtgtgggggagatagagagggattgggggcgccgtttttttctcgccaactatggatttctgatgccatggttaaggtcatgtgtctatattggttcgcgtgtttacgttggctttaccttcaaccactatgcatttttttaaagtagtacagataatacagaaagcattcattttttatcaaaaatgatggtagattttggtgaaaatagaaatccatgttctgttttaaatgaggttttctttataaaacataaaagaatagaatggtataatcatttgtcccatcataaaaaataatgatgaatttgaattatccagaaaattattctggtatgatgggttattcttctcgagtaggcatattgtatccctattatataactctgcactagtgctacttgcaatttcagcagagattattcagccgcattgttcaataaacacatttgtattttgatcgttatactcaatagaactattttgatcattataatcaatagaacgtacacacctcttttggtattgggatccacgcctcttttggtattggtgagcaaaattccacatgtttcagtattggtaagaagaattccatatcttgtccgtgagatttgggatttgtgtttgagcaactggaattcatggatttggtaagaagaattccacgtcttgtccgtgagatttgggatcaagctgttgtgtttgagcaactcgaatttacggatgatttgagtattctcgcgatcatctcaatgttttccataccctgctaaggacactttgatatgcttggttctctcaaatatctcatttcacagccaaataataagaataataaaacttcaattctttttattatataaagctagagattgggtagcatataaagggagagaaccggagacacacgcaatgtgtttagctgcttgatttcctgggctgaatgtcatgtgtttcgttgaacacgctccatgtgacatgcatgaccgcaggcttgacatacatgagagatcaaacagcctcgatatgataaggaaaagctagctcgttagttagaatatttcatccaatttctttaactgagttaagacatgaagttacagtgtagtttacagaactaccttccataaggattactatacttacataaacagggaactacacgaagtaaacagggactcagggaggcacttttatgtgccatgggacattgtatgacagcaaatttaaattatacacatccggcccactatactatgatagaaagtcccaaatttaattttaggatatcacacttgggccacattcaattctttcttctctactggcccatactttccatccactcccttgatccaaccccctcgacatcttttcattctctcttacaggccggcccactttttccagaccagcccagctcgctttcctctctattggcccatttacaccgttgcgcagcctagtaggcccaacaggcccaaggcccagcatggccgaactcctggccctaaccaaaccatacatgctgctggctcactaaccgaggtgaagcttggtgtgctctaatacgtatgaagacaagtaagcaatgacatatcgtattttttaccaaaccatatgtcatgtttaatagtacagtttgttcaaaccaaaatgtttttaattatcctccgattgtcataggctattgaacatatggagaagatagtatgatacgtactgtgcggttttaagtgttgatgagcagtgttatgatcatcggaaaatttaactaatttgtcactattaaatttgtaaaatctcccatatacccctctcctatttgttattagtattacatttagttactggagagagagagacaaaactttttatatttcgccactttcatcgacatggcgtgccaagtgccaacaagaagtcctgccagtgcaaatgggtggtacgaaatgtccattttacccatgtggtccccacaagtcagctgctcccctccattcttcactcagcgatttgtccctgcggcctttgtctgctgtcgacaatgatcaaggctgtgttggattctcttggcggatt

SEQ ID NO: 35263 - DNA, 16335 bp, Oryza sativa
ttggccccaaatcctctctgctctacgcctgcatgagggtggcatgcatcgatcatgcatgacaattcatggtgcacgttgtcgtgacctcgccctcgtgggtcgtacgggggagaaagcaaacgttgatcaaatggcagattgtccggaacatgttgaaggatgatccaccttagatgacttgtgacaagttcttttttctttttacaaccaacatcggatggagcgatgattcattgaatagagtataaaaaaattacaagactagcattttgacaagtagtaattataaaacaaaaagaaaaaaacaccaccaacgaagaaccccagagaaggctagcactataaaccggccgctactaaggtgacatgctcccgctaggccaacaaaaaagctatagctcaaccgcccgaaaccaaacccaacagcctaacaccacactcaactctatctacgcctttggaattggaggagacagggttagagcaaaggatcaaagtgctcttccccgtaagtcaacatgactatcttacattagctaggataccgccgcaagaggacaatcatatctagagagagcacgtacaagctgtctgagagaagcttaatttgacaagggagcttcctagacgatgagcaccgccaacgccatttgtcgaggtctcaaggagaaccaagacaggtttttcacctgataaccccacgagagggagagagacggctccacagcgccccaagaggtaaaatggcactaaagctccatcgttgtgggcttggcaatgacaagctaagttttgaaccgaccgcatcccccgagtcgatccttagcttagctattgctccattgcccaccaccgaacaaccccgctagcgtgaggacatcacttacctgacaccccctgccggttagccacaacatgcctctgtggaacacccgccatgtcgagctccctaccgttgcccgcactgacctccagagtcagcctcccgctgctgccggccgcacgtctcgcatcgtgccggcctaccaccgctggcggtcgcgccggcctacagccgccaccgacatgcaccaggctagctctactagccgtagcctccctaccgattcacgacacgtcgttccacatatatgtttgaccattcatttcattaagaaattaattaattattatttatatatttatagtggcttgattcatcatcaaatattatttataaaaaaaattaaataagagaatgattaaatgtttgttaaaattaatgtcaatggcatcctatattaaaaaaaaagagaggtagtttatatatatgatagacacatagtatatattctgtttgtaacttgccttacttaccacgctgtcgctacctacccagcatgaaaatgtcctacgtctctctattggaaatttggaatctttctactacttggaggcaaacaagtcttaatatgctgacttttaactggtcaagaacaaatgaatcagaatctaacaaggttgccacacagtaatgaaagaagagggtacacatccatgtacgaaactgtctgctttttcatcacagtcacgactcattctaacatacaaaaaccaagaattcaaaccacgtgaattgaaaaccaaagcaacgtgtacttgactaacctgcactctagctaatcctacttgtcatttctgtgctgaccttcagctcgatcgatcgcccaatccatttccaacgtagaatctttcaaaccttaataaacaaaaaaatattcagtcatatattctacgtctcaatcatgaaatccaggctatatatcgatcaataccgcagaagaaatgtacatatatatttctgccaaatttgaacattatatatatatataccaccttacctagtctatatatatagactgggtgtgtgtatatgtacgtacatcctcttctcatttctaagctagccaaagctatagatggatcacagccttgctagtgctttcggcataaatgccggcaaaatgatcatttcgcagaagccacctactaccacatgttgttttcctatacatatggtttggcacaaaccagctgttgctgctggaaatacgtgcgacatcctaagatcagcaagcaggcacaagagtttacaatccgtgtcttgtcattcacatgccccagctcctgttccagctgccgtggaagcggcggcaagttttgagccctcggtgtggggcgagttttttatccaccatgaaccacaaccactgcaggcaagtgtaaaagctatataaaatctagcagtaatcgattataattcttcgaaatgatgtccccctttgattactttttttcttaaaatcaaatgtaattggtcgtacagaattataaaaattttgataatttagggtatatagtgatatctggttgaccacttgaccaccatggcgtgtcatacgtgttgtacattccatttttgcaaatctacggaagtatattggtaatttcaatttacggaagattgaattccagtcttaataaaaagcaaagtcatagaataaactcagtataggatagttgaaaacgtaggacatgctaattagttggtcaattgaagccatgatcttcttcaaaatggacgattttacagagcgattcaaccctggatgtctcgcatcagaaggctcctatatactcccccattttatattataagatgtgttaaccttctgtagtcaatttttttaatcttgactagattaatttataggaaaacatgtgaacattttcaacacaagacatacagacagaccatcaaatatatatatgattgttaggtttaacaaaactaatctgacgttatagatgttgataattattttgaaacataaccaatatattttagtaggaaaaaagtcaaaacattttatagtataaacgaaaaagtattaatcaaccaaccgacttaattgcacgttgcggttaaaccagctaacaggccagtccaaccgttccacaatgaaccaacagcttggatatattgttcactctcccctaatccagcctttttttttccatacatttaggtttctttcttttgcatcgttctttggttacagtaatatcatcgaaaattttattacttcttttctttacaatccttattactgaccaaccaatgcatgtaagcaagcagatatcagaggaatggatgagagagagagccaacaaattgaaagaagatgtctgcggactgtttattatggcctcaaatggcatcttggagaggatgaacttagtggatacaattcaacatctaggaatagatcacctctttcaagaggagattgactctgcactaaaagacatccatgaaaatgatttagctagctctaagctgcatgaggttgctcttcggtttcgcttgcttagagagcatggattttgggtgtctccaggtatttttgtacctatttaataaattgttaagtttcttagtataattgatcaacacggtgaggccataaaagggcttaaaaacatgcacagttatataaccttggcatgctataaaaatatgtagtgtaaactgtgtatatagtgaaaacctagaaacaatcatggaataaaaaaatgaacgtgtaagatttttccatgtcattatgagtaaaacttttattctactatatattttcccaacatgtcacaataatcgcatatattaattgttctcaaatctaatgtgcagatgtatttaacaaattcaaaggtgatcatggcactttcaataacgaattatcattagccgatgacccaagaggcctactatctttatataatgcagcccatctgttcatacatggtgaaccagaactcgtggaagccatttcttttgcaaggcaccatctcgaatcattcaatcggcgtaatgttctgaaggcccctttagctgatcaagtcaagcgtgcccttcacttgccattgccaaggacacacaggagagtggagatggtatcatacatgtttgagtatggccgagaggatgggcacaatcccgttattcttgaactagcaaagctggatttcaacctactgcagcgtgttcacttgaaagaactcaaggaaatatctaggtactaatatcaatttgttacgagtatatcaacggctgggtaatgagaattcatgtggccacaaaaaaaagagagcaaaatataccctaaattcaatataaaatgatattctatctcttgcattatattataatatgttttaaatgcattatcttattaacttttggagacggcgtttaattaatatcatttgtcttattgaaaaattatgtaagtatgatttattttgttgcgaattcttttatcaagtacatggagcatgtcatataattttcataattacactaaattttcgaataaggagaaatgtcaaatattatatgtccaaaatttaatattgtcatgctattaaaaacagacgaagtatatctaagaatgtggaactgatcaatgtaccatcataaatacgcatagactgtttcaattatgatcgttggtttcacacataatttcctaaatatatacctgacgttgcgctatgttgacggtctcaatgtatgtacaaaattgatatgatattttctttcaggtggtggaaagatgtttctggatatatgggtataaaccatattcgagaccgtgtgattgagtgctacacctggtcctacgcagtgtaccatgaggaagaaatgtcgtttgcacggatgctctttgctaagatagttgtgataattgccctattagatgacacatacgatgtccatggatatacctccatccaggaatgccggatgctaaacgcagccattcaagggtacattggatatgtttatatatgcatcaaattatgtcttaattattattagcacgctgacaattagtggttagatgaatgctgactttgattttaatatcgtgcagatgggatgacagtgctgtcttgcttgtacccgagtacctgagaaagttttatgaatttatcttgcgctgctttagggagtttgaggatcaagtgccaagcaatcagaagtacctgattgccttcagcaagacagaggtacatctagctctattaattatatatgttccagaatccaaaaacatgcatgcctacatagataattaataatataatttttacacaattaattcgttttgtccttaaatttcgtcccacaattaatttttttatgacctcctttgccccaattatatatatatatatattcatacagttacaaaggttgtcaagttattatctggaaggagccgaatggtcccaccggaagcacatgcccagcttcagcgagcaggtggctctggcgacaatgaccacaggaacacggccgctggctgctggtttaatggttggcatgagtgagtccatgacaacgaaacaagcgtacgagtgggctgtgaatagcactgacgccatcatctcatgcgggaaaactggccgtttcatgaacgacattgccggatttaaggtatatatataccgattaactaattaattaattaatttgacatgtataaattcatttgcagcacgtacatatatcgatcaatgattattttttctgttggggcaatattactattaataacccatgttttgtattaattcttattgtgaaacaaagaattataatattttaaccctaattttagaaaatgtactttgtttcttactgatctagaaaaaactatgaactatttatataaacataaacatatatctacattaatttaaaataaaaaataagtcaaacaagaagttacaattaatttgtactgaaattaaagttttttgttttatgcaaggtttcggtttcaggcatgcatattagccgtcatatgtaaatttcggtgaccaatatataacaaaaaccagacaactaacagataggaaaaatagttttaacgaaggataatgtctggattatcccatgaattatcgtggtcgtttgaattgcccttaaattcaagtgctagacattttgcactcccaactattctaacctgttaaataatgccattgactcaacccagagtggttttcgttcctacgtgacacatacgcgcgcatgcagcctagttagcaaagttttcttttaaaaaaaaatgttgggccctcctatcagatttctcctcccattatctctttcccctctttccatgatcgtgagtggcatcgacacccaccccccatcttcctctattgcacggtcgagacctccgcaagtgatgatgacgcttgtctagagaagcacagtggtgacctcaccaggcgatggtgatgccattggcggctacccttggtctaagtcgggcagtggagcttcgtgagtaggagagcctcgagttcgcatacatctgccatcgccctgaagtccatgctagtcagcttcaagtctgagctctgagtttcgctgtcggacccaccgccaccgccaccaccacctccctaaagtttgttgttctagccgatgccctccacaggcgagctcggctccatcgccagctgccttaacttctagcatctctccctcactggccgctgcctccagcctccccaaggtgagctcgaactctgctgcagcaccatacccaagcgacctccctcttcgttgttggtcgtggctaccctcttcttcgccaccggcagccacctcaaacatccctgagaagagatcaatcaccgtttaggcgcactccccaagcgaggttccattgcgctgttgttccgctgagaacgacctccaacactctcaccgagcgagctcgatgccaatgactccctccagcgctcctgagcaagagagatagggaggtagagaaggatgagattgttgatacgtggggcccataattattttaaattttttgtgctgactggatagccacatgtgcttgtttctctttgaatccgtccaaaatagtgcagcggttagttcatccgatttaaatagtggagggtgtaaaatgtatggtatttgtattcaagaaatagttaggacaaccgcgatagttcatatggtactttggatgtttttataataactaatactcctactcctttcattccaaaataaatatacttatgcgtgtttctcaaaatgtataaaattcctatatatattctgtaagggaggtagtacctaatcttatactccctccatcctaaaatgtttgacgccgatgacttttttaaatatgcttgatccttcgtcttattcaaaaagtttaggtaattattaattcttttcctatcttttgattcattgttaaatatactttaatgtatatatagagttttacatatttcacaaaagtttttgaataagacgaacagtcaaatatgtttaaaaaagtcaccggcgtcaaacgtttagggaaggagggagtatgtagtataaagtatattgacattgagtatgtgtgctacatggaatgcagctcgggtcgcagaacaaagctgacatgccatgttcggttgagagttacatcaacgagcacaaggtcacagccgatgtcgccatcgccaagattaatgaattggtagaagatgagtggaaaacaactaaccaggctcgcattgaccaccgtgatgtgctccctgtggtgcagcgccttatcaatataaccatggccattccattgtattacagcgatggaattgatggattcacgttcggcgagggcattcaggaggttcttgagaaactctacgtcaagcccattcccttatagacacaaattaatttgttgatggagcaatccatctctgcccatattgtgccatataatttatattcctttttttgtgtgtgattctatactttgtattaactctcaaggttggcaccgatgaaatctcttcatcagtgcaaggacttgagatattatctatatggacaaataatttttgttttatgcttcacaatgaactcgatcttgtgttgttagtattactggatgatgtacggtatgatcgatatgatgtttgacctcaagaagatagtcatattgtcttcttaattttgtgctttctagctatccctccatggtgatgtttataattaatcttattgttaacccatcatacatatatgtaactaatctcctcatgctccgtctggtattttgcatctattgaggcaagattgtaatatgatgccctaatcaataaagctctctattcgcgcaaaaaaaattaatctcctcatgatcgtccactccacctcctctacctccacttcctctccatcactcctcttcctcatctcaactccgttgatggtgggcgcgggagcgggagcggcggggagctctgctgcgggggaccctcctcctcctcctcctccacccctcctctcctttcctctcctctttgtcggggatgggcaggagtgacctgcgccggagggatctggtggtgggcgggagcaggagcggcagcggtggggaactcggtggcggtggctgatccggcggtggggacagcggcggcaacggatacggctctctgccacccaagcggaaaccgacggcgctcaacgcgtggcaccggcgtgcggatcctagtggtgattgctagggtttcaaattttgtttggaattaatttttttggcgggccgatttttcattttgcagttggacaggttgagcacccgcagcggttgctctacacgcaggcaaaaatacagatttttgcatacacctgggtgcagcgggtcacccacccgtccgtgaaaatcgattttgatcgtaagcaaaattcgtttatgtgtgtggtagcgaaagtagaccttggagcctttggcacttgaagtcttcatatactgttcatgagctcctacattaatagatggccaaaatgggccgctcggcttggcccggcccgtccctggcgtgacccaggcacggcccgaggccagtcgggccggcatggcccaaccaactcgccgtacagggccatgccatacaccaacggcctaggcacgactcaatgaggctctcgggccatgccatgccaacccgaagacacgattagcccaccgtgctcgtccttgaataagtatattttgcctccctcatctctttggaatgggacttatatggatagaataagtctatcttacctccctcaactctttgggctgtggctgatactgctgaaaataagtctatttggcctcccttatctttttgggcctactgatcgttttgccgttccgtgcatccctagcgccactgctgcgccccatggcaaaaacactccatacaaaccactgctgcgccacatggcaaaaacattatcggtttgcgacctactttgcgatgacagcggtgatggctaggtgacgacagtattggcgatgacaatggtaatagtttggcgagcaactcagattttcttttttttttccgaaactggcatcactaccggttgacaaccctctagtgatattgccggtggcagtgatgctgtgatgggcatttctgtagtgatgagactttagcgaataaagtgagagtaattgtaaatagtacgactgttttattaactgtaatttttgtgacatcttacataaagaattaaatttattggcaattagttattttgtaattagttacatcacaaataagaatgaacttttcaggtgtttgtctcatccaattgaaatgtttgtcacactcaagctatagtcaaactttggctgttcaggacatttgtttattcatgagccatattatggcaagcgaaacttctatattcctatgcttaatagatatcatatacccaacttacaaaagatactatatatcatccaaatcatacaaaccactgctgcgccacatggcaaaaacactggaacattatcaatccatacaaacttttatttgcataataaacatgtgattgatacaccaagctatctatatttgtgacaataaaactccatcaaactcccagcagatgacaatctctctgactaattaattgcctgatctccacgatgacagcggaggagtttcagagttcttccaggtgttcagaaaagtaccatgatacctgtcaccttgcacaacgtcagctgaagcatacgactcaagttcagacatctcgtcaggtgtgagcttcactgacagtgctcccacattctggtcgaagttgtggatctttgtggttcctggtatgggacagacatcgctcccttggtgatgaacccaggccagtgcgagctgcgacgatgtgcatccctttctcgctgccatggcattaaccttctcgaatatcgccgcgttcttctcgaggttctctggctggaatctaggtaggctctgaagagaagagtggaaaatgcatattatatttgtgaaaaacaggcacggatcaatgtcgatctatgtattgattggacaaacaaagaatcgatatttaagattttatttagatcgtaattaattgttgatggctgtcgtggttgatctcatgggcagtataatcaccttgcggaaatcgtcgtcaggaagttcatcgaccagtttagctccactggagaagaaccctctccctagcgggctgtacgccacaattccaatgccaagttctctgaaattttcggaacaagaagaaataatgcagtttagaaacacatccatagacatgttctgcttcaatacaagcaggtattatatggtgtggggtgctctctgaaattgtgggaatttccgaactttttggcacgaaattatttgaaaaaatttaacaaattttgattgaatttgaataatttttaactaaataaaaaaaagaaaaatgccaagaatttcgggctagatatttgcgtgctagagaggggcaaaatttccaaaatttcagatcgaaattgcaatccctgcagaccgaaatattcccggttttctagaaaataataatagtagtagtagtactgctccatgattcttacatatataatatatttacctgcaagttggaacaatgtcttcttcgacatcccttgaccacagtgaccactcgatctgaactgcggtgatcggatgaaccacgtgagccctccttatcgtcgacgcagaggcctcagataatccaatgtatttgatcttgccttcttcaaccagcttcttcagctcacccatctgcatgtatataaaagtcagaaatgtaggcttggtgagtgctgaattaatacttatcttcgaagttggaattggtatggaaagtacggtttatttttgttgaatttttcccatcgggtcagctcttcagttgagtcaaaaagataaagagtgtgtgacttctcaacaccaacaggagtacaatctttctatccatatctattaataaacggttttgctaaaaatacttactggccgttttttcagtaatgaactttcaattctatggccaagcaaacgtttgggggggggggtgttggatgggactaaaagtttgtaagtccccgtcacatggacactaattagaagtattaaacatagactattgacaaaattaacctattccataatcttggactgattcgaaacacatccatagactgcagtttagaaacacatccatggacatgtcatccattctccttcaatacaagcaggtattatatagtctcgggtgctctctgaaattgtgggaatttccgaaaatagtaatagggtatgattctcttagtagtttaaaatccaaggtaaaaaaagtataaaacgataaataaaaaggagcagacggtttaaaactaaggttttaaaattttattttatttgcggcctataatatctatattttatttattaacttcggtcaaaattaatatctttccatttctccatgagctatttagtcagcaactatcatgatatgatttatttattattaaaaacacagcgttctaccatcaccttggcgtacgtacgtctccgcatcatatgactatctatataaattcaaagcaataacagtaaattaaaatgcgtgtgctacgtgccaacgtaatcagaagatctctccgcattctggtcagttcttcatcaattaatttactcaaaaagataaagagtgtgtgacttttcaagacaaacatgagtaagatctatatatttatctatttttaaaatattaacttaatttggtcagtaataatccagtatatatcatgatataatttattttttaattaaaagaagcgttattccatcatttccatgtgtccacatcacatgatgactgtataattgaaaactgtatcctgactagaatttctgtatgacaaaaggaaatagttaaaattgtgttgctaagtgcctatatttttttcagaatattcactggattattatatgaaaagttatttgttctattctttgagaaaagtacattttcgcaaaaagctttcaataacattgcttagatcacttgtttttattaatttgttaagtttatttttagtaagacatgtaacttattatgcatataattaatcaaataaataatccacaccaacaatccgcttaggcccggtttagatggcaaatttcttttttgttttcgggtgtcacatcggatatacggaaacacatttaaagtattaaacatcgtctaataacaaaacaaattaccgattccgttagaaaactgcgagacaaattttttaagcctaattaattcgtcattagcaaatgtttactgtagcaccacattatcaaatcatggcataattaggcttaaaagttttgtcccgcaatttacacacaaactgtatatttggtttttttatccacatttaatactttatgcatgtgtccaaacattcgatgtgatgggtaaaaagtttttgttttagaaactaaacatgaccttacaccgttctaatttcaaccaaatttccaatttaagcgtaaactaaacacaaccttagtaaagtatatgtttaaatcctaccctctacaatacaatacataggatctaggatctcgtgatcagctgctctcaccgtgatctcaacgggcaccgtggagtcgattcgatgctggtagtagaggtcgatgcagccgacgccgagccgccggaggctgccctcgcacgccgcccgcacgtacgccgggtcgccgcgcacctcccacgccggcgtgatgccgaacttggtggccacctgcacctgcacctcctcctccgtcgccgccgccgccgccaccgccttgccgacgagcacctcgttggtgtgcggcccgtagacgtcggaggtgtcgaggaaggtgacgcccgcggcgacggcgtggcggacgagcgccaccatgtcggcctccggcttccgctccccgtacaccgccgacatgcccatgcagcccagcccctgcgccgacacctccatcccctgcgaccccagcttcattcgccgcaccaccgctgccgccggagctgtcgctgctgctgccgccatggccggccgatcgattcttgggagaggattgagcggctggtgaagtgagacagctttgctcttccattttcgcgccgttatttatagcgagttttatgggtgctccgtggcgtcagcgagtatgtcacctggtgcctctggattactactcaagaaactaatgagacagtgggcagtggcttggtgtgatagtataaaattatgatagaatatatattggcttggtgtggattactactcaagaaacgtttactaattttagctggtctgaaaatatttttgtttgcttttttatttgaattactactaggactttgcctaacagcgtgattttcattaaaagaaaaaagtattttacaaaaaataattacaaggagagcactgaaaagattacaaaggttataatcaataaaaaactattttctttagaggatctttcattttgcacatatgctgcagaagaactttcttgaacaaaattctccagccttcaaaggaaggtcgctcattccgaaaaatctttccatttctttgcttcaaaatatgctagacagcaataataaaacttccaagaaacctttttgtctgaaacgcaaatgcgctaacaccactatttaaaataaattgagattagaatctcaaagaatgctgagatgccgccaacatccctggctgaaaggatagaagaagaaatgaaattattgttgttgttatcaaggaattctattatcccttgataagcttacattaagaaggtattttcaatatcagaatatattgttgtggaaccagctcgctcacccggatataattcttagatttaaaacgtacgggtgctcgcatttaagtctattttattcttttagtggggtagggtgttcatggtgtgcacacgttatcagcacctccgtctgtaccgtgtttgtcaaaaagaaaatatatatatagcactaaaaaaatagtacattttctgtacattttcgagcctgcaaggtcactgtttctaatatttcttgtgtgcttccgcatcaatcatatatataagaatacctcccttgacaatgagatatattaatttttaataattattaccagtaattaagcggagatagattcactactacaaaacatcaaataggtgtcaccactataggtaccggtagtgctaaaaccagcacctatagggccttttaccacctccacgggtagaaatcgcaaaaaaggcacctttaagtaattataggtgttagtgctaaataaaaaccgacacctcttatattttgtgtcggtttttttaaaaaaaccgacacctataatagcaccccaaaaatcgagccgagccggaaccaagccggcgggccccaccatgacgagcgacatgtggagataaggtctcgctctcttcttcgactcttcttctcgctctcttctctcccttctctgtctcgctctcttctctcctctctctccctcccttctctgtgccggcagctggccggcggaggccgccccggcgactgtgccctcccctccgctagatctggcgggaggggaggcggcgacggcaggagggatggcgtcagcgcgggcggggtcgacggcgggcgggcggtgtccggatccggcattggcggccggcggggtgcctcgaggagcggaggtgtccggcggagggctcgaggaggagagggggcggcaggcaaagggctcgtggaggtggcggcaggcggagggctcgccggcggggaggagcccttctccccgccagatctggccggtgtgtaggcggccacagggtcgtcgggctcgcgaaggagacgtgtcggcggacgacgggcagatggctagaagacgaccgaccgacggcgcgacgacgacttcatcaggcagagtggggttgcggcggcatgacgatattcttcaacaaggcaagccaccaagccaagcaaaccctctttgaatgttgtgggatttttttattgcataaatttgtgttgcaggctgaatccatctttgaacgttgtgggatgaatgttgtggatccaaatttgctctgtgtgggaggagttcttgcagatgtgggaggatggactgctcggcttgatgcgtcagcttgatcgagccgacacatttcggcatcgagccggcttttttgcatcgtcgaacgtaaaaggggatgagtctgcgggtcgggcggccgatcggtttggagaaaaatcgggcgctgacgtcagcgcccgagttacgtgcaaaactattgtaaactgatttttctcttaaattacttatccaaatcataatccgattgcacctttaaattcgttgcaattaaatcttcgaaacaagactatattccgacaaaaattttttggcttattattgaataattttaaaatgttgcacgatgtcccaccgggtatatcagaattgtttcactaaatagatcgaaaatgtttcactcgtttaaatcggtgttgtttcccctatgtaaaattaatgttttagttcaccgcaacatttgatccaacatagtgaaacattataagtacactaggtgaaacatttttcggtggaacaaaaaacaaaccaaattcccttaatagggggtttccaaaatatatgggttttttttgttgcaaaagaatattttaattcactgcaacattaaatctatacatagtgaaacattataagtacactaggtgaaacatttattgtggaacaaggggagggacaagtgggtgggtccagtggggtgcacgcgtggggggagggggagcgcacgtggggggag

SEQ ID NO: 35264 - DNA, 14756 bp, Oryza sativa
  unsure (1)..(14756): unsure at all n locations
tttcccacaccccccctcccccctgtcgaccaatacagagcattctcgacctaaaaggtgctggttatacggaaccgacacctttttattttcaaatcagtgtcgcctcccctgtgccggttgggaaaaccggcaccgaagggggttttccaaccggcactaaaacccttttctgtagtagtgattttgtattggatcttgtctgcatttgatcctacaagcaagagagaagattttcaaacttttcgcacatttcccgaactattaattggtctgtattttaaaatgttctatgaaaaagttagtttaaaaaatcatattaatatgttttataaacttgaaataattaatacataattaattgcatgctaataattcacctcgtgatgaaacaaaggcagtcttgacaaccggcaaaaaggaccctccgggaggcaaaaaaaatcatcgaggctagctcgagacaaggagcccacaattaaaatccctaaaataatgaaacaaatagccaacaaaaatccataggatgaacggagtcacataatccatcaacacatcacataatatttacaaaattcatcacagatgaggatgttgaagcacttcgattttgattgatatagcttgggagaagattttcctcgattgtgaaggtctcggggcttcaatggatattatggacactcatactcacgtggcctggatatccgactagagataggaggtagaccgagtgagggattatgtaagagattagagcttgtgactgttaattgccttgttttttagggtaaaatctcatgaatcttagataagtacaattatgtaatagataaggaaacatataccgtgtccggttggattcctatctttgtaaccctacccctcgcacatataaggagggcaggggcctctcaaaggcataatcacaacttgatcgtgtcatcaatacaatactcggcggatctagtcctcaaaacaggagtaagatattagttctcattgagaagttttgaacctgtctaaaccttatcctctttactcatctgtcatggttatgcataccacatacctaatagtagttgactaaatctcggcaggatccaccacataccatgtcctatacggaaactaacttcagatatggagggagttccggataaggaaagacaaccagagttctacatggaaacgacaaggactactcggattgtatccatattggtttccctagttctacttggacaaagggacacctatgggtataaatataaggcccccgaggaggagagggggaaccaccctgagaggagaccatggaagacacccatgattatcaacatacacccaccagaagccacaacatacaagccaacatacgccaagacacgccgccggatatcgacttcacagataggcatggctattcccctacggtgtctccggataccgtcaggagatacgaaagcgctatctttgatctcgccgggtacggactcgaggaggaagactacccagttgtcgactacgagtcagaccttcagaccgacatgtcgacaacagttagataggctgcccacatattgtattggtgtgattatggtgaataaaaagcaacatcggctctggccaacaggatgtagggctattacctgaccgctcagggacccgaacctgtataaaaatccctgtctccatctcttttacctcagtctcgcatatatcctagcatcaacgatccccatactgtacaaataccagaattgcgatatcaaacgtcgacagtggcgcgccaggtagggggattttggtgcttcttggatttcgacgagatgggtttaagagatggattctccaacaacaagctactcgacgacttcggctgtggggaggtctaatccgaccggaatatatcccccgacgagatcgggaccatcgccgccgagaaggagacgccgacctccacccggccgtgcagctgctgacacgagtgcgacgcccatccaaggaatgccaagcccgacttggtggcagatcaatctgtatttgcttcgttcttgtgtccggttaggactggaatttggcaaacggaatacgtgcatgcatgacaaccgtgccgaccaatcaggactcaggagatatccatccacaggcctacatgttgacgtacgtacatatgctgatcggtttccaaaacctattcggtatatgcacatcaacacatgtctacacagcacgactgcataatattcaaacaaatcaacaaaggtatttagcaagattaatttaaaggtacgcagatacatccggcatgtatctacaaaggtacgcagtattttatatacaatttaccgtacctacttttcagatcatacagcattgtcagatttatattatatttatctagagcatgttttttatacaatatctattgcgcgagtgtccccgatgttaaatcgactacggtttaatgctgggggctcgctctatttttttccgtataaatcatgcttgtttacggtttacataatgcctgatatttaattaatctgctcgttatatcctgataatactagaagatccacgcagtttttgagtacatactcgatatcatctgctatatatcttgctttctaaaaaatatttttcaggaacaattgagcactcgagtaggttgtggtcgagtacactccattatcgagaatattctcgacaaatgcggagttatcgcacccaacctaccaacaaagaccgacgacctatctcatagcaccagccatggctggactactcgagaaaaggttgttaacggataattcctcgctaacgtcgtcggcttgatcacccgacatgattgcgaacggacatccggatatgctataagttgggtacgtgagtcatgctggccacatgagatacacttgcaataaaccaactctagcacttccattggtgttcgagagaagattccgctcgctcactggttctcgcaccagtacgcagcaatctcccacaccgcaacgtccattggtgttcgagagatcattccgctcgctcactggttctcgcaccagtacgcagcaatctatcacaccgcaacgtccattggtgttcgagagatgattccgctcgctcactggttctcgcaccagtacgcagcaatctctcacaccgcaacttccattggtgttcgagagataattctgctcgctcactggttctcgcaccagtacgcagcaatctctcacaccgcaatgtccattggtgttcgagagataattccgctcgctcactggttctcgcatcagtacgcagcaatctctcacaccgcaacttctattggtgttcgagagataattccgctcgctcactggttctcgcaccagtacgcagcaatctctcacaccgcaacttccattggtgttcgagagataattctgctcgctcactggttcttgcaccagtacatagcaatctctcgcaccttaacttcaagtggtcgagttacgactactacctggtcctcgaccagcgacgtagcatttctcccaccacttccacttcaagtggtcgagttacgactactgcctggttctcgaccagtgatcgaccagcgacgtagcgtctctcccaccacttccacttcaagtggtcgagttacgactactgcctggttctcgaccagcgacgtagcgtttctcccaccacttccacttcaagtggtcgagttacgactactgcctggttctcgaccagcgatacagcgtttctctcactatttccacttctagtggtcgagttacgactactgcctggtcctcgaccagcgatgtagcgattctcccattacctctacttcaacaaagttggtagcatgtacacaaaatcgccaagtgttttacccagagatcccttatcacgacgacacctagcgttgaaacctatcctactgtccctttacgcagtcttgacaaggcctccgaggaacctaagggatcttcggctggggacgcccagagccgataaggccttgtcggatccttcagagacgaaagaacatgtaagatctggtcgtgtaagagttctcgccgtgcgcattaaccaagccgtgtaatcggaaactaagctttccaacttcacggctaggggctaggatcaatgcttattcaaccaaggcaggtcaagggtccaagagccttctcctccgagaacgattctccgacgacaaggctgggggctagggagagtgtacaactcaaacgactgaccaaagtcgtgaactgagaagacactcttacacaaaacattggtcggtaaatttgattcattttcagtttaccatacatattataacatgtcaccctttgagcattcgctcgggggctatttctatctaatattcttttctgagtattgatttcagaaaaattctattcgacattgtggaagactccatgtctctatggttctacaccaagatcgactaaggcgagtatgaccaatgttgacaaggctccgtcgcagactctacgccttctcgatcgctcgagaacagttgctggatctcgacaaggaatacgaaatgaagagatggtgtacccgccgagataaaatttcttgacttcaatccaaattctcgattacggcaagatggaagacttagtcgtactctatgtacttccttggttgacatcggagattgactcagacaaaccctttgggtgcccgcatgaggctgacaaatgaagtctaacgttatctctaaactcaccgagaacggtcagatgagctcgataacagttactccaatgtctgcgcgcggttgagaatatgaattcgttcatttgcattgaagtcgggagctactgtcatggttatggataccacatacctaatagtagttgactaaatctcggcaggatccaccacataccatgtcctatacggaaactaacttcagatatggagggagttccggataaggaaagacaaccagagttcaacatggaaacgacaagaactactcggattgtatccatattggtttccctagttctacttggacaaggggacacctatgggtataaatataaggcccccgaggaggagagggggaaccaccctgagaggagaccatggaagacacccatgacaattaacatacacccactagaagccacaacatacaagccaacatacgccgagacacgccgccggatatcgacttcagggataggcatggctattcccctacggtgtctccgaatactatcaggagatacgaaagcgctatctctgatctcgccgggcacggacttgaggaggaagactaccctgttgtcgactacgagtcagaccatcagaccgacatgtcgaaaacagttagataggctgcccacatattgtactggtgtgattatggtgaataagagcaataccggcttcggccaataggatgtagggttattacctgacaacttagggacccgaacctgtataaaaatccttgtctccatctgttttacctcagtctcgcatatatcctagcaccgacgatccccatactatccaaataccgtactcgagacatcaaacgtcgacatcatccactttagatctcgtgctctaccccttttcttattaccgaattttagaatcgacgggtcattacaaattattcgatgcaatcctgatatcgtttcaggtaaaagaacctgcccccaacccgtttctgctaccctgcgcatgatgctgtggtgcatcatcagcccatgcgagaccctacacctttgcctgtttggtccgcaatgcaacccatctcgtctctgttgacgacaccacgcgcacgccgtcttcgccacccacgcgcacactggacaccgcctaaaaccgaagggccttgccagatccggcgacggcggtgccggatctgccgccacctagccaggagacctcgccgcaaccactcaccgacaccggcaaacgccacctcccccgcgccaaagaggaagcgccgccatggagaaggccccatcaccgccatcccagctcaccaatcgactttgccggcggcagcgaggtagggggaggggtgagagggttgtggccgtggtggcagtagggttcgccccacttgtcgcctgtgcgtgggcgacgcgtgggagcgtgttgtgagcacactagttgcgatcacatctacactaggccccgttcgtttcttctgtaagggtaggataaaattttggattctcgtaacacgcttttcaaactgctgaacggaacatttcatgcgaaagctttctctatgaaagttgcgctaaaatatcagattaatccatttttcaagtttgtaataattaaaactaaattaatcacatgttattaccacctagttttgcatgaaacacttaatctttatcttcatcttcatcttcagaagattcaaacaccacctctctagcatactgatcgaaataattttattttatttgtttgtccaatatcctctttctttcatctccttttttcttagagtttgtgtggaggttgccccttgcatgagaggtgactgaccttctctttccgatcctatgtggcattttaaggggcaacacatcaagcattatagtacttggccgaatggtggagtttggacacggtgctcgttagctcggtctatggccttgcctctgtctctccattctcgggcagcacgccgatggaacgggatgactggacatgtcaggggctttgcttcctgtccagaaagagtaatggaggagatgatttagtctgggcacggagatttggacagaacggcttcgtctactcgcaggctcgcagcggagccatactcgtgcaacgattggggagaatggtgtgaggtggacgatgggtacggagacacggtgtctaggcccaccagcagcgactgctattagctaggcttcgtggagaaggctcggcttggaaagctgtatggtgttgttctctactccaaaagaagacgcacgccacgtgttcgacaaaaagtctacaaggagtgggagagaagaggaaaaggcgagaaggctgagtttttcctgggtggatatataaggctttcaggtggggcatgaggtgccaaggcccactgaaagtgagaggagttgaagagaaagcaccaaaatgagagagttgaagtcctaaatttgaatcacttggtgcctttgtctgccaaattggagtaaaaaattggtaaaaattactgtgtgcagagctagtgatgatgaacactctggtacaaaggcacaagtagaagagttatggttttacagtggtaaagttcactgtaaagtttagaagagggctaggtgatacgttttaattctagattatggctagtttgactgaataatttgaggtatcaaatgagtttataaaataatgccaaattagctgagggtatttcataatgtatagtagttgtgtgatttttccaggatttttgcacacatagatcaattacgaaaattattccaacctagtttcaatgcatatgaatgaaatgacggatgcatgaaaaatccaaaaaggagcaaaataatctcaaaagatagaagggaacccatttcactaatgatatcatgtattccaggttttacatttttgggtctattacatattgcaataatgtttgttcaaatatataaatgtaaatcttacatagaagcctacacttttgttttataaatatataaggtagccacggtcatattataactagtgatgtcctcatgagcattaaaatctgtgatcactcttgtggcctggtgccctagtgtgagcgaaatgctagaattttccggcatatagccaccatgcctaccacgatcgctgccaagtttaaggaggaagcgcgaacatatatggagccacaagacttccagagatcatccccctcaggagagtagcgtctcgctttgttctgtgcgggtctattgttttcgagataggctctgtaaatattacttgttgtggcttaatttactccttctctgttaatacaagagtggcaaagcttccccttcttaaagaggaaaaaaaaagacctccaataaggaaccgtacatgagaccaccaatattggtgtatctgtggccaatatggaggaggatcccacagtcttgaaaccagagtaggccgagcaagagacgcggtagcattagcataggcgccagctgtggagcaggggcggagctagagtatactagggggtgcccaggaacccggtcaagaaaattttttaagctatactcatctattttcaccatgtatgcaccccctcaatacaaacttaggcacccgcgtcagtttaaattcgatctaaagtaaaataatttaagtggcatcaccctccatttcattctagctccgccccttccgtggagaacacagaaactgatggtgatggccggatacatatgaattaaatagccggtgcaaaattaacttcagcaacaggccagtgatcgatataacacatagtccgtaccaacaatctgatacggagtagaaacttggagtgatcaatcaaacgaaagccgtacgtgcgtaggcgccttggagttcgcatgtattcggagctggaccaaaatgaatgatatataggaaagaaagcatatgttgtccgtgaaaatatatacgtacacgcttaactatatttctgggaggacgacaaatatacaagtacaatgagctctttaattactataggatgtaatttcatggtgcacctagtatttatgggcacaaaaatacacacttataatttctttggcagaaaaaaatattacgcatgagtacataagtaggttcactatgcttttctgctcaggcacataagttattttgaaatcacgaagaccacatgtctctgacagcacatattttaccttgtgctgttatggtcttttggaagatgcattatctgttacactggtatttacgcacagctggaagcaatgtgagtgaccggacacacatttaggctagtgtgtttataaaccagtagtccaggtgcctccctcatgtcaagatccttgtgcaacattccattgggcagcttccaatcaaaatggtagagaaggttagccaaggcaaactccatgttagctagcccaagatttattccagggcatactctgcggccagagccgaaagggagaaactcaaagttgctccctttgaattctatatcgttgttttcaaacctctctggcttgaattcttcggcatcctcccaatacttactatccctgcatattgcccacacattcacgaatgcagatgtacccttgggtacatcatagcccataatcttacatgtctcacggcatttgcgaggggctaagaggggcaatggacaatgcagtctcaaggtctcctttattaccatcttgagatagctcagttggacaaggtcatcttcagtgatggtgttttttccatcgaagatttgccgcatctctgattgcacctttgccattactcttggggaacggatcagctctgccatggcccatattagtgttgttgacgatgtatcggtgccccccgcaaacatatcctggaataatgattttttaatcaattactaatcatcctgaataatttttttatccataccacctaatgcacataatacgtgcctacatatatagcctaaacttaattcattactaagaagtatgccatttgttcgagaatacttaactaaaactacatatatagactgttttcttgaactaaaactttatgatgattgggtatcactactatatgaatgattttcctagacagggacacttttagattgcgtgcgggtggtaactcagcctgcatgggaaaatcggctcattttcacgtgcggtctatttaaaaggaccgcatgggaaaatcttaaatggaccgcacgcgaaaataagtcagttttcccgtgcaggcctattaagagagccgcatgcgaaaatagtactccctctttccctctcacccacttcaaaatttcccctctttctctcctcacccctccctcctctctttttcttatctttatctgcgagacctctcttctctcccacgcctcacccctctctctctctctctcatgcctctcttctctccaacgactttgcgggtccgcgcttcgctgacggcggcagtcggcgttggcgtgcggcgaactcagctccacggcggtgaaggcgcaggatccggcgggcagtggccgtccccacacggaccggcggcggcagccgtccgcacggatccagcggccggccgccctccccccacgcgggaaccactcccctcccctcccctgatccggcggagaggaggggcgtcggcggtggtctgaccggaggggagcgcggatccggcgcccggcggcgtggaggccaacggaaggcgggcggtgtggaggcgggcggcgcggaggccaacggtaggtgggctgctcggaggcgagcttgcgcggaggccgccgccgacgacggggaggaggaggcggcgccgccgattcaaggtttttttttttcagtttttttcccgtgcgggcaacataagcgtccgcacgtgaaaatccaattttcgcagacccctgggtgtgtgcacctgcacgcattacccgcatgaaaaattttgtttgtagtagtgtatatatcctagctaggtatagaggttaattaggatgtaatcatgttccttgtgagagaaaaaatattattataatttgtttatatggtaggttttgtgtctatcttcatctctactattataaaaattaaagatgtttttgtcggtactttggtacgtcgtccgtgtaactactccctccgtttgttgtttgtttaacgtataacgccattgattttttaagatatatttgaccattcgtctcattcgaaattatgtaattatacatctattttactgtaacttgatttatcatcaaatattgtttaagcatgacacaaatattttatatttgcacaaaaaaattaaataagacgaataattagaaaaacggaggtaagtagaacataaagacagtgttgtgaggcttgcttaccatcaaaagcacgactataacctcatttgtgattgggatcggcgagccgccttccttctggagcctgagcaggtcgtccagagagcatgcgcatgacttgctgtcggccgcgcgatcatccgcctcgatttgggccttgcgttctcggatgatctgctctatgatgcgcaccatcttgtcgcggttggcgatcgcggcgcgcggcgccgcggacaccatcgccgcgagcctcgacgacgggaacaggtcggcgacgctgagccccgacgtgaggcgcaccacggcgtgcagcgcggcgaggtactcgccgctgtgctcgcaccggctccccacggagcaccggagcacggtgtcgttgaccatcctggtgaccatctcgctgaggttgacggccgggccggcggtggcggcggcggacaggtcgcgcatgagccgcgccaccttcttctcgcggacgcggcggaacgagcgcacccgcgacgcggtgaggagctcctgggtgagcagcttgcggagctggcgccaccgctcgccgtacggggacagcacgacgtccgggccgccgaagctgaacgccgcggcggcagcggtcaaggtggcggtcggcgaacgcgaggtcgtggctcgtgaggacctcccgcgccagctccggtgacgacgcgaccaccgtgcccacctcgcggaacaagagctgcatcagcggggcgccgtgcctccgggcaagactccgcatcgcgctgtgtacgctctccctgaaggacacgacgtggtgnatgctgcgatcaagcgncagcgtccatggcnccggcggcaggttgagcttcggctttgccgcaaatgatatcatcagcttgaagacgacgacaaccaacagnatgnatgcgccatggcgaagcaccaccttgtcctccatgtccgtacgatgtgctgtacgcactagcaatagctactactccagtctccagttgccaagtactacagcaggtgtactatatatagcgatgcatgggctccgagatccttcgtccaccaagtgtcggttaatgttatttctctcttctctcatcaaaccatatcatcctaattatttatagcttttagataatagatctatggttcaaattgtctattctttcttctctcataacaccatgcaatctgaattatttttggctcaaaatttataagtattaatttgtttgggttttaataattatattgcatcttatttgtacacattacataatttaatttcccgcagcaacgcggtggggtatatattcagctagttattttaacatccaattacaacactcccattgcacactaaaaattttaacaattttgtattttgtagtgaattaaatatatctccgacgctactacagcaaattaatatttttgcggatggtccataacccatttacataggtattttacgatcccacccgcaaccttgggcgtgtgaaaaattttctattacacgggatttccagttttttattttttttaatcacaagtacataattttagatgtgaaatatgcgcacgggcggtatatagaattcgaacccagggcctctcactcagtgccatagtttccttgctatgccatagtcactaacgaaaggactatgaccggggacgactatgcatggcatagaatattccaacccatggactgtatatatggcatagctttccttactatggcatagaattccaacacgggactatggcatatagctttcgttactatggcatagaattccaacccaggatctttggtgactatcccatagatgctattcatttgacttcatccttcataaaacttgtaacatatattttttactccaagggccatcaaattaaaaagttatcaactataaacttgcagcgtcgagctctacagagcatgtctccatttgagctcattttaaaaattcaaaaattcattttatcaaaatagtgaaagtttgtaacgaatttatagccacataaacaatctggaatgaaaaaacgttacactacaaaattgaatatggacactatctacaattcacatataaagtttcagaaaaagtacgaattacccccctgaactatcgaggtcgaccaaattacacccccgaactcgaaaaccggacattctacaccccccaactattgaaacaggacaataacccccccggctcaatccgcggtggttttggtcctacgtggcatatgcgtggcagtccagtcagtaattttattaaaaaaattagtgggacccactgtcagttccccacccctctctatctctctcctctatctcaaccccccctctctctcaaatccctccgctcaccatctcactagcacggcggctgagtcgaaggctaagacgaaggcggaggggatgaccggcggcgggtggtgttggtatttcttacgaccacagagaaatccgcaagcgcacggaataccgctgtagcacttcatcttcggttgaccccaaaaggatatcaaactcagggaacgtatgtaatctacctaagcgtaagacgatccaaggacaacaactgatgataggtagactaggctagagaggactttctatgtggtttaattatctaagctaagcaaaggtaattccctatctgttgcttcgggaaccgacccccgctggtctaccagcgtggttcctgctatagctctttgatgtatccgaacgtggaggattactaggacgggattcagggctgtcaccacatgccgcctacctctgacaaatccgtggcatacacaacaaacaaaggtaatctctaacttagacaccacgtctaagttattaattactactctaatacttgcgcaagaacttccttctctatccggagtcctagtactagagtacttagtataaatactaaacaattaatccgcaaagatggaaacatatcttacttaaacaaagtaattaaataacataagaaagaaacacgaatgcttacttaatagaagaagtttctccgaacccggagcagattgtaccgacagctccagtactcctctagaattcctcctaggaagctacactcgtcgaggtagaagtcggatgagcgccaaacttctgggcactcctccagagctctctaccttattctaatgtacaaaagatacaatacagtctcttgtaattcagctcaaagttgtgtattgaaaatgagagtgagctcctccttttataggcaggtatgacggttacagcctatgcgaaatgaccaaactaccccggaaccgccattaggatgtgatcaggaccatccacatgaaatttggcgatcaacggccaccaaaatggttcggccgaacccgggacggctccatttggcccgtttttcatcgtggacactaattttgaggccctcagcccattggcatgatagttgggcccatttggagttgttaccaactgggactaaagataaagcatctttagtcccggtactaaagaggccagatccggttgctctttattcttttcttttcttcattgtttttaataaattgatttcacccccatcccatccccaaaatcccaaatcaatcatcctcaaattgcctctaaatccacaaatcgatcatctcaaatact

SEQ ID NO: 35265 - DNA, 4322 bp, Oryza sativa
cgatccgatcgcgcacgcctctctgatctccacgtcgatcttttttcccggttggtgttaccaaccgggactataaatagatctttagtctcggttggtaaccgtgagtaaagcgtatggcgttcttttatcccggttgatgttatcaaccgcggctgcttatagatctttagtatcggttggtaactaaagattgaaaagtgccctggagcttttaaaccgggactaaagatgtttttagtcccggtttttaatacgaccggaactattgtgaaatctggtcgaccgaccaaagatagtttctccaccagtgtagcggtagccaaggtggacgaggtagacagggcgaggcgcacaacagcaacagccgaggcagatgcaagcgatggtgatgatggaagaagctacggcgaacaaggagtagccgagatagacaagggcaatgagtgtggtcgcaggcggataacggtcgtgggcaaggcagacacaagtgatcgcaccagccgcgtgaacgagcatgagggaaaaggtctgacatatgtaggtgacggcggcggccacagtggaggagggaggtaggcatggctcacgcaggcgatgatggcatgcaatggccgcggtgacgatggcttgcgacgcggctagcgcaggtgcactattgccatggtaggcccacaacctcaggccacgcgtggggcgagccggtcgactatttgtcgcccactcattttcgctattcccttctctctcctctgggtcatccaaaaccgtaagtggagctcctaatgtctgttattgcaacttattgtacctactcttactgttttaattactttctaagataaatatcttgccgctttcttatcatcttcgtgacctgtttttaagcctcaaataatagagaaataaaaattaaatttataactttttttgtttgtttttgtataattttatgtggcttaacagcacgactatgagatactctagatttagacttttctaactttctagcagtaatgagagtgactttggaactcaatatgtagtacgccgtatatattaggcagagaaaggttaaatattgatattggtaactaacacagtatgtagatatttcttggacagatggggcatttcttagtacatgatttgttgtactagaaaatatcccatccatttaaaatttattatattttaggaccgaaggagtatagtccctaattggagtggacagatggaaatgggacaaactggagctcaccgggatggagcgacggctgcttgcctcccacacacatttcatttccttggacgttctctgcacgttctactgatagtgaaggataattttagaaggtattggtggtaccaaacaaaatagatagtattttatccgttttaaaatgtatgacatcgttaacttttcacataataattaatcattcgttttattaaaaaattagtataatatgcaaaagtaaaagttaacattatattttatttgatgataaaacaagttataatgaaataaatgatatttatataaattttttaataagacgaatggtaaaatattgtacgaaaaattaatagcgttatacatttcgaaattgagggagtaattagtatattaggtaccaaaggttttactagtatacaattctgctacctactagtcaaacggccggtcaaggtcacctgagagaaattaggcaggcagctagtgacctttttttttttttcggaagtcggcagctagtgacatcggacacctatccgcatctgtactcagagactgctcatttgtcctacaaataagctatactagccgggaccccgcgggttgccgcgggcataacaaatatatatatatttaaaactgtgaggtaagaggagaaggttcccacgattcatattaagcttcaagctttcaaaatatttccatcaaacttataccgaataacatcattgaatgccatcacaaagattttggccatagttaatttaccaaacttttaaacgattatatcatttgcaaccacaagctctgtagcacacatatgcccgttacgccatttacaaccacatacaaccgtgttgaaggctctggtcaatccaccccaaaccattttgttatcaattggccagcggataaaccaaacaaagctattttgcatacaaattggccttctgaaaaccatccatagatgaggctgaaagtttcttaaccaaaggccaccaccgatatggaacttttgttacttccatatgcacttgattgtgaaggattgacaactaattgtaaaatattaacataatcttgactatcttgtaagtgatatttacatgtatagttatggtatggagtagcccataggctaacacggtgtttaactaagctgcctttttgttttaactttgaggaaaccaaactgacctaaaatggttagattgcggcaatttgtttctagaaacggttgaaatcaatctgcaagagtataggagaatgtgcatatgtagctgtagaaatcctctatttcaaaagtagctctacaaatccaatagaatagttggtacacaaaacgtattgtacgcttgcaactaaatgagtatatgtaaattagaataatactatactctatagcctgacaaagggaactattaagactgcaggaatctaaataatgatgagcgccaataacagtgttaaggatctttctgcacagtcaacatatgcattatgaccaaccactggataaatggcgaggatgcacacatgacattcatcctttttcaaaattaataactgagctatcccaaagaaattaaacgattgctaaaatactttgaatataatttgtgctcataattacaaatggtgttaccacagataaatgtgttattttcttcagagagaagaacctggaagacttgtggtagtttactcccttggtcataaacatcggttactgaaagaaaatgcagaaatgttagaacaaattttattattaccttgatggttattatgaattgaagcctcatggtgatgaactgttcatatggcctcatttgcacataacagcagagtttgtactatacaaaatgaagaaatgccatcaacttatgtgtattcactcaaatgaaggccctcatcatcccataaatgctacaaaagcatatgcaaagccatggaacctataaaagctaggtgttacacatgcagttcaacaaatatatcactgattgaagaccatgaacctgacagtccatacataggcctcgtaatgtaagcaatcatggcatcatactgcagcaagcggttgcgatcaagttgaattgtgtgccttttgtactaaacatcaatattatctatgaaataataaattatcttccagcttgaatcaacactttattcttctcatttgtatcgccatgaagccaattaggaacactgaaggaggtagcaaaaaacaatcatcttatgtacaccaaagcagtaactaattattcctgtgcatgcacaaatagaacatgtgcaagcggacaagtagcacactgatttttttataggttgacctttcatggtgcattgttttgtggcatcctgcactaaccataggcatatggtcacatcgtacaattatatagggaaaaaatcaggccaatatctctttgtacatgatattttgctgtgtgtaaaaaatgaaaatatgtgctataacaacaaatggctgctaaacaaatggaatcccagcaagatatataaaactatcatgcatccctgaaacaatggggaatcatgtattttgaaagaaataggaaaacttgattgttgtttgcactttaggccaattgtacgggtagcaagcatatcagaagaaatatttatggattagtaggaatcatacctgtatagagagcaaagcaaagctaatctgagcagtaaaatacctactacagaaaggaataggtatatagatcaacaatatgaggaaaacaaaatgaacctaataagcatcagtgtatacaaagtagtagaggatggcagtaccaattggagaggtgtggaggagccgatgagcattagccacaagaagcgaggagatggccatggacgagatggttggtggcagtgctgaccattatattggctccacgagaagacgacagcggcagtcggctccacagggaggtggcgcagaatagtggctccaagggaagggagcggcaccgctggctcgacgatgacgaagcggcaccgggtcgctggcaagtaaggcaagaaggcgacaatgctggctggctcggcaacacggcggttg

SEQ ID NO: 35266 - DNA, 654 bp, Oryza sativa
ttcaccaccccacttaataatcctcccaccggtcacaattcacaaccaaattccggtcgaacttttctttggggaagggaagaaacaaacaaaggttgtcaaggcagtcagcactcaacagaccatatgaatatagaataagacatgacattgcttaatttgaacaaacatgttagtaacacaaaattagtgattgcaaaacattattttattattagcacacgtactgcgtgcagtgcacaggcttatagaaccgcacttcacacaagtaggttgtaggcacaaacatgacgaaagcatagaacataacacaatacagacagacaggacatctcattccaaatatacgtgatgtataacaggagcaagcagcgtccagcgactgatgaatacgttctacaaaatcttgtgtgcgctctgccattcagctattttggaccaggactttgtatttgaacagatgaaaacaattactgagctttccaagatgacaagggaagggtctcagaattttggcaagtagtggtgggcatcgcctgaggataccggtcgcctcgaacatcatctgtgccttgcgtagactcgagttcaccatttcctcaggtgtgagcttcacagatagtgctccaattgtttggttaaaatctcgatttt

SEQ ID NO: 35267 - DNA, 572 bp, Oryza sativa
gaaataccatcagaggagggttatctggagcaagtgcctccgcaacaaattgtggccccaaagatgaaccaccaattcctatagaaagtatttgagtaaatcggccagcaggggaagatggaggtcttatctgcattaagtaaaccatcacaaaagtagcatgataagttgacacaagacataaaacgtacctacaaaagatgcaatgtgctaatgatacaatattgtattgttacgacaagtaatacaccactaagttgtttggatgctctgttatcccacatagaaccagaacttaacaccactaaggccctgctcttttcagccacttcactggattattgtcacggaaattgtttcttctactgcattgtttagttctcttgttgtaaggtaaattcatcaagtttatttattagaatacttaatttatatccataatcgtgtatataatccactacaataatccggccaataatctgttgactacaatgctaacaggtcaaattattaaattaattaatattaaccccgagaagcagcctatccctatgacctattccatgccttat

SEQ ID NO: 35268 - DNA, 1355 bp, Oryza sativa
gtcggagcatgaaaggactgtgtttgagaaactggtgggtagaaacccggaaataacacaattcgaggatcttacaagagccgggctagcaattgctgatgaagatccacaatatgacggtgccttcgaaccaatgtgtgatgaaccaaggaaggggttggagttttgatcaatggaagatctgaagatatggctgcagagttattctatccgtgtccaccggccttaccatgtcaaggaatctaacgcgtcagtaaagtatactgtggcttgtctcgatcgccgttgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctcctgtagctattgtcgaggcagttgagcaaatctggcactatcggcctacatatggcaaagcttggcgtgctaagcaagttgctatgaaggtcatttggggagattgggacgaggcgtatgttcgcttgcctacactgatgcgtgccatcaaagcaaggaaccctaccatgagtttccgtgttgaggctcaccccgagaagtcaaggatggtggagggagtacagaggcgagtatttggacgtgcatattggatatttggccagtccatagaagcattcaagcacttgaggccggtgctagcaattgatggcactttcttaaccggtaaataccaaggtacattgctcatggcaataggggtcgacgcatggttacatcttgttcccttggcgtttgctctggtagagaaggagaatacatccaactgggagtggttcatcaacatgttgagacacaagctgatcggtcctaatagagaagtgtgtataatttctgatagacaccctggcattttgaactccatcaaccacaacatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacggctattgggtgtggtcggagagaggccaaagaagtggctagaagaccatatggcacttaaggtcaaatgggcaagagcatttgataccaacgggcgtcgccacagcataatgaccagtaatatggccgagagtttcaataatgtcttgagaggcattcgaaaactgccgggtacagctattgtggcatacacattttccaagtgcaata

SEQ ID NO: 35269 - DNA, 8054 bp, Oryza sativa
  unsure (1)..(8054): unsure at all n locations
ccacatgataaccgtttgtaagttgcgaggtttggatgtggaggtggccccccgaatgtgttatgaagcttccaatagggctgtgcaggacacgtactcccctaggtttgaaccttacctagatccatcgcagtggccaagttatgatggagagttcttcgtttcggacttgtcattgaagaacaacacacgaggaagaagaaggacaagaaggttcaagaacgacatggacaaagtgtacaaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtaggacggggggaggtggtgagggtagcacacaggtgggattggatgacattcatattttttaatgttttaaatttagtttgcattacatttgttaagttcatattgttgcttcaatgtttactttctgttgtcctcctttccgttctcattgtgatttttccatttattttttttttttttgcaattactgatgattccattttcatttgcaggatggagcactttccggggttggaggatttctacgaggagaagcacagggctccccagattgtgagcggagaggttagcatcaacaatattccattttttttatggttgaatttattttttcttctttgatttgattctgtatagatagatcaaccatcatagagatatctcaaatcaaacacacacaaaaaagaaaaaaccccattttttttgttctgtttttttcacactgtacatagagagagatcatgattcatgagcctcaaagcagagcatgtaaacacacacaaacaacaaaaactgatctgaatttgtttgattcattttgaaatctcagcttctctttgtccccgttccagaacgcccaaatctgagcaggaaatagttcgatttccgtatgaagcaggtcccaaatgggccttaaacttgatgagttcagttaagctgcctgaagtgtgacacaacaaatttgatgatattttgtacgtcactgtatatctgttttgcttgggaacacaccagttggacgatctggcagcctggcacaattcatcaaattttatcattttgtttatttatttatttataacgtatgcaaggatgccatagatcttcttttcagttttctttttcctagaaaaatggcgtccatgcaacaaagcatcttaatcagataagctaattttcatatggctaagataatcttgccactgaattaagatgtgctttttccatgactttttttagtacttgggaacatgcttaccagtatggtaagtattagtgctggtttttaaaaatagtatttgagatgccaattctactggtcatacagaactagtacttagctcaagattgctcataatgagtagtagttgcttgtattacttgatcataatcacagagattcctgctgacccaatcccaaaattaaagttcccagttgcttgatatattttccacaacccttgtatatgatatattgtcgctaactatatgttgttatgtttgtctattgatgcagcgcttgaagaccctttgagttagaggtcacacggcgcacatactgttcgacgaccggtacgtcccgtacctacagcgggcgaagctcttggcgttcgtgaccatggcccagcgaccgatgcctctatacaacgccgctgctctgacggccctcgtggaccggtggcgtccagagacacacaccttccacctaccgtgcggggagctgacggtcactctggaggacgtcgccatgatcctgggtctacctatccggggtcaggcggtcacaagtgacacagcgtcagggaactggagggagagggtcgaggagtaccttggtgtggagcctccagtggcacctgatggtcagaggcagacgaagacatcaggggttcctttgagttggttgcgagccaacttcggtcagtgtcccgccgaggcagacaaggccacggtacagcgatactgcagggcgtacgtcttgtacatcttcggcagtattctgttccctgactctggtggagacatggcctcttggatgtggctgccgttgctcgcggactgggacgaggcgggtaccttcagctgggggtctgctgccctagcctggtttaccggcaactctgtgatgcttgccgaaggcaaggcggggacgcgaacctagcaggctgtgtttgttgctacaggttagttcacgcatattatgtttcgtaacatttcaatttcttgctaaaaagttggaagctaacgtatgtgacgcaggtttggatgtgnatgaggcttcctgttggttggcccatgtggaggacccatcaggtttggccgcaccaggatgccgaccgacgtcccactgtagctcacctatgggaatcggtcccatctccagtagtaggccgcaggaatttggcctactaccactacacaaacgagatggactatctacagccagaacatgtaagcaattcaccattctatcacacatgaagatggtttcttactatatagtactaaatgtgcttcaatgtgttttatttttgttgctgcaggtggtgtggatgccatatgaggcacaggaagtgctcgagctagaactaaatcccatgtgccatatagaggatgcgttgaagaccctacggtgcccactgatctgcttctatgcagtggagttccagatgtgccaccgcgtgatgtggcagttcgggaggcttcaaacaatcccgcaccgtttctccacaagtgtcgacctacacaagttagtaatttcacttaaaaatttattttgcttgctcagttattttcacatcaacatttattaaatactcgagttggatattttgcatatgtgcagggtggaccgtcggaagaacaagaaggtgactgattgggcttactaccatcaggatcatatcacgcaatgggagaagttcgaggagaatggagtaccagaccagggtcagcacaacaggacagagttcgacgtgtacttggcgtggctccacaggacctaccgtcttgtcctacgtccggcctggacgctagccgacatagcggatgaccccgaggatgttgagaagcagagcgagtacgatactcgtacccgtcaaggtaccacggtcgagacgggacctgttcgcgacagagtggttagttctagcattaatgttgtgacttacttcatttcaacgccataaatgttgtgacttacttcatttcaatcctgcaggctcgagagctcttgcggaccgtcaacgatgcgggagtggcgctaggcacggctcctggctccgaaggagagggcggcaccctccgcaacgccctacaggtaatcgttggaataagagatgaaactacgttgttttcttccaaaatcgataacttaacagggattatttttgatacagagactacggcagcggtgtcagaagttggcaacaaggctcggctgcaggtcgaccgatgtggtcgaacatgctcatgcccaccaagagagggatgaagaaggggaggtgggtgacgaggagggcgagcaagacaaggaggcggaggaagaaggagatgaggaggaagaaggggatgaggaggaagaatgggatgaggaggaagaagaggaggcggatgagctcggtccctcgcagctggaggacgcaccagagtcatcacagctagatctctcgcaactcggcccgtctcgaccacgacgccggcaggctccttcgcaggactggaggtacacccccgatgtgcctcatcctcgcactagaggtaggaggaggtgagtgcatggttcaatggatggatggatggatggatggacttgatgcatggttcgatggatgtatggactagaacttttgcttgttgtgcatgaatggatggatggatggatggatgggatgtttttatttgttatatgtatggagttaatgtatggatgtattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatccagaaggcttgctcggccgggccatagacgattctgccaaattccatccctattgccagcgccattatggttatcgttgagttcctagcccgcaagccatccagaaggcttgccgggctgggccatggccgattcggccaagtcccacctcagcaccaggtgggctggcgctgaggtcccttagttcagcgccattatggctggcgctgagttcctagcccgcaagccatccagaaggcttgccgggctgggccatggccgattcggccaagtcccacctcagcgccagcccacctggcgctgaggtccctaggtccagtgccaatgcagttggcgctgagattggccatcttagcgccgatgcagctggcactgaggtagctgccacgtcagctgggggatcggcccggccgccacggtggcacgatatcagcgccagccccattgacgctgacacgaccaacctcagcgccaatgcgcttggcgctgagtcgacggcctatttttggttgaagtttttgacaggggttagtttcgaaataagtttttgaaaagggtcaatttgtcaaaaaaaacggggaggagtacttgtgtaagaactaagaatattgtattgcttcagtttaatacaataaatcgattttgattcgttttcttataattttaaagttaaattaagtctacagataaatgtagtaatatttcttaacacaaaacaaatatattatcagaatatattaaatgttacttcccctccatatttttatgtattatgacgttgttgacattttaaccaaaatttaactattcattttatttaaaaaaatttatgtgattattatttattttattttgacttgatttatcatcaaatgttctttaagcattacatgaatatttttatatttacataaaaatttgaataaaatgaatgatcaaatgttgataaaaagtcaacagcgtcatatattaaaatatggagggagtagtatttaggaaactaatttacaagtagtatgaaggggagtagttacaattatttctgtaatgatgcccacacgtaataccatatatgtcatgacagagaagctaattaagctgatcatttttatctctgctacatttgtgtagaaaaaaccgactaggggaatgacgcattggcgacgacaaaggtgcagcaaacaatgctctctctttccttccccttcattgccaagtcagatcgatgagcgccagaccacccactgccagatctaagggacgtgtcaggttcttgatgttggtggagcttcggaatagatgacgtcacgacccgcaccctctttatatttttcaaactagctaaagaaagatctgggtgcccaataaatacctatatacaaaaaaatcatttatagggtgggcctcttaacagatccacctacgaaaataaatctattttcgcagggcagcccgtcctccccctactcttttctctcctctcttaaaaaaaatctaagccctcactactctcccatcctccaccgggtagcgacgacaagagcagccgcgatgatgggaggggtggcgatggcagctacaacatgagcttgagctggcgctggtggccccgtgcctagctgattcggtattgtagtgggtggatctgtggggggcgggctcatggtgtgattctggcagtagctcatggggggggttttaggcagctgactctgggaggggccaatcgggaaatggtggccagcgcttcgaggggtggaggcggtgggctactgccaatgggggcaaagcttgggcgaccacacttcatttggtgagctctgggcttttgtgggcctcaggagttccaggaacagcgacgatgggggagtggtggatccaccaccacggagcttgagttcaaaagtaggatttcatgattttggaacttttatttatgttattttgtgttttattttgtgaaagcagtcaatataacttaatcgtctgtgaaaatcactttttgcatacaattgtgcagccggcttgaaaaatgctgatttctacatatacctgggttcaggcagttgctctacccatttgcaaaaatgacttttgaccatgtataaacatcaattttcctcatatacctcttcccacgcatcaagcagtcaatactaagggtgtaagtgactaatccacgaaatctacttatggaccaaaataaatcatgaacccacttatttagacttacaagtaggttcgaggtttatccacttgcacgatgagccaccgcatcctcgttggtcaccacaaccgcatctaagttctccttaggcctggtttagttcccaaattttttttctaaaaatattacatcgaatctttggacacatgcacggagcattaaatatggattaaaaaaactaattgcacagttagggagaaaatcacggacaaatctgtttagcctaattagtccatgcatgattagccataagtattacagtaacccacatttactaatgacggattaattgtgctcagaagattcatctcgtggttaatggatagtgtcggtaggagtggtaataaacctaactttttaggttataaaattttgagagttgggtctaaaataaggtgggctcaatttctataatgtttctttgtctaaaaatatctgaggtacctagagttgtgaaaaaacaaaagggtcttgacccattaacatctctaagtgtccagtgtataagttgatggctggatgaaatttagaccagttcaaaaagtttaaggatgtaaaaataaacttccttccatatataaactgcttatttgttactttgtatgctagtggtagtcattagctcacgacaacagttttcagtttaatttcaccaccccactgaatagtcttcccaccaatcacggttcacaaggtaaaggtaacataggattagacatgatagtggttaatttgaacaaacatgttaataacacaaattaaaactggtgatggcaacactttatttaatattaccacacattctgcgtgcaatgcacaagcttatgaaacggcgcttcactcaagtaagttttacgcgcaaattaaacatcacgaaagcatatgacacaacacgctacgcatagatcgacaggtcagctcattccaaatacacgcgatgtagaagaacaggagcaagcaacgcgtctgatgaaacacttctgatgaaatcttgtgcaacgctcttccattttgaaccagctattttgaaccaggaactgtatttgaacagacgaaaatgatttactcggatttccaagacgacaagggaggggtctcagagtcctgccaagtagtgttagccatcatcagaggataccggtcgccatggacattgctagcataagactcgagttcagccatttctgcaggggtgagtttcacagatagtgctgcaacattttggttgaaattctcgatttttgttgtcccgggtatggggcacacatcacgcccctgatgatggatccaggccaatgcgagttgtgacggtgtgcatccttttctggctgccatttcgttaacacgctcaaatatttcagcattcttctcgatattacctggttgaaatctagggataagctgcaaaaggcaccaatacaagttgttagttaattgaatgagaattcattatagttctacttcatttttcaaagactaaatagacgagacgtgaatatgcagcacaaagattagcttaattggaaaaggct

SEQ ID NO: 35270 - DNA, 12503 bp, Oryza sativa
  unsure (1)..(12503): unsure at all n locations
taattatgttacaaggtttcaaaatataaggtctgaatgcctatttaatgatctttcttctcgtttttcctacattaatcattcatttctactccatgtatgagtaaactcataaacaagatttgtttcaagaaaggaaacaaattaatttctgttcttcttattctaaaagacattaacacgacaggtatcacagcattttccctaacccgttctgctattttaatgacctccttcaaagccattcttagggaaaactgagtgattagtaatcatggaaatataccttgcgaaaatcatggtctggtagagaatccactagtttagctccactagaaaaaaaccctttaccaagtggactgtaagctactattccaattccaagttctctgaaatgaaaattagaaaaatagttaaaatgcagcatgtgatttttttttctcaacagacaaactaatttgttttttcaatgcctgcaagttggaacaatatcttcttcgacgtctctagaccataatgaccactcaagctgaactgcagtgataggatgtacagcatgagcccttctgattgttgatgccgatgcttcacataagccaatatatcttatctttccttcttcaactagtttcttgagttcaccaatctaacaatgtgaaagggaaatcaactggataatcttgagaagaaaggtcattacttaaaaggagtgcatggttctcaggacaaaaataaaagatagttcagtttatagacaataattacatgcaacgattatatttgtaaagaaaggcaaaacaactagatatcttgagaagaaagattattacttaaaaaaagtgcatggttctcaggacaaaaataaaagatagttcagtttatacacaataattacatgcaacgattcgaaaatatcaggagtaatagcagttcaggtgctacctcttatgcgctatcaaaaagatatagcacaccaaaatgatgaaaatgcatgtgttggtggatatgttctaataactattgctagtttgtagttaaatattctgaaagaaaagaagtcttcttcactgaagatatattttggttcatgtatttcttcattggtttttcgattgttaaactttgaaatgttgggttggttggtggtggttaagatcccagctattacaacaaccacaatgtgtgttgtaacttcccagtgatatgtcagtgaatttactttatgttctttacccttcaaaatcccacagctaatgtctaaaaattgaaaccctgccctatatctaaaaaaatgcaatacataaagggaaagaaaacattgttaaattatagaaaccatctgtcacatagggagtactgtaactgcccagtgacatgacagttacaatggaagatattcataagatatttttcacgcatttgtgctaaacagagagatcttaaggcaaataatattgtacttcatacctttataaatgtatgattcaaacacttgttatgaaaaaacaaaaagaaatatatgcttcattttgtattacaatgaaaaataatagcttattacaatgaaaatttaatacatgaggttaaaaaaataacgacaaaaggacaggtgccagaaaatggagcttgatttggccttccagaattcaggccaagttgctgccggaacaaaaagtcattgtacaattaaccaaacagacgtaggattttaagggtgcatcgagccgggttaaattttcctcccttcaaaattgacgtctcctacattttgttttattttaacgaccaataccacaaagtgcgatgattcattaaatagaataggaaaaaaaaaggctagcaccctggaaagcagtagctaggaaaaaaaacaacaccaccacgcaccgatgatgcctatataggatccaagaaaaggctagcgtcgtcggactggccgccgctagactaataaagaagctaccaccaaaccgcccaaaaccaaaacctaaaaagtgaacaacacactcaactctatacgtatcaaaaggattggaggggagagggaaccactctccccctcaaggcccaccaacatggtcagcttgcattggctaggtgctgccgcaagcccgcaagaggataaacatctagagagagcacgcgcaagctatcagagagaggtttcagcaggggggcctcctagacgacgtctccaaggagaaaagcgacagaacccaagagggaaaacgatgtccgaaacgccatcacagccggctggcaagaccaggctaggttttacacctgccacgcactccctatcgatccgcggatatcactccattgctccaccaccagccatcctccatcggcatgtggccaatactacaccgaccccccttccacccctggtcagtcagcctcggcatgccttgtggcacacaccaccatcaccggcctcattgttgtcaccgtgtagacctcccgtgccgtcggctgggctagcctccctgcagttgcgcacgccaacctcctaacgccttttgcgccgacccgcccacattgacctctcccaccattgccccgtcaccgccaggcgtgcctcctagcgccgctgcgtcggcctaccaccgccaccagctgctcccaaccagcaccacgcttcctcctatccctaccattgtttccagtacctttctcccgccgacggcacttcacgagcgtgccctctgtcgacggcacgtcgtcgtgcccttactgcctcgccccgccacctccacgcagccgtaccccttcgccttgtcatcgttgctggctcaggagttagcttcccaaggcgaggaggcaaaatccggatgggatgggaccagatttggcagctgcacccctgcggcctccacgttcacgcctccgcatccacgtagccgtgccccgctgtcttgctaccgcatccggcttggggaccgacctactgcaccggggagcccggatccatccaggacggggctggatataggagtcgatgccagatccagtggcgccgccttgccgtcgtcaccccggtccacctaggcatcgacgctaccactctcctctttaacgccggcagctccatcctagcaccattatggctgtcgtcacccggagctagtcggggtcgtgggctccgaccccgctaccacggaaaaggaaggcctcgctgctgccgttcttgtggccgcacggtttatggcagcccgctcgaccctgccctagagagcgacacggagccgttactaataatgagtcttatagtttgttttcagcaacatcataatcctccctccaattagtttttccaatgatttttttgtgtgtttggcgggtgttgagggtgggggcagggggcatcaataaaagatgtctcttgacaacaacctaccaccacctacattccctttcagatacagatggatgtttcacttacatataacaaaataaaagaaagggaacacaaacatagaggggaaggggcaccgaccgtgacctcgatgggcaccttcttgtcgacgcggtgctggtagtaaaggtcgatgcaatcgacgccgagccgccggaggctgccctcgcacgccgcgcgcacgtacgccgggtcgccgcggatccccggcttgccgccggcgaagaacttgccgaacttggtggccagctcaaccctgtcgcgcacgccgccgccctgcagcgcctgacatttcgtcgagcaccttcagcgcgcgctcgcgcatgcacaaattaagcccaacccctacccgagcaatggcggggacacagtggagaggtaggtacgtaccttgccgaggaggacctcgttggtgtgggggccgtagaggtcggaggtgtcgaagaacgtgacgccggcggcgatggcgtggcggatgagcgccaccatgtcggcctccggcttgggcggctcgaaggccgggcacatgcccatgcagccgagcccctgcgccgagacctccatcccctgagagcccagcttcacccgcggcaccgccaccgtcgccattgcagcagctgccattgccacggccgctgtacttcttggctgatgcctatatatatatttttctgctgtgtgtcactcacttatataatgctgcacactgggagatggaaaaatggctatattcaagatgattgaacatttcaattgctgctgctgcaggcaggaccaaacatgtcagcatcgaccaacaactggctcactctggcctgcttctgaattttttgttgacgaataccaccctctctgacagtctgactgactacctgaagaagataagctgatatcctgtgaagcagatagatctttaaatttgcttgtgaatttttgttcactgtaggttcttattttgatggagtgcacatatagttttgacagtggtgcagtagctcatagcttacacatagctgaagctgagtacacttttctttggtttgaatcatatatatatactgcaagatgtggattttaatgcttcggtttcaggggaaagtgaaatcatcccgatatcctctcgtttcgtgcatatcacctaaatagtcatcaaaaaatatgaaaaaaaaattggcaacatagactaatatgaaatatatcaaagtttaaattcaacttctacaagttgtaaaaaaaataataaatatagttgcgaatgtgagataactattttcagtttaatttattatttttgttgcaacttatagaagttgaatttggtcttgtatgtttgtggagtgatatatttcgtattaatctatgttgtcaatttttttcaaattttttaacaactatttagatgacatgcaaacaacgaggggatgtcccctagggataaaaatccacatcccggtttcagatatgtttcagagatatgcaactttcttaattagctggttcttgtttgtagagattaagaaatatagaaattcagacatgtttcatgccaaatgcaggtactccatgtccgagccagcttcctgatataaccacactggattctgatgctacatccgaggcggcaacttctagtcgatggggctccggcactttaaagttacaaatagtttccatttttttggcagaaatttgccatgtgagtatgacgaatttgaattccatcagtattatggaatagtgccagtagagtgatctgagcatgacaaatttgtactttgtcagtatgatatatagtaattgtttccgtgatgccgattggaataatggtggctgctcgcggatggaatctaaatgtcagtttgtttaattgcatgtttcttcgttctgaatgacaatctgaatgtctgaacaagtgccaactgccattgcattagtctgaagctactcacaacctagaactacatgagtgaaattgaagctactgattgcatgagcaatctgaatatactgaagctatattcagatatgtgatgcttcatgagcatcatgtgattttttttaatatactgaagctaaactgaaaatgttctgtcttttggactcctttcacacatcaatcaaggtttcacaataattagtactccaactaaatctaattactcaatacttcaattcagaaaaagtacattcagagagaatataatactagtacttcagtttgaaaaaaaaaatatttcttgtgtcagttatttcattgtgtatgtaaaactgattctaatcaaaacactgctgttcaatccaattcaattactccaattcaacaaaatctacaaacttcgctgctcgtatttgaaacgagcaatccagatcatctggcacatatcatgtgggactggtacatgtcagtgagcagtactgcggagtaccctcactcttgaaacgagtgatagagacggtcgagaagagggaggaagaggcagcagctagtggaagtggttggcgagcccttgaggtgttcattctcaacgcaaaactttccggattcccaattaagcttcttgggccgtcgtcgttggagatcatcacgccatcctgcagcgacaactgtttgctgttgggtttcccggccatcaccggcgatctgcggcggcggccaccgcggcatcgacggaaactctgccactgattgcaaaaacatcaacacaccaacaaacctcgatgttagttaaaacatcactagctctcccatatctatgctcccgcctttgttggagtggcgaaaaagtttgttttttttttaatcaagatgacatacgcccatgcattaagattttagaacgtgtctatctacttccaacgaatatttggaacagagaattactcagaaaaagagaattattttttttctaatccaccatgtcggcctccggcattggacgggccgtagaaagcggacatgcccatgcagcccaggcccactgcgttgagatatccggcccctgcgagcccagcttcacgtgacgtgaggcaccgccactgccgccgtccccgagaagccggctgccgctgccatgcatggctggccggatcagtcgatttcttactttgtagtgatgctacctgggctctgcatggccactcacatatataaggttaatgctataacaatgtaactgtagtatgtaagggtattgtttagaagagattaagattctaaaaagctgctggttggtaatcagtttttagaatatagaaaagtcggggttcccagcttccgactttattcttttttggattcaacagctatagctttttaggatctaaacgaaaatgtcaactgtttagagagcttatgattataagagaagttgcacctgccaaaaactttctcaaacagatcctaagcgtcactgcatgggtgggagcaggagcatgtgtaagagcttatgcgtgcgacgtgactcgttttgaattgctaactatcacccgtagggctatcaaaaaaagctcgaggctcgtgagtcacctcagactcgattcgagctcggctcgaactcttaacaagccgaaccaaagcctagctgcaagctcacgagttttgtcaagccaagctcgagattcttatgagtctaactatgtgtgtaaattttttatcttttatatgataagttagtagctcaaggacaaattagtatatattcatgtgaaaaattagtgtattttggcatcatatataactttatcttcaatattattgattaaattttttttactaaatcttatcaacaaaatatacattatcctataatcgatcgagctcgcgagcctaaacgagctcgagccgagcctgcttaaaagctcaaaagagaattaagctcggctcgagctttgtcgagcttgagcccagacgagcaagctcggctcgctgatagccctaaccattgacttagcatattaattgctcctatagttttgggttatacgacaaaaagtaggtaaacctctctttcttactgtcaacgtaaaccagaggcggatctaggaacaaaaaattaagggactcaattatacagtttcttcaacctccagccatttaggaagctttagtttatcattcatggtgaaaaaattagagggggcgctctgcgggtatatatccatgggtcttgtgggtgtaggggaacctaagtccccctgcaccacgttggatccacccctgaacataacagctggaaggaacatttcaatttgcaaagtggccatcctgccttgaattttccatcttagacacttccctttctaaacgatattgcatataatcagttaactagttactccgtgtgtcctgtgtagtctttggactaaagatttgtccctagagtttagttttatagacctcttcaatagtaattttatcgttttcttctcgttatcaaccattgagacactttaaactctgtaaagagacttcttagaataaaaatatatactaaatgactaaatataagtaactgaagacaaatacatataagtgatgacttgggattgagttggttagtgccttgaagataagtatgatttgtgcaattgatcatgagttcaaggattgcaaaaacaagagaaaatattttattttattttattttttcattaatttcatattattgtggtacaatttaatgtatctagaaaatgcctctaccatcttatagacattttataaaatgcctcttcgtttgtacagataattcaccgtaaggcaattattagatatttttttaatatatctctatagtattgtaaaggcattttaaaagtgtctctatagtattagaaaaatgtctctacaaagcgtttttcctgtaataatgttcggctggaaattccacacccatttcctaattaaaaagcaacggattcaatatacctatgttgcagcttcatttgtactattaaaaatttatcccacaaagactatttatagcgttatagcctatcaagttagagcaggtacaatagggttcagatagctggaagaaaaaactccacgtaagcatgaacgctgagttggcgaaaaaagagaggagagagaccatcagttgctgactaatttgccactagtgccacacgcactctaagaaaaaatagtctcaccatttgatctctgcaccatccaaaagtgagatagaaatgaaaggaaagagaagataaagtaaataaagaataaaacattatttatatggagagatgggtaaatgtattagagcctacctactgtatgtacttgcttttatattatatttacctgacgtgagaaggattggagccagcagcgagcgcttttattagacttgctcttaacacatacacatttagttgaagcctagaaaatggtaccaagagtactaaaagcaaggtaatagtaagtaagtcaactatatgcatatgtgaaaaacagagatttattactcaaattaacagactcataatcggtacaatgagcaaataattattgcaagctctcgataaagaacaatctattgttcaacatggtttgggtgttgccagaactgtcattagttaaaactagaacatgctaatttgattcatgtatgaagatcgcatgagtttagggtttatttatggactgctctatgtggtgttctaactagttttaacacagttgagatgaacatatacatgctcggttttcaaataactgaacaatttaactttactattataaactttaaccaataattacttggacataatacacacttaattatcagtgtattttattagtgtctgtaaatattttgctaaaaaagaccgatggtgtcaaagctcgaaagcagtatatattcgctgactaagcagtatatattgagtaatatctttttttttttggctaggagtattgagtaagaataactcctgtcaatcggcaaaacaaaagcattttcgtgtgtatgcatggataaatagatagtttattttaaacattgagatgatccttcgccctttgctttaattaaaaggctataaccaattattgcataggctataggacgaatgactgcgacttacaaattcaccatttgattaaaaacaagaaagctatttaaactatttagaataccaccttaaaaattagatagcaaaataatactcagttgctgcatctatcctacgaagccggccggctgcatggacagataagatactaatataagagtacagagagtacaaatgcttacaaataaattatcagctgagccggctgagagagagttcatgtatatatgtgtgtggatcataaaaagctaagagaagaagagggagcgtacagccttggtgaaaagggtagtaggcgtcgcaagtacttccaccatctaacaactaaaccgcccaaagctgtactctctctcttctccatttagccttcacgatatgatcgtctatcgatctccttctcttagttgctctagaagttggatccctctgggtttatatagcacactagcatcggcaaaatgacactattgtgacgaatccatttattgtaatgcaacaggaaattaataattgcaccctccatcccaaaatatagaatcggatggaactcaacttagtactagattcatcgtaatatgttgagttacatccaatcctatgttgttactacctccgtcccataataaatgtcgctttgactttttgcttacaacgtttgaccattcgttttatttgaaaaattggtgcaaatataaaaaagtataagtcatacttacggtacttttgataataaagcaagtcacaaacaaaataaacaatagttccaaaaaaatttttgaataagacgaatgatcaaacattacaaactcaaatttaaagcaccaagtaatatgggacgaaggtagtatattttatgagggaggtagtaattagttagtcaacatcatcttttttttctcgttcccgccagcacatatatacatacatacggagaaaaagggttggtagagagagcatcattaatgtgtgtaatgtgtggtgatgtggtaacttctaactagtatttaaatattaatataattcatctgttttcaaatacagctagatataaactaggactagataggggtttatactagattgtatttaatctaatagtgttaggtttctatatttatattttaggatggaaatgttatataatatagttacattcacttgttcatgcatacgggtgatacaagttatacttcattaaaaaaaaataaagaattactacgaagtgagcgtaactcaattggttaagtttcttgtggtaaactagcccacccaatttaagtactagacttaatataaatgctcgtatttacggttaattattctttcagtgctagacgacatacccgttgtacctttataggggtaagcgtacgcgcgttgtgaggatatgtatttatattgtgctttaaaaaaataaaaaaatattgtttaaaacattataaaggagaaataatattgttatagcggtaaagtcgtcagcgtgtgattccaaccgtaaacatttctaatcgcttgggctaaaaaaccaaaatttaaatttttgaagttgattttaaaattggttttaagatatttttaatgtaaatttttttaacattatataaaaaatttacgtataaattaatttttattttctaataaaccttttgaatttattagggaatacgagctgccacgaggctctgtgtgtgcatgaccagtttcattgtccttggaaaatataacaatggctagtagtgtcacgtacgcgtgtgatggatccaagttgggcatgtggcatgcagtgcaggctgtagctaaggccattccgtcgtttttcgcgagcctccgggctaacagcagccgtccaaaatggccggccggctttggaattggtccatcaactagctagctcaacactgtacaagccgtaaattttttaccaacctgcactacaccgatcctctgcactccaccgatcctctcctggagtttgcattactccctctgtcccattataagtgacaccgtaagttttcgtgcctaactttaatcgtctatcttatttaaatttttttataattagtatttttattgttatgagatgataaaatactttactcatgacttatgtttttaaatttttttaaaaaaatcttcaaataagatggacggttaaaattggacacggaaaatcatagctacatttaaaatgggatgggatggagtacctaatttcgcattacccaaaagggcatatccaacaacctttgtaatggagataacgatgagaatctttaaaagcacttgagaatctaaacgtgtgtttggttcggaatgagttgagatgggtcacaccaatttatgctttttatggaatggttctattatcttttggcatgagattttttttagagatgggagggtatagccagcatgttattgaaaaagaagtgacttagattagtaagctacttaagcttagttagataaggaaacattcccattcagaaatcaacccatcctacctattctcaaactgaacaccccgaaaaataaaaatgaattcccgtcctatcccatcccaatgttcacatgctaaactgttggcaacagctttttcacaaactacctattctcaaactaaacatccttaaaaataaaaataaattcccgacctatcaaaccaaacacccttaaaaataaaaataaattcctgacctatcacatccactgtccgcatgctaaactgttgggaacagctttttcaccaatagagcaaatagattgaggcatggagttcatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35271 - DNA, 521 bp, Oryza sativa
tattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatacaaaggcttgctgggccgggccatggccgattcggccaagtcccatccctaggtccagcgccattatggctagcgttgagttcccagcccgcaagccatccagaaggcttgccgggctgggccatggacgattctgccaagtcccacctcagcgccgggtgggctggcgctgaggtccctaggtccagcgccattatgcctggcgctgagttccaagcccgcaaggggtccagcgccattatggttggcgctgagttcctagcccgcaagcca

SEQ ID NO: 35272 - DNA, 390 bp, Oryza sativa
ggcggtgcggcgcgtgaagctgggctcgcagggcctggaggtctcggcgcaggggctgggctgcatgggcatgtccgccttccacgggccgtccaagccggaggccgacatggtggcgctcatccaccacgccgtcgccgccggcgttaccctcctcgacaccgccgacatctacgggccgcacgccaacgaggccctcctcggcaaggtacgtatagtaccttcctcttccttccactggtgtccctctctttctttgggttgatttgcgccatgcgcgagtagtggtgcgctgaaggtgctcgacggaatgcttgtttgcatatgggttggaaaaaaggcaggcgctacaggtcggcagtgtgcgcgacaatgttgcactggccacca

SEQ ID NO: 35273 - DNA, 721 bp, Oryza sativa
gcccatttcatagcagtagagtagccggccaatgagaccagagaagcccatcctgtgaccagagccttcctggatactcctgaatttagcatatctacggttaccgtccataataaatgcaatatgtttaggcattgggccatatgagaggacagctacgatgcatttgcggataaagttttgcagactcgcaaggacaccagtcgcaattaactcatcagggttctccgtctttggattctaaatgaaaaaagcaaaccagaagtatacgaatatcagcgaatgtcagcaataagcacaaaaaaaaagtcacagatctttgattatctttacatgactaataatgtttccacctgggtacttgttcagcataagagattaatctatatatcactgcatatgaatctaaaacttaccactgaaggtgagtaagagataagtgaaccaagcattttgatggggagggaccaacaggcagtatcaggcctgcaaactggaaaagacataaaattttcagacttgcttgctctgatcaagaaaaaggagcaagcgtttgccattggaacaggatacacaaagaagctatagattgctactccatccgtttcacaatgtaagtcattctagcatttcccacatttatattgatgttaatgaatctagacatatatatctatctagattcattaatatcaatatgaatgtgggaaatgctagaatg

SEQ ID NO: 35274 - DNA, 1537 bp, Oryza sativa
cagtaatgtagtagtacgtatttaagctgatctagcccttttcatccatgttcaacaattgacctaatactctgataggtatatacagtgtcctgcttctgtggtcttgtacattttccatccgattgtgatggcccatccgatcaccggctagcgacgagccgacgaccacctcacaaaagatttttccagtatcaggccacacagccacacaggggctatagctcctagacctgatctgtgttaggggaaccaaacattattaaatcgttagtttcttaagtggagtggaagaatttgctctagaaaaatatatacgaaggatgaagctaatttttttcaagctacacaactctagcttgggagtactccctccgtcctataatataaaaaatttaatattttatttacactgtttgaccactcgtattattaaaaaaaattgtgcaaatataaaaaacaaaaaattatgcttaaagtactttggataataaagtaagtaaaaaaataaataataattctaaaatttttttgaataaaacgaatggtcaaacaatacaagtaaaatatcaaaatcccttatattagaggacggatggagtagtagatttggagccctaccaaacatgtctcccttcattctaaaaaaaatacaatcccaatattaagaaaaagacaaattagtacaaaagaaaatgtcctatatacccctcattaactcagagcatgttggaaataggagtgtgtttagggtaagatagggaaattttgaatgaggagagcggttggaggaaaaaaaagaaagagtacttttttgacaaaatttatatgtttggattgcattctttttaggataaataagtattttaagaaataaactttaataaatatcttagaataagttgtgagaaatcatactttcaataagttgtgagcaaataatatgcaacagttatttggtaaaaaaaaagcttaaaaaactagggcagaatgaaaagaactttatacgatttgacaaatgtagtactacagtaggtctatatattcgggctgacttctttcattggtttttccaactcacctccctcttttcccatgcacgtttttcaaactgataaacagtgcatgttttgcaaaaaagtttctatacgaaagttgtttaaaataattatattcatccagttttgaaaaaaaaaagctatcgcttaattaatcccgcgctaatggaccgctccatttccagtgagcaggatatgggttccaaacccaaatcaacgaagacagcctcaaaagtcctgctttctaaagaagcccctatattgccactctctctacctctctgatcagcgtagcatatatttttcctagaaaaacatctactccctcttttttataaaaaacctaatcttagatttgaatatagatatactcttgtccagatttaaattcagaattagatttttttatgggacggaagaagtaccttacaagatgtagtgacggccatctgacgtacgtctctttcacgcccggccga

SEQ ID NO: 35275 - DNA, 3783 bp, Oryza sativa
  unsure (1)..(3783): unsure at all n locations
nnnnnnnnnnnnnnnnnnnnnnnnnnnnnnnnnnnnnnnnatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccatatacgtcaagtcttcctggattttgatttgatccggacttgcctgttcctcaggaactctcaaacatttcttcaactgagagacgtggaacacgttgtggatgccaagcatgttggagggaagctcgagctggtaagcaacttcacctctacgtttcaagatcctgtatggtcccacaaagcgtggtgccaacttccctttggtttggaaacggtgtactcctctgagcggagtgacacgaagatacacataatcccctgtttcgaaagcgagctcccttcggcggttgtctgcatagcttttctgccgagactgcgcgattctcaatctttccctgacagctctgactttctcttctgcctcatttaaaacttctgtaccaaacaactggcgttcccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcctaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaatcctgctggcctttggtgttctgcctttactcgttgacagacgtcacagagtgctacgaattcagctatttcccttctcatgctgacccaccagaacttttctttgagttcttggtacattttggtactgccgggatgaatggaatattgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgtacctcacagcatagttcctctacccatgcgacgttgcagtaactcttcctgctcaaggcatctgctaccacattagccttgccgggatgatagtgtattcccatatcataatctttaattagctccaaccatcttcgctgtcggggattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatggggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcagctgatcgaacagatcatcaatccttggcaaagggtacttgttcttaatagtgacctcattgagtgcgcggtagtcaacgcacatcctcttggttttgtctttcttctccacaaagataaccggagcaccccaaggcgacgtgctcggacggatgtatcccttctgtaactgttcatcgacttgcttcttgacttccgccaactcgctggctcccattctgtaaggcctcttgtggatcggtgcagttccagttaccaagtctatccggaactcgatatccctttttggtggcattgttgtcagatcgtccggaaaaacctctggatactctctgactataggaatatcctctagtttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaag

SEQ ID NO: 35276 - DNA, 4549 bp, Oryza sativa
ctgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatcgtgtaacgaggcttctgacacttcccctggggagtcctgaactgggctgccttcctcttacggttcattttgttacactgctcctcttgacgaatagccttgtccacaagcttctcaaagtcctcatagtctctagagatcaactggttggtcaattcatcatcaagaccagacataaacttctcctgcttctcggcatcggtacgcacgtcctcaggggcgtagcgcgcgaggcggttgaactcatgcaaatactctataactgttctggttccttgttgcagggaacggaactctctcttcttttgtcccacaattccctcgggaacctgtgctttattgaaactatgacgaaactctgtccaagtaacctctgccccagccggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcattatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaattttttttttttaaaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcatccaagggggggggggggcggcgccgacatgcgggccccactggcagcggcacaaggggagagggagggggcggctggcaggtgggccccaccaggcggtggctcaaaggggaggcgagggaggcgccggccgggctcggctcggcctcaaagccgaccggcggccatggcgaccggcggcgacacgcgcggtcaccggcggtgaccggcggcgcgggagacggcggcggccagtgcgaaggcggcggcggcggccgaagatgacggcacacgcgcggagggcggcggcgctcatgggagggagggaaggaaggaggaggagaggggattcctcaccggcgaacacggcggccggcgcgaaggaagaaaacggcggcgacgaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaagcggcggccgaggtgcgggcgggctcggtgagcgcgacggcggcgactgcgtggcgcggcggtggctatagtggcggcggcgcgtggccggagacggcggtaggcggcggcgcaaggggcgagcggcgcggcgacgataggaagcacgggagggcgcggcgagtgcgaaaaacgagagaggaagacgcggggagcgatttataggtgcgggagggggcggacgtggccggggaggtggccgatttggccggcgatgtgggggagtggggaggaagagagagagagagagggattcaaatcccccaccacttgcgggcgcgcgcgcgcgggaagatgtggggggggggggagagcggcgacgtgggcgcgaggtgcgggcgcggagagggacggagaaggcggacggcgtggggaggtggggcgccggcggttggggctcggctccatccggctagaggaggaagacgaccgacaggtgggccccacctgtcggcgcccgaaggagagagggagggagggagaacttcggggaggggaa

SEQ ID NO: 35277 - DNA, 1488 bp, Oryza sativa
  unsure (1)..(1488): unsure at all n locations
ccacttgcgggcgcgcgcgcgcgggagatgtggggggggggggggagagcggcaacgtgggctcgaggtgcgggcgcggagagggacggagaaggcggtcggcgtggggaggtggggcgccggcggttggggctcggctccaaccggctagaggaggaagacgaccgacaggtgggccccacctgtcggcgcccgaaggagagagggagggagggagaacttcggggaggggaaaggggaacgggccggcccacaaggggaggccgagcgcggccgacgggtggactgggccgacggcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccatatacgtcaagtcttcctggattttgatttgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaacttccctttggtttggaaacggtgtactcctctgagcggagtgacacgaagatacacataatcccctgtttcgaaagcgagctcccttcggcggttgtctgcatagcttttctgccgagactgcgcgattctcaatctttccctgacagctctgactttctcttctgcctcatttaaaacttctgtaccaaacaactggcgttcccctgtctgatcccagaagagcggagtacgacaccttcgtccatacagtgcttcaaatggtgccatctgcagactagcttggtaactgttgttgtacgagaactcagcatacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35278 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnnnnnaataaattcccgactgactgtcgaataaactccaactaaaatttttctaaagccctagactgagctaattttttttttttttaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagagcaggtatgatgcaggatataaccaaaggaggctagaggttcttttgcataaagctagcatttaaaagcagtag

SEQ ID NO: 35279 - DNA, 710 bp, Oryza sativa
ttctccatttctccaataaacctgaagtgcttctctaccaaacttgactcaggttctccaagaaaaatatttctaccccaagggaagaaaaaaaaacgattttctttattttgcttaaacacatcaactttgttctgactacacatgcacacacacacacacacacacacccaactgaagaaatgaaggaaagatgcaaggcaagaatcaatactgaacaacagaatcttcagaccagctcatgaaaggacaccctagaacagcaaagtccggcgaaaagctcttcttaccttgtctgccatgagaatggcggcggtgtggccggcttcgtcgtcgccgccgccgctgcggccgagctggacgccggaggaggaggtcgccggagagggaagaggagaggagggaggcgtgaagagaagagaagaggggagaaggatggtgtatgttcgtactgggttggtggtgggtgcgtggctttaagcctgatctcggccctcactgacgcgcacgcaggtgttgggtatatatcttctcttaattatgtgtgtagtgtatcagtctagtaattagcagtaagcaccaaccacggcccaccgacaggtggggcccaccggtcctcgtcgaccttttgacctctattaactgtgtatcatgtgcaaaaatattgtcagtaggtgggcctctctctgcgttgggggtaccgagctcga

SEQ ID NO: 35280 - DNA, 12414 bp, Oryza sativa
tggcctgggtttatataggtaaattaaggtcatggagccgtcttggcccggttttgttttggtgtgaggaaggagatggttgtcgtgttttggtgcctgcactgacacacctttccagtcacatctcaatcaaaattaaggaagggaatttatattggtttaatgtgattattctccatggcatttgtttctttttttttcttgtcagaaaaaaaatcttatatgagatgaccttatgttagttagtactcctaccgtgttcaacatttaaccatcgttttattttaaaaaaattaaaaaatcatgtataaaaatactaatcataaagaaatttcaaataaaataaacagtcaaacgttaaatatagaaatccataaccacacttaaaatgggacgaaggggataatgtattatagttttcaatgaacattttgctaaggcaataatagtgtacatttgctatttactcctaatcaaaaaatggtaaacgttccatattgttttcttaatttaattatagatgaaaattcaaaagacttttggacgatttcattctttttctccggttcttctaagtttatcaacttttagataactaccattctcaaactacgatttcttcacaagctttccgcgtcatcattgttttagatttcttgaagttactttaggtctctggcatataatatttgattcatctctacaaacaattatacatgatacgtccaataataacgtgacctaagtccctcctagacaatttcagatgttgaataaatacattatgtcccaaaaaaaccatgtttagtcatcacttatatatttaatagaagtatggaattcttatattaaatctgatcatcgataattttttaaaatatatatgttaaaagcaatggattaagatcctctgcagtcgactgcaccgcgcttttattattgacatgcggtgcagtcgactgcagagcatcctgatccgtaaacagccacatcggtagatataacatcactgggtctagataggagtaaaaaattgtgatgggtgacactaagttaagcacatggacagcgcaatcagccaacaaggttcactatcttcagatattggcgaattcagcatgtctccatccgagcccttcacacgtcagccgggtcgtcttaggccactaattaagcaaaccttagatccaaaaataataaccttggcctttcgccactaactaccaaccactctgaaaagaagccttctcgagtgatgcgaaagcagaaatcacgttgccaaagcacaaggtcaattaggctgtctccaatgggcagctcttagctagctcatagaggtttttaagcgatgaacaggatgcgctagctcttcttcaagcgctaactcgcacgctcaccaaggcggtgccctctcacaggcatgctcgcccaggcagtggccggcactgtgccgagcgcgtatgagctagcagccggctcataccgctggtgaaggccttggctcgcataagtactactgacaagtggcatcgagtcaagttcccaagtgccctctcttttgtaatgccttttttttttaagtagtatctagttttatttttttgagaaaatttttcttatctagttgtagaaaaaaattaagtaatatatactctctgatcttttttaaactcctcttttaaggtgcttgctccactagacctacatgacatggcatttatacctacaacattgtgcaacttcatcagaattttttagataatggacttcatcagacttgaactctgtctggttgttttcttagataaggaaggtgccagatcctcaatagagttttttgttttctttgcatatgaaaaacatggatgcataaattgctgaaatttgtggctttacattaactgaatatgtcatgaagcaaaaggtgacattattgcagtgatgctgatgcccatgatctacctagttaatgagaagaaaagggattaagagatgcctgccttgtgtataggggttacacttaacaatggcctgtccttgatcgatacatataggagctgattgggatgtgaaactgacactgttctattcgttaattgtcgccatctttgctcttaatcttcgagttcaagatctctgacggtgtttctttctctgtagattacagtgccatttcgaagctcatgcacatgttaattgttgttattaagctacagctagcttgatcttattccgatcatacagataacgagtggtcaagatgcgatgctcctgtctgtgcaagaagaacttgtactgcaccaatttgcagttgatctgtcagttcttcagatcttgggaaccattcatgcttagccacatttgagtcaatgggaatgttgcttaagtagaatctgtactctgttgctgcaaaatggattcgagcgagattgatgctatatatgtgggcccacatgacagcagctacgtgtccaaaggtgacagaggtggcatatgcaccaggaatctcctccaacaacggcacccatatctgtcatgaggattacgatcaaaaacagaatattgagtggctaagggttaaggtctagtaaccacataactccttttcaatagttcatttgttgttctacatatcgagggctcctttgattgaaaagatgaaggaataaaaaaagacactgtgttttgataggaaaggatcagaagtgtaaaacagagattacaaaacacacaaaaaaaacatgaatgatcatttaaatcaaccgtagaaaaaacagagtaatcatatgaaagagatagacccaaaaagattttttttctaataggttgaataatttgttaattttcctctaaaacccctatagaattgaccattccatgagaattcaaagaaaagggtaattaaggtgcgctctgttgttttaaaggcattccttcaacatttccttctaggataaaatccttgaagtttcctatatatttcttacaaatgaaaggggacctaaatagtctaaaggtttatccattctatgccctgtagatcattgtgtcatttaatagtgccttgatcagtcaatagttgactgaaaaatcagaatctttttcaccctggaaagagggaaaatatgcatgcacatcctccatccctaatacaactatttctagcatttaaaatttctcataaaatataaatattttagaatattaattctcacccctgctcgagtattgtgttactataacttaaccaccctcctgttgcagtatattatttttttccctttatgatcagaattccttatattttagaactgatgaagattttccccacttgttggatggtagagggtcatggtcaggctagctagtagtgttaccacacatgattgtgaaccttgtggttaattaacacaggttaatttccctatcaaactggctgtttttgctggctgatattttctgagactcaccatggactgactgactgactggctgattgatttttgttttagataataatgggactgactgattgattagtgagttaattaattggtgcttggatgtgtttcatgtgtgaggtgactgtgccaatttgacaacttgagatactacggcgatcgatcgacgtcgtgcgggtgacggtggcggccggctgccggacgaccggtgtgaggccgtgcgtgcgtggccggcgccggcggattaatggcggtgctgtgcgacgacgccggccggccggccggttgaccggtgcaaccggcaactgcagccatgcaatgatgccactgcattctttgcaagaaaacgacttgcattatagttgatgtttggggttgggacgttgggttgacttgcttttcgatggatgtgataatatatttttttttttgggtgacgatgtagcgatagcttcaaccttaaatatcccaaatgaagtcaactttatcgtgcaaaaataaaaacgcaattctcatgagaattgaatttcagtaatgtagtagtacgtattttagctgatctagcccttttcatccatgttcaacaattgacctgatactctgataggtatatacagtgtcctgcttctgtggtcttgtacattttccatccgattgtgatggcccatccgatcaacggctagcgacgagccgacgaccacctcacaaaagatttttccagtatcaggccacacagccacacaggggctatagctcctagacctgatctgtgttaggggaaccaaacattattaaatcgttagtttcttaagtggagtggaagaatttgctctagaaaaatatatacgaaggatgaagctaatttttttcaagctacacaactctagcttgggagtactccctccgtcctataatataaaaaatttaatattttatttacactgtttgaccactcgtattattaaaaaaaattgtgcaaatataaaaaacaaaaaattatgcttaaagtactttggataataaagtaagtaaaaaaataaataataattctaaaatttttttgaataaaacgaatggtcaaacaatacaagtaaaatatcaaaatcccttatattagaggacggatggagtagtagatttggagccctaccaaacatgtctcccttcattctaaaaaaaatacaatcccaatattaagaaaaagacaaattagtacaaaagaaaatgtcctatatacccctcattaactcagagcatgttggaaataggagtgtgtttagggtaagatagggaaattttgaatgaggagagcggttggaggaaaaaaaagaaagagtacttttttgacaaaatttatatgtttggattgcattctttttaggataaataagtattttaagaaataaactttaataaatatcttagaataaggtgtgagaaatcatactttcaataagttgtgagcaaataatatgcaacagttatttggtaaaaaaaaagcttaaaaaactagggcagaatgaaaagacctttatacgatttgacaaatgtagtactacagtaggtctatatattcgggctgacttctttcattggtttttccaactcacctccctcttttcccatgcacgtttttcaaactgataaacagtgcatgttttgcaaaaaagtttctatacgaaagttgtttaaaataattatattcatccagttttgaaaaaaaaaagctatcgcttaattaatcccgcgctaatggaccgctccatttccagtgagcaggatatgggttccaaacccaaatcaacgaagacagcctcaaaagtcctgctttctaaagaagcccctatattgccactctctctacctctctgatcagcgtagcatatatttttcctagaaaaacatctactccctcttttttataaaaaacctaatcttagatttgaatatagatatactcttgtccagatttaaattcagaattagatttttttatgggacggaagaagtaccttacaagatgtagtgacggccatctgacgtacgtctctttcacgcccggccgatcgatggaggcgtggtgccctaccaagttggaaggctgaaaaacaaaaggataaaaggataaataaacagagagctttatcgaagacggcttaatgatactaataatcgataagtaatggagcccaacgggcactggaccgaccaaaatagcgatgctcacacgactcgttgccgtcgccaatcatcataacagtgacaagggcacctccttcggcctcatatccttcgctccgccattggaatggtgcagatcagagatattcagagctaattaagctcatcattgccaaaattttgctcacctgccattatacccctattggtgtgataaaaaaaaagaagagagagaagaaagacgttaatttggtcgtgttcgttgtaccaagacgattcacgtgaaaaaagtttaagctggtgagaaaagacgggcgatgactgtcgcgctctgtgaacacatgggtttaggccatgtagaaatcatcatcgtgcatcatggcgtgtgcatcgatcgtttgctagctagctagctagtgcacgaattggcgccctgtcggctaccatgtgtaaagatatgtaggtgatggttgacttgcaaatttgcaatagatcctggcacttgcaagccacccaagcttggttggtggaagaccttttttttttgtttgaaactatatacttagggtgacctatctaaatggtacaattgtgaagaaatcgttttaattagtcaagtgtcggatcatcagtggagaggatgtgggcagtgggccccctttttttcttatcggaatgtagaattagttacttcctcctccgtttcataatgtaagtcattctagtatttctcatattcatattgatgttaatgcatctagatagatatatatgtctagattcattaacaacaatatgaatgtgagaaatgatagaatgacttacattgtgaaacggagggagtagcaaattgagaatgcttcattggtaattcctccgtttcagaatgtaagtcattctaatatttcccacattcatattgatgctaatgaatatatctaaattcattagcataaatatgaacgtgaaaaatgttagaatgacttacattgtgaaacggatgaagtggcactaaatgaacttaggatttagcaagtggtacagtccgatcattagtggaaaattttattagttaataattaagagtgcttcacaaaattaatactccctccggtttcataattcttgatgttttggataatgatatggtattcaaaatatatgtttgaccttatttttatattacaatatatacaataaataaatacatgtttacttttattatagaattttgaaagacaaatccatatgagttgttttctagattttttatatttaaagttattgatagttttgagtgaattatgttttgatgagatagtccaagggaagtactgtacttcagtgtactgttcaccactatcgcagcattatttatcgttcaaaagattagagatctttaaggcatttctacatcatgagagggctataacacaaatatcccccagcaatgggtcaactgaacttaatttgaaccgtccgattgagatccaaaggccagtgagcgttgagccctatcaatccaagccgtcaaatctcgatcgagtggcagtcgtacgggtttctccctctataccaaaattaagatacagtgaataattgagttcaaaaaaaagatacagtgaataatttaatagagagcgagagcaactccgacttcattgacgaaggtgctagagatgatggagaaggtgtaggatttagcagtcgagtttgcgactacaaattaaactttgtttgataatgttttagggagtaactatatttatggcgccatatttttcaccaaaaaatagtcggcatgtatttacattgtaagtccctaaattacatatgtaattttagtgtatttacaatgtaagtcctagaattacatagaattacatatgtaagtcctaaaattacatatgtaaatactaaaattacatactaattacatatgtaagtggtgtgtaagtgtggtgtaacttgtataagagaaggtatcagtgcaacgttcaacgctaatcaataaagaagattagggcttgctgcaatgccgccgtgcgtgaaaacatccaacgaccatcgaaaactcacggagcaatcgtacggctagcgacaccgactaaaatcagcccaaaaaaactggcgacatatttttagcaattccgatgttttattgttgttcctgctctgacagctggtcaactggtagatcggctgttgatcgactgactaattaacgggccatcatcatgcatgaaccggcaaggagcagtcgccagagaagaacaccaagtccgtcttggtcacaatcacctgaactattcgggggaggatggcatgattttttaagttatatcggtcttcttttgattttctaataattataagttgttcgcatcctaaccatacagaagttagaagttaggagtgatattagagtaattattatatcatcttgtaatcgtctgatatcgataaagctttctttatcttaaaaaataggggcagtgtatgagacatctctaatgttgagcaagaaattcagtgtgccaaaagaggtaagattcagagcagcaatgggaaatgggatggagcaaaattgactgaacaaaattgttgaacaaattcgccagaactcttgagggtttgggctagaaaccaatctgatgcaggcgcgaagcccaacaatttgacatggatctattatcctttttctggatcatatttgttccagcctcatttggacaagatgtggcagaagcccaacatatttcatccatgatccaaccagttcccagtgcaaacatcttcacagccttttggcccttattaattcggagcccacttcaggggaaaaaaaaaggaaatatccaccaagaaacctgcaattttctccaaataacaaaacaactagtgatttattaaacgggtttactatagatttctatcgacaaaaaaaagagaattctttttcattttttttgaccatcagatgtgcttgaagattcatgaagggcttgagagagaaaaatcatgtgaaaactcaaataggcttacatagggatggaaccccgatctactccattcgtctctaaatataagatattttggttggatgtgacatatcctaatacgacgaatctggacaggagctatgtcacatccaaccaaatttcttatatttagggacggagggagtattactcacaagtaggtttacatagggatggaagcctgatctcttattaacaagccgcacgcactagccaccagagccatcaaagtggttttagaagtggaaaaggtacaaattacatccttgaatcagaaaaccagacagcgcttaccttgaactttcaatacaggacgaattatcccccttgacataatcccgagcgattttattctatatggcatacgcatgacaatctagtcagtattttttttaaaaaaaatggtggagtccccttgtcatactctctcacctcctcccctccccctctctctccctctctctcacgcgcgtcatcgggcacacgcgtaggtcgagcggcggcgggcggttggcgcaaacggtatcgcacggggatgggtggtgagcggcagcccggacaaggaagcaagagctgtgaactccaagagggagccggagttgtgggaggccaccacgaagtacctgaactgcggcgtccggttagcctagacgacaagcaaccgccccctcggcgcgccaagtgtgattgtataatacaattacaatatgattgtatttggaagattttgaaaaggattttttaatagaaagtttaactttcaggtaatccctcattaaaatttaccatccttaagatggatcagcacatgttgttgtcgcttgaaagctgcaaatctccaaatttccagcgacacacgcacgtcgctgcggttggacgtcgcgggccacgcggtagaccgcgacaaacacttgccaccttctttgtgtcgccttatccctcgccacgccgtgcgcgtggcgcgcccggaaggcgagagacatggcggcgatggcggcggcggcggtgccgagcgacagaccaccgcttccgtggcgcgcgcggctgctcgtgggcgccgtctccgttctgcactcggcgtcgctccgccgcgacggcaccgtcaaccgcttcctcctgtcgctgttcgaccgcgtcgtgccgcccaacccggcccccgacgccgccggcgtggcgtcctcggaccatgccgtgtccgacgacctccgcgtcaggatgttctttccgggggcagctgccagggatggcggcggcgatcatctgccggtggtggtatacttccacggcggcggcttcgtgttccactccgtggcgtccgcgcagttcgacgcgctgtgccgtcgcttcgcctcggccatcccggcggtcgtcgcgtccgtcgacttccgcctcgcgcccgagcacggtttcccggcgccctacgacgacggcaaggcggcactccgctgggtcctcgccggcgccggtggcgccctcccgtcaccgcccgccaccgtcttcgtggcgggcgacagcgcgggcggcaacgtcgcccaccacgtcgtcgcccgcacgccgagcagcgtgtccgggctcatcgcgctgcagccgttcttcgccggcgagacgccgaccgcctccgagcagcggctccgcgacgcgccgttcgggtcgccggagcggatatcctggctgtggcgcgcgttcctcccacccggcgccacgcgggaccacgaggcggccaacgtgcccgccgcgctccggcgcgacgccgagcggcgccgcgcgttcccgccgaccatggtctgcgtcggcgggtgggacgcgcaccaggacaggcagcgcgactacgccgacgccctccgcgccgcgggcggcgccgaggaggtcgtcgtcgccgagttccccgacgccatccacgcgttctacatcttcgacgacctcgccgacagcaagaggctgctcaccgaagtcaccgccttcgtcaaccgccgccgcgccgccgccgccgcctcctagtgctccacattcttgaacttgcagtagccgacattacagtttgcttcactgtatcgctagctcgtctccactcacacaatttctcatttgatttgatttgatttgattcatacgatgaattcaacgagacgagctgttcatgatcgattctgtccgtgaaacgaagataacgagttgaggaggccacgtgaaagcattgatttttagactgattgccattggcaaatggcaagcatcatgtgaacgatttttctctcgtcaaaaccaatgaacgtgtagtggcgacaacgccatgaaaacccaaatgaaccaaaccaatcgtagttatccactctactctagtatttggacggaattggggctggatggtctacactgagtctgtgaatgaccatggttttgcagatggccagcaattcagcatggttctgacttgcaagtgcaatgtataaattgttcctctataatgctctctctacgcaattaaactgtttacacatgtcctttgattgctgttgactgatcagcaaccaaagtaatatcttttgttcaatgaatgtggtctacagaagtgttaattaggacacgtaatctttcttattaattcgatcgtctgtctggcatggcatcaatctcactggccacagtagtagcagcttgaagtctttgcagcatcaagcactactagaaaagaaggcaacatttattcacaacagaaaagcttctttagcttctgaacaatggtaaagaaggggtcccatcccaaaacatggcagcatttcattttcattttcatttccataggataggaatgttctgctttacgcttcccagaagccttctctctgataatcagagcttctagctagtgtagtgttagccgcaggtttttggtttagcttctgctttcttgctgtaccaggctgtgagtctgattaagctaatacaatagctaattgggcatgagttcttgcttccgagaggaggtaggcagcagttgcaaactttgcattctcctttttgtactgattgattggccgtttgattggacacatatgatcgatcgacaaacgaatctggccgaccaaaacacattgcacggacagcctcatccatgcacgtaccagcactgtattttactgtactccacataggcatctcttctcttctcttccaacttccaagttccaacaaatggacagaaatatgggtccccatgtttctatacagtgaaaccaatcaggtacatcactcagaaatcagaacatgctgacagctgatgagcttatctatgtactactaggagtattctgtattaccatgcttttgatttttgaactatactgtacttttcagaacagatggctgatggctctgagctaatgaacaaacccaactgatcatggcttgctcatgctaattaatcattagtcaacttgctccaactgaatgtactgcttactactagtatattatggttctcattgtcatttatcagatagtcataaagggaagaagatccaactagacaccaagaacatcacaactcaactgttcacatgcacaactcaacaccctaaataaacaaaaaaaggcacaggcataataaacaagaagaaggcgacacccaaaaaaaaaagaaatattttcttcttctttatttttaccactggccatgagctaatgatgagtgagtgtgagcgagattgatcacacgcactgattgctcccgt

SEQ ID NO: 35281 - DNA, 8252 bp, Oryza sativa
  unsure (1)..(8252): unsure at all n locations
atgtactgcttactactagtatattatggttctcattgtcatttatcagatagtcataaagggaagaagatccaactagacaccaagaacatcacaactcaactgttcacatgcacaactcaacaccctaaataaacaaaaaaaggcacaggcataataaacaagaagaaggcgacacccaaaaaaaaaagaaatattttcttcttctttttttttaccactggccatgagctagtgatgagtgagtgtgagcgagagtgatcacacgcactgattgctcccgtcgtccatggcgatggcgatggcgagatggccatcacatgacgctgcacccgccggcgttggggtcctcgtagcattgctgctggtggtagtacggctgccggttgccgtagtaccatccctggtggtcgtagggcgccgccggcggcggtgccacgccgtagtacccggcgggcgcctggaacgcgccgccgccgtagccgtagccgccgccgccgtaatatgacgactggtcgtaggctgctgggttgtagctgtagcacgagagggagccggcgggcgccggccagatggacggcacggcgacgccctgcgccgccggcatcatcatcggcggcgcgatcggctcgccgcgcgggggttcggggccggcctgctgctgctgctgctgctgctgcttggcgatcttgagcttctcgaggagcggggcgaggtcggcctgtgtcatgccggcccgggaagggctgcaccttgccgggcttcgccgtcgccgcggccggcggcggcgcgtcgtcgacgtcgaacttgaccttcttctccggcttcgcggcagcggcggcggccttgtccgccttcgccgcctccttctccggcttgccaccaccgtccttcttctccgccttgtcaccgccggcggcgtccttcttctccgccttcccgccgccgccgtccttctccgccggcttcgccttgtcgcccgcggcgtccttgccgcccttgttctccttgcccttgacctgcatgtccttgatgatcctgccggccttgcagcacagcttcttgcacaccttgtcggcgtcgaacggccccgacaccatcaccgcattgttcttctcgtcgtacgagatcgtcttgatgttcgccttatctgcacaacaccacagatcatccatgaaaaccatcagccattagccatgatgaacacggtcgtcatcaacctcaaatcaccaacatttttatcttttcacactccatatgctacagtgcgcagcagcatcgcacgagctcacagtaactaacacaaccatctgacatgtgggcccacatgtcagttgacgaaacagagacaggtccgtgcctttgcagcttttgcattggtgactgtggcgatgaattgatgatgcgaatgcgatatgaaaccatatgatagtgtactagcttctaccttggatcctgcaaaggactcttctgatcttcttgtagcatcgatcgcattcgaggtcaacgttgagcacaaccgtggagatctgcagcgatgtgatcgagggattaaaagataggtaaatgctgtactaatggagtacttactagctagtggtattattaacagcagatccggaagctgttggtacttccggtgttactgtgtggttcacttggcaattcttaattgagagttaactgcagagttgcagatagcagaataaattagtgacttgcctaattcttcaacctgtgggttcagaaaggatttactagtattctacaattctgctactacctagtttttgttctgtccttaaaaaaaacaaaagattaggagcataaaaatgaatcttggagttttctcttgcagaaccagatgaaatgaagccagtttctgaagaagaaattcagtgggcgaacttgaactaggaaatcgagtgggtgcttctttcgagagcatcaaaagaaatatgaaaaggacactagctgggagcgtgtatcttttgtatctttgttcaaaagattgtttgaaaacgaaaccacgagctgggaaaagaaagaaaaaaagaacgtgtgccttgatcttcgcatgaaagtggcttgcgacaaggaaaggagttttgggtggtcagagatagagatatttttgcttgctctgcacttcatttctgcttaccaccatgcttgttttcttgcgtgcctgacactctgtttagctacacaagtgaacgccatcaggttgtcaacattctccatttctccaataaacctgaagtgcttctctaccaaacttgactcaggttctccaagaaaaatatttctaccccaagggaagaaaaaaaaacgattttctttattttgcttaaacacatcaactttgttctgactacacatgcacacacacacacacacacacacccaactgaagaaatgaaggaaagatgcaaggcaagaatcaatactgaacaacagaatcttcagaccagctcatgaaaggacaccctagaacagcaaagtccggcgaaaagctcttcttaccttgtctgccatgagaatggcggcggtgtggccggcttcgtcgtcgccgccgccgctgcggccgagctggacgccggaggaggaggtcgccggagagggaagaggagaggagggaggcgtgaagagaagagaagaggggagaaggatggtgtatgttcgtactgggttggtggtgggtgcgtggctttaagcctgatctcggccctcactgacgcgcacgcaggtgttgggtatatatcttctcttaattatgtgtgtagtgtatcagtctagtaattagcagtaagcaccaaccacggcccaccgacaggtggggcccaccggtcctcgtcgaccttttgacctctattagctgtgtatcatgtgcaaaaatattgtcagtaggtgggcctctctctgcgttgggcacacacgtttcagagaaaagaaaatagataatcagtctagtagtactagtgctgcagtagtagtagtactgtcctagtacaagtcacttctagaattcagaaaagaattgtgaaagcaatgtactgtaatgcttatctcttcatttgcaatgttttgcacattttccccccttaaaccagatgatatatggtgatgaagaagaggagggctagatataattagcacttgatactaacattgcatggctcagaaaaaaaaaaggtagtaaaaaaggaaaaggaggtgacatacatgacttaacacaggtgatgtaatgttagcagcagtgatgtgtgctttgtgtttttgtgccatggaaagcagggaaatttgtgtcctagcggcaagagcgcatgcatgcatgcatgcgtcccagcctgggaatggcgtccatcgattttgacacctaaatttggcggcgtctccatgaccaaaacttggactttcgatgcgtaggcaggcgaaatgccgccaaattcgccaataaattgaggtgaaatgcaccgaactgaactgaaacaggcaaccataagaaaattttgggaccccacatactttgggggaattttgtttgttacctttgggcaggtacaatagcagcctattagtcagctataaacatattttaataagataaacgatgagagagaaaaacagcgggctacagatttatagcccgctgtagcacggactctaatatgcaatgtgtatatgacagacgtgaccatatattaatagtatagtaagtaactattgtatgaattggctattagattgactatagatgaattggagttagtagtaggctatactattgaactttctcttacggcgtgatgttttctgtcggcaacgggatgaagattgaaggcgagctacgtacgtacgtcatcaaccatctgtgtatgggcaaccaccagataaaacacaaagatggtcaataaattaatgatggtgtgctaatgcgattgccttttggtgttgggaagttcatagctatctggattcttggactgggggccagggatttaattttgcattccctaaacttccaaagtgctgcacaactcatttgccaattgccattcgtcgtatcgatctcaccagagggaaaaatacttggaaccttcctctgtccctccctccttcccagctactcgctcgccacctttcgcagcttcgccaaggtggtcactcgcaacgccactccagtactccactccccatcacatgaacaagtattcacatgccaatgattgcccccctccccccggatccggatatatgcagtagtagcgtggatttatgcagttgtagctgttgcgttggatctaaatctaacggtaagaattagattgattactgcagtaaaaggactaaaagatcgttcaggggtaccgtagcatgaacactgtagcaattgatttagatcattgatcacaaaaataaatggctgaaaatacatgcagttttaaggtgtagtcgtaattaggaccccaaccaatgcaaccaaaagaaaaaacgtcgtcacaccggacgagacacagtgacaactcatgcagcatgcggcacgtactccctccaggaagtcgcttaggacagcgacacggtctccaaaatacaactttgactttttatttctataaaaatattggttaaaaaatgctatatgtatatttttataaaagtatttttcaagacaaatctatacatataatttttatatttttaaactaaacaacttgaaagctatttataatttatatttctaaggtttgacttaaacattattctaaacgacttcctaggtgcagagggagtacaggcccaacccgcagatcgccccggtgggcggtgaaaaaaatagtaggcgacgtacatacgcgaacgcgaggtcgcgcacggagaattctgccgtttttaccgtgagacgcgcgcgcgagcggcgcgcggcggcgtcgtgtgggcgcgcgtatgtacgaacgaggcgagctgttacggcgcgcgcgcgcgcgcgtacaccaaagtagtaccaaattaacacgttggccgcgggacgttttcttcgcggcttcgcggggttggtggtgtcggtgggattctcatcgggttgggcgcgcggttcgccgctcgcgcacagtggtcgcactagtcgtgcacgttaccccgtcgccgtgcgctcgcgccgttgcacgttcgcgatcgtcaatggagatgctcatcgctgggtttcatttattatttttatttttacgctacctggggtgtgtggtgtgcaaacctggtgtggtggctgccgttgtgctctcgttgtcatgataaatgctactctctgtattttaagtattacaccgttgacttttttttattgatgtttgaccattcatcttaattaaattttttttacaaatataaaaatatttatgatatgcttaaagaacattcgatgataaatcaagtcacaacaagataaataataataatataaattttttgaataagacgattggtcaaaacatcaatggcatcatatattaaaattcggaatgagtacctccttatttcatgatataagacatttcaattttttcctaactcaaactacttcaacataaaaaaaataaactatcaaaatatattcaatacaatattcaataaaactaatttagtgctataaatattgttatatttttttctataaacttacttaaactttcaaaaaatttaactttaaaaaagtcaaagcaatttataatatgaaatggagtgagtatgtactgtaagttttaaaaattaaagtgtagatataatgagtgcacgtaagttttaaaaatttacagcgtagatatatgaaattatagtgtaacaaacatctaactacattttgatgaaaaatatgacatcaaaaataaataaatagttaattcctgtgcaacccgtagctgccgttgcgctttcgttctcatgagcaatacaatccgggttattctgcaattcgtgcggtgtttttgtacatgcccgtcagtttgtcccatccactgactgcacaaggaagaagaataatttatctgctcctacgcaaagaacgtgtgggtttttatttttgtttatttgatcgtatttgggttggcttaatccacaaggtttttagtgctggttgttcgtgatcaacttgtcgtgtttacgggggtttcgtattgtgatgattcatccatgcaagctgcaacaagagatcgagcatcatggcatctcatgcatggctcttggatacctcttcagattgttctattggattggttacaagaccagcaggctgtaggatcgaatcacaagaactaagccaaccaaaggggggtgaatggttggtatacccaaaaaccgaaaacttttagcgaaaataaaagttaccctcaatttcgatgagatcggtctgaccgaagtagattagccggtctgaccgaagcgtagccgccggtctgaccggtgttgatctaccggtttaaccgccgagatcgcctgccgctcgctatcgccgccgtcggtctgaccgccgtgctctcgccggtctgaccgccgtgctcccgccgatctgaccgcccgtagatcgccggttagaccgccgaaacccagtaaacacaaatcgaagaactcataaagtagatgacgactttattgattctctttgtgtttacaaagtgcaccaacagcaatctttacaaaaatttcgactaaactcgaaaccctaactcaaaactcaactctattgctctctaaagcgataccgggaagcctcacgctccccctctatttatacatgaggtaggcagcctaaagccacgaaccaaactcatactaggagtcctaaacaccttagaaaaccctctagtacaagaaagaaactttacataaccaaacgtaccaaatttggactccttccaaattcgactccgcatcctatacgcacacaataactccatcgtatgccatatggaatctccatcaaccacgtgcatcaactctagcctaagtatcccgcatgatctctgaccacaacggacgtcgtcttatccccaagccgactcccggtccatcaccgcaaatactctcccgagacatcgagtcgcctacacatggaacaaacaaagaaaccatattccgagaccaagctatctccaacttaactcattagcagcaaacaatagtattacatacatatagcatccatttagaagtcataatcatgaaaaaaactcggatatccaaataaacaacccgaaaccgaaaccaacacagtgtcggccggtcagaccgcgggctgcgccggtctgaccgcgcattacacgccggtctgaccggcaacccatgcccggtctaaccggacccaaatccagcagtacctgtatattcacctgtgaaatccaataatctccaaaaccacttcgtgaataaattccaaataacaaaaccaataatctccaatacccatttgttcatcacagaataataatcaaaaatacctttgattttacacaggcataattctgggtgatgattggttctacttgattaaactaaggagaaacttccgattggtagcttgcacccactcaagtatcgaaaagagattattgggtgatggagtgagcactgtttccctgtgaaacaacagacaaggaattaacgatttgaagattttatgagaatattgggaagatgaaacttccctttcagataatgaataatgtgttatttgcacactaacatttttgaacttttttgggtacatgtactttattactaaaaaggtaaatagagagaaggagtacaacctaatgccagtacatgtttcactgaatggaaggagtacaacaaaatgcagagagatagctgtatgcaccgtggtatttacacactaacattttttaatacttctctacctatttcgttagggagcgtattctgtgcacataaatttttcgtatacacattatgcacagaacaaaattcaccaaaaaaaaacttagagaaaaggagtacatgtttcaatagcattatatttctgtttaaagtcttaacctcagatttattatattttagcccagaaaaaagatagcttgaaggttataataaaggcaaaatttgctacaggacacgcaaaaaatgtgtaattagctaggagacaccgaaaaaacgtgacactgtccatggacactacaaaagttgtnnnnnnnnnnnnnnnnnnnnnnnnnnnnnnnnnnnnnnnnnnnnnnnnnnnnnnn

SEQ ID NO: 35282 - DNA, 10674 bp, Oryza sativa
  unsure (1)..(10674): unsure at all n locations
ctcatcgaccctttcgcgccatcatcgtcgtcgtgaagctctgcatcgccgcctggagactttctccatcaccatcgatgtctagaccttgccgaaccctgtgtgcgattcggtgagtactctagagcctctacaaaccacatgcatgcattcccttaggctaaatcgagctctaacacgacatgcaccaccatcccgaacttggccggcgcccgtaccgctgacaccactgattccgttcaccattgcttgcaagaagactatggtagcttcgccttggacccctctacaaattctcttttgactgcaacctcatccaagccgccgttcactgccggcgacgccgcaaacctcgccgttgccctgcctggctgcctcccatccaccacctcgctgacatgtgggcccaacccgattagcggactccaactgcgggtttagatggtgcgataccgggggcaatcaggtcatttagaaaatcctatcccctctttttctcagaaattataaaatattgcctctggtgtcctacggctaattacacaacttttgtagtgtctatgggcagtgtcacatttttgcggtgtctcccagccaattacatttttttgcgtgtcctgtaacaaattttgcctataataaatcggttagatttttttgttgcttcatatacatagtgtgtacacgagattacttgtgcggataagatatgtgtccgtttcagaagaggtacaacttaatgcagagagcaggtagctgctacaatagatgtatgcactgtgtagtgtgagtacgatggtacagtcaacgcaaagcaaactctgagtctggacgagctttttgtttctgactgtgactgtgtttagtttctgaaaaaagttggaagttcgaggaaagttggaagtttggaaaaaaaaagtttaaagtttatgtgtgtagaaaatttttgaatatgatatgatgtgatggaaaattagaagttaggggtaaacacggcctctgtacaagtacttgacaatctcaatgcatgtaccacaaaagattagtatggtcttgttcgtttctccaacaacatggagataaactttttatactcgtggcacgcttttcaaactgctaaacggtatgtttcgtgtgaaaactttctatatgaaagttgctctaaaatatcagattaatccatttttttaagtttgtaataattaaaactcaattaaacacacgttattaccacctcgttttgcgtgaaacacttaatctttatctttaggagattcaaacaccacctatgtgtcatctttgacaataagcagatagcaagatcccgggaagaacactataggccctgtttagttctaaagttttttttccaaacttccaactttccatcacatcaaatctttcatacacacataacttttcagtcacatcgttccaatttcaaccaaacttccaaactacagtgtgaactcacagcctatgaatcaacggatagcccgcaaagtggtgggattcagtcatactaatgaacaacaatgccacacccaaatgacagatggacatcctaattatttctcttgtaaaaggcccaactgttttgttgggtcaatgggcattttgttgggccgatgaaattgttgtacacagtatgaataagtccaccttgaatccttcacgtagggtttcaatcgtatttctcaaacgaaaaaccaggtacaatacattgctcatcttctgaaatcagtcaactatagttcaaagacagtattgactaattgagattgttttcgactcatgtgaccccatgttgtgtgttgactcggtcatcgtcctacgtggcactcatatcaaaggaaacaaaaaacagtggagcccgcatggtgcccactcatcacataagaagagacagagagcccaaacaagaggtgagagggaacgaggatggatggctaagggcatcaccaatgtttactgttggaattaatgaatggaccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagagggggaacacacgcgcgcgcgtactcgctcgcctggcaggcggcgcacgtgcacgacgtgcacgtggttcgccaaaattggttcctcaccttgcgcagatgcagcctccttttgcaattttgttttgctgcaaattcggattcgtttttgttttggaaacgttccagaaaaatccggtgcatgcaaacggtgtggagtccggataagttacgcgcgacttatccggttcggttacgcgcagtggagatcgtgcgggcgcccttatcaagcgacccttctctatataaaccgagccgccgccttcacgcaacacacgcgaaatcaatctagggtttgcctccgactctgtgctgcgcgtcgctcgtagattactccatcccgctcgccggcgtgcacctgtgatcgggagagcaggtctccggaacctctgccttcgacgttctgcaccgggagaaggcggcaataaggtttttgggaagcgctttgcgcgactgctccctgttcgtccgcgacggctcgtcttcctcttcgcttgcgtgctgcgtgccttcgtagatgcctgcgaaaagtttcgaccgagcagccggtctttccgccacctcggtacgtgttcaatatgttgcgcatatttgatctgtttatgttatactgtgtagtttacatgtgtagatctaatgatgcgttcatgctagttttcatctgtaatgtcatgatttatttatggagtagattaaatcattatatgcctataatctcaacaatccaaaaaccttattataggcattgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttattgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctattgatgctagcaatgatctgtatatcatggagcagtttcatgactacaagatggctgacaaccgttctgttatcaaacaggctcatgagatacaaaccatggctaaggaactcaaactccttaagtgtgtcttacccgacaaatttgtggccgggtgcattattgcgaaactacctccatcttggagaagtttcggtactgcactcaaacacaagagacaggaatactccgttgaggggttgatagcgtctcttgatgttgaggagaaagctcaggaaaaagatgccgtgtctaagggcgatggtgggcagtccagtgccaatgttgtgcacaaggcccagaacaagagcaaagggaaatacaaagctcagcagaccaccaacttcaagaagcagaagaagaacgacaacaatcctaatcaggatgagaggacttgctttgtgtgtggccaacttggtcatctggctaggaagtgtccacagcgcaaggggatgaaggcacctgcagggcagacttctaagtctgctaatgtgactattggtaacactggagatggaagcgggtatggtaatttacctattgttttttcagttaatcagtctactaattggtgggttgatactggggccaatgtacatgtttgtgctgacatctcattgttttcttcttatcaggacgcacggggttccaccgtcctaatggggaatgggtcacatgcctctgttcatagtgttggcacggtagatctgaagtttacttcgggaaagatcgtgcagctgaagaatgtgcagcatgtcccttctatcgacaggaatcttgttagtggctcccgtatgactagagacggatttaagttagtttttaagtctaataaagtagtcgtgtctaaacatggatattggggcgcgcgaggcgtgggcgcgtggagtggttggtgaatggtgagagagagctcgccctcgccctcaccacggcgtgcgccttttatagcgaacgaaaggcggtttcttaattgtgatctgtggtgttaagcaagtgactaatggtactgtgatcttaattagtgtctaatgatgagcgtgattatgctttaatttctgtgcagctctccctgcgccctgtggttgggccgttttagctaaaagcccattcggattttggacgtgtattttcttagtttatccctcttttgggttaaatttggtttgatgccaaaatcaaatactactactgtagcatttagcaatactgaatactagatatttgaattgctactaatatttatcaaatcaataactataaattgatagtactatattctacgctaccgaaaacattggtactcctgttttgattggtgtgatttttttgtgtatacgaaagaaaagatatgcatggatggatggatgagtgaatgaggtgtcgttgcgtcgagtattaattttctttttctactgtaccacacagttcgcaacgtatcatgtactatagcgctctctccgtttcgaaatgttcgaaatgtttgacatcattaactttttagcacatatttaaccgttcgttttattttaaaacttttatgagatatgtaaaattatatgtctacataaaaatatatttaacaatgaatcaaatgataggaaaagaattaataattacttaaattttttaaataagacgaatggtcaaacatatgataaaaaatcaacggcgttaaacatttcgaaacggattgagtagtatatagtcgttgcatcgcacgtctctcctgcaggctttttcccttgctggttttgcggaacaaggaaagcttagggtaaatcacattatcacacacacaaatttaaatacacctgtacgttcaaaagagaaaaagtagaagtatagttggctgggtcctgggtgggtccatttcaggtcaggtgaaaactgaaaatactgccagctacgacgaatcctatattcaattcaaacgagcttgctctagtttgggacctctcagaacgtttctttgttctaaaataaaatataaaaaataaaaagactagcacttagtagtaactttctttggcaatcccaacgatgatcatgcaataatgtatatacagtacctccgtcctaaaataaacgtagacatagatatccatcttcaacatttaaccatcctcttatttaaaagatttatgcaaacaataaaaaatagtcacacataaagtactccttccatccacaaaagttacacctatttcacatttgagtttttctaaataagttgttcctatttgtagtctttatgcattcaagacttgaatgaagagataaattaaatgttttattagaactcaaggaatcatctaaatacttattggttgcatgcttgcatttactacttgattttgtaacatccaagatgatttaatttttccttggtcttggtgtcaaaagtaatatatgtaacttttgtggatggagagagtactattcatgtcttatcatctaataataataaaaatactaatcatattttttttaaataaaacgagcggttaaatattggacatgaataatgtaaagttacatggatggagagagtactttaccggaatgactacgcatacgactggtcaatacgactctgtagtccgtacgatcataacctgaacccacagaggtaattaatctaagcaatgtgattagtttgatgaggtgagacatacgttagtagtacgtatagcacttctcatactctacgtgctctattgcccgctcgtcagaaaaaaataataattaattttaaataatctaggtgtttctttagtgtgtataaccagttattcagacgtggtttctaaactgctaagattcgtaagtagtccaaccaattaatcaaacgtgcatctcgctctatgaataaccagcatagttatgcaaataaaaaactttgatctcaacttaattatcgatgcgcgattatcataaaaattcatgattaacacgatgatggtatggtcaaagtctgttgacctgatgttaagtgacttttttttttgcaagcttttcagtccataccaaatgccacgagggcatagtagaattattagtgcaaatgcagtcaaacatcaaaacagaaacacacatcacactgatatggttcttctccgttaagatgaaaaaggaaggtggcaacagaagatgaagacaaacaaaaataatgcagggttgtggtgtgtatctcttgctccggtgcatgttgccaaaaagcccaaacaaggcaggagtatacaggtacagccagctttatttttttttcctttcagggagggaaaagaaggcagctcacacgcaacacatggacgttctgtgcttgcagcatcacagtagcttttgttggggaatcacaatgcagcatgaaaccaacacacacagggaaacatacggttcagcaatacaatgctgcaatgcagttgtgcaagcaaggcagcatttacacttgcacgtcagatcacgcaacacaaggtagtcggagcaatttagaccaccttactcttcaaccacaatataataacaatttagaccaatagtccttactcttcaacaatacaagtatataacccttaatgttgcgttggataataaatcttttatacttgtactcttaattgtcaaaaaccaagcctaacaaataagaagtggggaaagaaaagagacatcctaaattaattcttgactagactaagggggtgtttgggagagaaaggttaaactttagcccctctctcaaaaccataagtctctaggggggacttatgtttttgagagctctctcccaaacaccagtaggcagggcagctatgcatctaagatattatgctcatttaaactcggttccagaagattaacatctgaagcaaggcaaacacacacacaaacggttagctttggtcttcagaagtaccaagtatgctcttattcaggcatcgacgatttcacgttacttagaggcgggctgtttgcttctcaagaaaagttccctgcgcataaagataccagcaagatgacagcgatcgttagtacaataacaggctactagccagctataaacatattttaataagataaacgataagagagaagagcagcggactacagatctgtagccagctgtaacacgcaatgtatgtatgatatgtgggaccatatattaatagtataataaacaactattgtataaattggctattagattgactatagataaattaaagctagcagcgggctatactattaaacttgcacttacattgatgagaacctaaacattgcaaaagcagactaattaaacgtgtgcagagaatcatttaatttaccgaggcctgagatagaaggtaatgcagctctccgacatttaaccagatcagaaacatataattctgtattaatcacaccatgcgagactgtctcattcacagaagtatagtccactacctgtttgacaataaagactgaatttcaggatattcggtgcagtgacggactcagaaagatcacgttgggtgtgcacattcatatctctcttacagcgataaatgcagaaatgaaaatctaagctacgggatattacaggacctgaatatcaaattattatacatacaaatagtatgcttaaatgcagataagattgtcaaaaatagtgcttaaacagttcaatcatcatctcatatatagtgaacaaaaatagaaaattacaaccaagaaatttaattggttggattaaaaattctgcacaacaatataaatattcttgaattgattcccatgatccttatcatttaaatggttccagagctaatcagatgtttggaaagtgatctaagcaattagaaattcaaaagttgacaactaaaggctaaaagggaatctttcaatctaaccttatttattagtgctaaataagctagaaatccttatattttggaactgatggaatatatatggtagcataacgaatatgtggacaagaacgtgtaccttgtatccatcaattcttgtttcccttttaaaattgtctttcaaaatgttcatctccttatcaaacttatgggaaagtgcatccagatcatgggtgattttcttttttaaaagaccattatggagcttatccacggtatcttgaaccaagatatgtgttattgcccctaagcctccaagagcatcaagaaaggatagaatattttccattgtgaccctattatgatataactcggggtggcaagctcacaaaagatagttgtgtacgtcctcaccatctgcaattcagaaacgatcagtaagccgaacgaaattttagaagtacaatagaaagaaactttagaacttaattacctgatctgctgtacgttgagaaatttcggttgtaccaagcccgaaggcagcaacatcctagaaatgttacaataaaattgatgaattaactttagaagcaccaactatacatataacaaatggaaagcgtacacatgacatcataatttaccatgacctccgaagctaaatctagagctaatcgtgctttcctgcaaaccgttgacaccatctccttctcgtctgcattctgtcatagtgtcatcgccaaattaaaagagaatgaaatgcatcaacgataagctgcaacacatttattttggtagatctttgttaaacaataagagcatgcttgtcaaaatttcaccataaagtaatgtgttaacaatgaattcggtgcattagcaaaatactagtgaacttgacataaccccaaagattggtcagctagtgcaaatagggaaaagatgtgcgcactaattttttttaaaagaaccattacaaaagcagatgtttcacattgtgactgaatcttgacttttaataaaggcaaattgactcaatcagttaacatttttgttagtaagaagtttgtaaagaaatttttagtacatgtagcattgctcttgcaaatacatatcaatggaaatgttattattgtggattttttaattagaagttttttcccaactgtttcacagacagagtataaacaagactaaccagaatcttagaactggaagaatacatcttctgcatgataaccgcaattttgtacttctccttacggaacatatcagggggcgtacgcttcaaaagatcaaaattagaggcattaggaacaacaaatataaatctaaccgcaggaaagtttgctaataatcactgactcaccttataaagaaaatgatctcggttacctctgtccctagagtaataaaactaacacagtagtagattgctttcaaaattccaattgaagtttaaatttacattgggaccactgtttttagaaaaaaaaaaacttctgaacttaaaagcaattttagaactcatacagctgatggttgacatcataagcttgggactttcatttgtaacactctggtttacaagaagaaatcaaacattggcaaatgccaaaacatctacttcctccgtttcaggttataagactttctagcattacctacatttatatagatgttaatgaatctattttatgtctagattcattaacatttatataaatatgggcaatgctagaaagtcttagaacctgaaacggaggtagtatcattagttatcatattactcctctgttgcttataattcccactgctcatctatatctcgagggactagtaatctagtattacagcatgaaccagattaatctagattaacatctgagatcgagacttaccaggcccaaggctgctctgtaatcatccaggaatttgtctaatctctcctggaagatgattgctggatgctctgatcttgcagctgcatcctgttcgagcaagcaataagcttacatcattattagcacaaaaacatagcgggagatcgaaggctcgccggaagaggagacgatgccgctgcgtcggctagcattacctcgtcgtcggcgccgtcgtcctcgtgctccggctctgactccgttgggctctttgtacagtgggagcggagctgtatcctcctcgccggcgccggcgaggggaggcggcggcgttggctaatcagagggaggaaggccagggcgctcgtcggcgcggcggtcaccgcgagatgaggcggcgaccaggtggggcggagcgccgccatgtgttccggagtttcgcggaggaggaaaagggattagcgatggatttatctgttcgttcgttgcaaccccgcatcgtatcgcgcacaaattagttaccataatactatcgcgcaacattctaaacgataatttcaaatcctagtttagagattcactggtcaaaaactcggattaaatcctccaatttcgttcgaaattnnnnnnnnnnnnnnnnnnnnnnnnnnnnnnnnnnnnnnnn

SEQ ID NO: 35283 - DNA, 4710 bp, Oryza sativa
tcctccaatttcgttcgaaatttacaccaaacacggctacatttgccaagcaaaaacttgatcacatcatcatcacctgttctagctgaaactgaaaagcatattacacgtgaaaaaggattgggatgttgctgttgttctactactggtcgtaggtgtagatgaagtcggagttcccgaccatggcgttgagcacctgggagacgaggaacccgccgccggcgaggacggcgacgatgagcagcgccgtgacggggttcttgagcagctccacgatgggctgcgccagcgtgtacgcgaacccggtgctcaccgtcaccacgtacagcgcgtaccgccgcatgttgtcccagaactcctccaccagcgggccctccggccccagcgccgccgccggcccgggcgccgccaccgacgacagcgccaccgccgccgcgatggccccgatcagcgcccacgtcgggagcccgcacgtcctgtctgccccgccaccgccgctgacttctccctccgtggttcttggagggggtggaggacatggtgatcataagtcttctcgggctccggtggtgcggtcgtcacggcgagaagacggtgctggttcgttcgctgaggggaaaggaggcgagcttggaagacggtggtgcggccatggaggcggaggtggcgggggtggtggtggagtacgggggagaggcgaggtaggtggaggagcgaaaggtggtggttcatcttgcgccgccgcggctggcttggccggcggtgaggtgaggacggcggcgataagggaggaggagtgtgtggtgacgagttcgcctcgcagtcgccgtgatctgcacccgctctgcatgtggggtggtggggatgcgggtggttgttgggccgagtggaatgttgttgggccgaagcaattgttgctgatggttgggccgtgggcttggttcgtgtccatgggcatggttcgataaatgggccggtttggtgtgcgctttggcttgttagcgcttttctacttttgtgcggcttgtgtaggctaaagtggctaaccaaaagtttgatgacatgttagcgctttctacatcttttaatctgcgcaatgatttagcaaattgttttgcttttctctgctagaaagaggccgtctcgtaattcgttttagctttcgtgaataacgtggcgaaatcgtgtttactaaagcattttatcacggtaatgatacgttgtggctatattttgtttcatattgtatctttatctctaaaaattgaagatgtttttaccggtatttttggtacgttattcgtgtatgagtcagtttttaaattcgttcgcctttaaaaaatacaggatgagtagtataaaaaatctctttaaaaaaactcgcatgctaacatgagatgatcagacttatactacctccatcccaaaatgtttgatgccattgacttttttaaaaatgtttgaccgtttgtcttattcaaaaaatttaagtaattgttaattttttttctatcatttgatttattgttaaatatacttttatgtatacatatagttttacacatatcacaaaagtttttgaataaaacaaacggtcaaacatatttaaaaaagtcaacggtgtcaaacatctaaggaagaagggagtaattgcagctaatgattttctagaaaattatgcagcgaagcaaattttaaaattgaatttctccttactaaaccgtataacaataataaaaattaaaatattcttcacctgttgtaatgtacgggtattttttttctagtttgatctaaattgagaaatatttaggcattttctagctagaactgaactgaattagaaacctcaccccttctttctattttataataatgtaaagcgtagtaaatactaccacagaggctcttggaggttgtctgtactccttcattcttatctttcaccatagattatattcgtcaaatcgatcaatcggtagaaaacactatattttttattaggattcaacgaggtcaatagtattgattgataatatatactcgagataattttatcaatttactgctgattttgactttgtacattccgtttaacagtacatctttacaagtagtaacaaaaaaccgaaggcgtaagccgaagaagactttctttcacgccctcctccaaatccaagggcagcagtagcagcaaaaggaagtcaccaacccttccttcgtcaccctaccaccggtcaccggtaaacccgcccccgccccgcccgccgcaaccccagcgaaccaaaccaaaccaaacgaaacgaaacggagtagattcccccaaggccccaacctcctcctcgccttcccacctgtccacctcccccccttcgccgccgccgccgccttcttcccgggggcggggcggggagaggaggcgcgggggtgcgggggtttagtatctcctctcgccggtggccgcgcggggaggtgacggcctgagattctcgccgcgtccgcccgtcgttctggtggtctcctcctccgccgccgccggcggccgcgtgttgggggagagcggtttggcgtgaatcgggccggggtgagcggacgccgccgccgttggtggctgcttcatggagtgcttcctgctcagcctgaacccgttccggttcaagccgatttggccggcgaggaccgcgcccaaatctccctgaaaccctagggtttcccctcctccctgcccggggatttcgagaaaaaggaagtcccgggcggcgcttccccccaacccctcgtttttttttttgggttcatctcgtgtgttccgtgaaattctcgtcttctcggaggtttctgaggggagggagaggctgggctgaccggctcaaggtgttgtgaaaggacatgagcttgctgcgagaggctccttgtctcgtttagtttgagttcgggctgggcgtcccttcttctataggtgacggtggtggtggtgctgctgctgcgagggatggcgaaggaggaggacggcggcggcggcccggagttcgtgaggtggagggaggacttcgtgtcgcaggagaggggcagccgcgtcgtgcattactacctcgaggacgccgcgggcgcgtcgcacctcgccgtcgtcggcacggagcggagcctgcgccacatgctctatgtggtctcggaggatttccgggaggcgcagggtgccgatggcggcgggccgggggtgtttgcgcgcaagtggcggtcacgccgtgaggtggtggattggctcgcctccttccttccggcgaagtccctcgcctcgagtaagtctcgcctcctttgtttatagtgctcatacacgagttcggctgatactgaatataccaatagctgtttatttaacatgctatatgccatgtagtgactttagaacctaatgaagtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcagaactttcaaaatttggatcacatatgggtaatgacattggattggatggatacagtgaacctgatagctttatgggtcacaatctggtatgcaattacttgtaactttgcatacagtttgttctcatctttattagcgttttgattttttttatattgttaggggaaagcctgtagctcggacattatgtggtctggttcgtcctggacttgtggcaagcagctttaccactataaagctttttgtcgtaatggtaccacaatatctgtaagtattttgtcatggtcatggtcatgtgtgtatacccaattgcccatattgttttctgagcttcatgtgccatcttctttgcagacccactcttttgtgcttgtcatgtctgaggaggaaagtcgctatcttgcatacttggaagatatgtacgaagataagaaggggcagaagaaggttaaagtgcgatggtttcatcaaaaccaggaatttgcttgcgctatacctcctccccctcctcatccttgcgaagttttcatcactccttattctcaagtaatcagtgtggagtgtgtcgatgatattgcaactgtgttaactcctgagcactatgaaaaatgcgtcaatacattgccaaattcttctatggtgggaatccgtttctgctttcgccaatacagtaaaaataagtttaaacgttttgacctgagatcattggggtaccgagctcgaa

SEQ ID NO: 35284 - DNA, 763 bp, Oryza sativa
  unsure (1)..(763): unsure at all n locations
cacatccggcgcactagcttctctctgtcctccatctcctactcattatttaaaaattaggcaaaacttcagtacaagatttcattcacaactaaaaaatgcatatagttttgctcgtctatgttttagcttaggattctgctggtcatattgactagacaattatgcagatgaagcttgggaaattaaaccgttaacacaaatagcatatgttccagacaccaaaatcaagaaataaaggtgactgctttctcgtccatgtaatggaacaacttaaaataccatcagaccaaaaaaaaaaatcatcatgtttccagcagagcgtgtacccttccttagcatttttttgataatgagcattttcttagcacagaactaaacctttcagaagagaaaatatgcaatgtatgtccaaatgaaactctataaacagagaaaattactagattgcagaatgcttagtctactatgtgaatttctaataaaataagctgtttgtgactttgctgaaacaagtacccatttcatccccactatgaaatctgaaatcaaccaataatgcatctcctttttcgcaatgtcagaccgttgggacttgggaaaaatgcatgtacacatcggacagttgaggaacaatggaagagattaggcaccgaccaccgagtggcggcaagatctggaaggaaggaagggaatgttgggnnnnnnnnnnnnnnnnnnnnnnnnnnnnnnnnnnnnnnnnnnnnnnnnnnnnnnnnnnnnn

SEQ ID NO: 35285 - DNA, 821 bp, Oryza sativa
  unsure (1)..(821): unsure at all n locations
tgataatgtgattacctaaagctttccttgttccgcaaaacagcaagggaaaaagcctgcagaagagacgtgcgatgcaacgactaatatactactcaatccgtttcgaaatgtttaacgccgttgattttttatcatatgtttgaccattcgtcttatttaaaaaatttaagtaattattaattcttttcctatcatttgattcattgttaaatatatttttatgtagacatataattttacatatctcataaaagttttaaaataaaacgaacggttaaatatgtgctaaaaagttaatgatgtcaaacatttcgaacatttcgaaacggagagagcgctatagtacatgatacgttgcgaactgtgtggtacagtagaaaaagaaaattaatactcgacgcaacgacacctcattcactcatccatccatccatgcatatcttttctttcgtatacacaaaaaaatcacaccaatcaaaacaggagtaccaatgttttcggtagcgtagaatatagtactatcaatttatagttattgatttgataaatattagtagcaattcaaatatctagtattcagtattgctaaatgctacagtagtagtatttgattttggcatcaaaccaaatttaacccaaaagagggataaactaagaaaatacacgtccaaaatccgaatgggcttttagctaaaacggcccaaccacagggcgcagggagagctgcacagaaattaaagcataatcacgctcatcattagnnnnnnnnnnnnnnnnnnnnnnnnnnnnnnnnnnnnnnnnnnnnnnnnnnnnnnnnn

SEQ ID NO: 35286 - DNA, 769 bp, Oryza sativa
aaacgactaccgatgctaccgttactacgaaacattgcaacgaatagcaaagatcttgatacgcttgcgagaaattaatgcaaaatgtgttatacctcatcatccacatcctcctcgtcgtcatcattcccctcctcataaaccctatcatcctccaatctctcctcatcttcctctccaatctcaccgttctcatcctcatcttccccctctccgtgctcatgcccatcaatctcttctccaacgtcccccaccgccaaagcgaccctcccgctgctctctggctcagcctcctcaccatcatcctcaacctcctcttcatcctcgtcctcctcctcatcctcttcctcgatgccgtcttcctcctcatcactgctacttggtacatcatgcacctcaacaacagcgtcttcgtcatcaccatcctcatcgatctcctcccccaaatcatcctcctcctcatagtcttcctcatcatcatcgtcttcctcctccacatattcatcctcgtccccaacggccgcgacccgaaacccattagcgtggtgttcgtctcccccgttcgggacgacctcgtcggcgtcgctctcgtcctcgtccacatcgatcacaccgttcacctccaccgggtgcgacgccacgccaccgcgcgggtgggagacgcctccgttggccacctcgccgctgccaggatcctcatcctcgtcatcgtcgtcgtcctcctcctcctcgccgtcgccgtcgccatccccgtcgtcgtcgtcgtcat

SEQ ID NO: 35287 - DNA, 762 bp, Oryza sativa
gtaaacatataattgttctgtagtggcatgtaaatgtgttagttattgcagtttaacacttcagcattttgtttcttatggcatgccagtacagcagtgtttgtttctatattcataattttcttataactactatgtgtaaagatacactaataatttgtatttcgtgtattagtccaatagttgaggtttcttatctattatctgagatggttcagcacgggcttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggtcagtattctgttctgtctcacctaatgtcttctttcattgtacttatcaaattttttattgtttcttagaatgaattttggtttgataaaatatgacctcatttagaatttcatcggtgctctcgaactgtatggattcacacaaactgcaatgtatattaccagcttttgttttcttctaaattccatctagtagaatatatatcatctgaatgctgtagacatatcaaagatggtaatgttactaccttctctacttaaaaagaactaagaagggtaccgagctcgaattcgccct

SEQ ID NO: 35288 - DNA, 2206 bp, Oryza sativa
  unsure (1)..(2206): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacaacagtacttatgaaacagttagggatgctaatatgcagtgtgatcacttccctattatcatctccggcactagtcggcacactcaccctattatcttcgaaggagagctccacttgggacacgtcgtcctcagcctccagagctgccttcagcggggggatgatctcctcctgcatcatctccggcagcggcttcaccggaggcttcttcggcttcgcggccggcttcgctgcgggcttcgcctccgcggtggcttccttcttggcatcggccgcatccttcttctcactgactgcacaccacaccacaaatccatagtaaccaaaagatcaacaaaataagtgcaacttttcaatggcaaaacgcaaaacattggcatggtgctactatggcaaacatttgactgatctaatcaacactgatgcgtttctttcctaatcttataaaggatttacagtagctaagcaattgggggcggaccagtcgtggcggcggcggcggacgacgactcctgcacggcggagcaggaggcgccggaaccggagccggagccggagccgcgagggaaggcgacgaggagcggcagccgctgccgcccgaagacgagcgggatggcggcggagcacttgcacgccgccgcgtgccggccggcgagcgggctcggcctcacgaggcgtagtggctgggacgccatgggaaaatcgggcggcgacgccgatgaggtgaccgtctaaagctttcgttcttggcaggcagtggctcgccgtggccgtggtggtggttgccttccactgattcagttggatggcattggtttcccgccacaactcgctctatctgctcggaaactggagctcagtggcgaggcgcgagcagcacgattgcctgagagccagccattcgtttcattatctctttgccgtccgatcacaaccaacggttcggattagtcgctacagctggagaaacaatagaaagagaacttttttgggatttgctaaaaatatgtggccagtttttttgttaatgaactaatgattcacttaggggaaaaatactaatttatttgttccaaatcgacttggaaagaaaatactccatccgtttcaaatataagactttttgactctctctaaatttaactaattctgtagaaaaatattactatttttttcctagatagttagtcaaacttagattagtttgactttgaccaaagtaaaaaagtcttataagctaaaacagagggagtcataactttgttctagaatataataagttttataactataaatctaaacaaatgcatgttaagattataataaaaatactatattttgagatgggttgagatgggatagtatttagattttccaaaacatctaatttacaaacaaactccgtatctcacaacaaaccctatttttactgccgaaaatacttcccagtttgtgctttgtacttgacttggtgaaaatggaagcggtttgcgggggaggggcggagatgcaacggccccgtcggacacngcggaagcgccgcgtagccgaacaccaccccgnnccgccgngcgtngtttnccatccatccccctccacccatgaaactgacaagtgggcccaggtggaccccacctctccacccacaccacccccatggccccaccaaccacgtccaccctctgggcccggtccacgctgtacgcgcgagcaacacggcacgacgacccggcaccgtctcctctacactaggcggatgatctcccacgtcactgctctcacacccgccgtccgatctccgctctccacgatccgcgccgtccatacagggcatcacgggcatagcgtgcctgcgcggggccagaggccagagctatctgtagacacggaccacatggtcagacgagcgtagccaccccaaccggggccccacctcccagtcgccgtacgtgacatggacccggtgcacgtgattnnnnnnnnnnnnnnnnnnnnnnnnnnnnnnnnnnnnnnnnnnnnnnnnnnnnnnnnnntt

SEQ ID NO: 35289 - DNA, 2372 bp, Oryza sativa
ggaaaaaagaaaatcaaaagagatggtgcaggctagggagacaatgaaactgaaactgaaactgagctgccatggctacttgctaagttgctacacaggtatctccattttccctcctaaaatctgatgtttgaagaggaaggctggatgaagaagctctctctcaatccaaagtctttacaagaaaaacgctaagaaaaaacagggggaaacccaccatttctgtttgctgatgctcctgctgctgcttgcttggttctttctagctgagaagagggggaggaagggatccatgtacattgctgcttggtcagtggtgcttgaagggcctcaggtcctcgacaccatcatcgtcctcgtcgtcatctccactgcctgatggatcatcatctctcttccgcttagcgccctgcgaggacgagggcaggtccgtaccaccatcatcatcgtcatcaacctcatctctatcttcatcagcatcatcagcctcagctgcatcaaagtcgtttccaaccgccatggcctgaggttgagcaattggttgaacaagatattctgtgtcttcatcctgaggaaatgcaaaattggatgaattctcattagacctgtgtttccacaattctgcttttagagatagtcattaacaggaaggacattctggaacagggtttagaaaaacctcaaacataaaagtcatgtgtatcataaacagctcactaagtgaaatgcccaaagagtcaaacaaattactccatgatttatagttttaacatacatgcagcaataaattagcaatgaaaaacataggcaaagtaaccatgcaattgctgaaatacaataagcgtctctaccactgaaagaaaatatgtatggtttcaaaaccatagtaaacatcagcaatatttacatcaaaagatcaacttaacaataaattaaatgtcctataagcaagaatagcacactaaaacaatagtgaaagtaaaaaagcagtatcaaccacctctcgaaggatttaagaagatgaaattcagaaaggaaggccttctcgttacacaatgaacaaaacaatgggccataacaagcatgacaggagaaaatctatctacaaggatatttagcagcgaataaattgcacagttcacaaatgagagaagagcttctactggccagataacataggcaaaaactaaagcatgttctcatggatagaagaactacaggtctgtacacacttacacagtcagggatatataatgaaataatgcattattaagatagccccaaaagaaataaatgcatgacaaaacatctggcactactaaaacagaaatatatcaataaaaattagagtagaaacactagtgatttactaagcatacatagatatggatatcaaataaggtaaaaagaacatataaaatcccaggtttcatagatgtatcagtttttttcttttaagcaattgccaaatttaaaaacttcagatgcaaaatcttttgttatatccgaaaatagggcataaaagagataactaaaaccttctctttcttctacatgaagaaactaaactctgctgtcatacagtatctatctaatcatatctgaaacactaatttctcacatttcctgtcatttttgggtctaactggaattttcaaaaagattgtgcacatagctgcagcatatcaaacaaagtactaatgcacaactcataaaatcatcacacggatacattagccaataatgatagagcgcacacataagtctctgaactgctcctatgtatcacactcagtaaatgaggtaaaaatgattttatccctgctgctaagtaactgaggtaaagaagattatccctgacactatttcagagtgtaaaacatcaccaaaaaggtgattgtggaaaggaaacctaacaattgaagttatctacttcagcatgacaaaaaaaatgttgcacttataataagtagactaaacaaacacccacataactaacgcacgaactagtaaatcccctgaaaaaaaaaagaacctgcaactgagaatggttaatatcaattttactagaacatgaatataaacgactaccgatgctaccgttactacgaaacattgcaacgaatagcaaagacatcaccaaaaaggtgattgtggaaaggaaacctaacaattgaagttatctacttcagcatgacaaaaaaaatgttgcacttataataagtagactaaacaaacacccacataactaacgcacgaactagtaaatcccctgaaaaaaaaaagaacctgcaactgagaatggttaatatcaattttactagaacatgaatataaacgactaccgatgctaccgttactacgaaacattg

SEQ ID NO: 35290 - DNA, 618 bp, Oryza sativa
ggaggcactacctctacaactgcgacatccagggctccatcgatttcatctttggcaacgcaaggtccttgtaccaggtaactaataaataaataaaattaaaccacagctgctgttactactactgttgctgccttttactactgtctaattaagtcaggatgttgcccaaattaaccacaggtatttttgtggtaattcttggtaaggatcagtagtgtactgttaccatgagaaataatcctataagaaaaaccgacttctatttctatttagaagggacgcgcacatacgccactacacacaacaagtatgaccgctgaatactcgtttaaagagatagagagcagttgcaaatccctaatctcactaagttcttattggatgtttaatacaacatatgttttttctatttgacattggtcaaatcaaaattgaactaaccaatgtcacgtaaataaaaatggaggaagtattttatattttttaagaatatgtttatgtatagcatgataaaatctttggacactctgtcccccacactttgctctagttgtcctctagactagtagtactataccttttatgctgtgtctcctgttggtccgatcagagctg

SEQ ID NO: 35291 - DNA, 767 bp, Oryza sativa
  unsure (1)..(767): unsure at all n locations
nnnnnnnnnnnnnnnnnnnnnnnnnnnnnnnnnnnnnnnnnnnnnnnnnnnnnnnnnnnnnttcacaacagcttaaatgcagatatactcttgtagcacaagcaagctaggacaagaatgttattcatatgaacttaaactatattaacaattgagaataaactgaaactatagtccagactccggaggaaaacataagagaagcaatgatcaatcagactgctatacaatatgactggtaagggtaatatttagtttgcaacctctgtatctggtgacagaaagcctgaaagtgggaagctaacagtaaaacaagggaacacgtgtatgaaaaaagatgtcgatgctcactgatatcagcaacctagtaaaaaacccctctgctggggtccaattaccatatctatagctatgtacatacgtctaatgaggttgcgcttcccaaacttcacaatttgccaacatctatgcctacttccccattgcaatgttgttcagcatcatcatccctaggtcgctttcctagaactgtttgtttctggtcctctgcaaaagcagaggccatatcagtcaaactaacttctgctggctgatcagctcctgtttgtttatcttcactagaggttggttgtatggctgcaagctcttggtcagacattgcagaatttctggagtccggcctctcaacagatgtcagattatcaggttgccttggttgaacaaccaaccgagggtattttcgataacacatctggtttcatttctat

SEQ ID NO: 35292 - DNA, 821 bp, Oryza sativa
tcctcctcgccggcgccggcgaggggaggcggcggcgttggctaatcagagggaggaaggccagggcgctcgtcggcgcggcggtcaccgcgagatgaggcggcgaccaggtggggcggagcgccgccatgtgttccggagtttcgcggaggaggaaaagggattagcgatggatttatctgttcgttcgttgcaaccccgcatcgtatcgcgcacaaattagttaccataatactatcgcgcaacattctaaacgataatttcaaatcctagtttagagattcactggtcaaaaactcggattaaatcctccaatttcgttcgaaatttacaccaaacacggctacatttgccaagcaaaaacttgatcacatcatcatcacctgttctagctgaaactgaaaagcatattacacgtgaaaaaggattgggatgttgctgttgttctactactggtcgtaggtgtagatgaagtcggagttcccgaccatggcgttgagcacctgggagacgaggaacccgccgccggcgaggacggcgacgatgagcagcgccgtgacggggttcttgagcagctccacgatgggctgcgccagcgtgtacgcgaacccggtgctcaccgtcaccacgtacagcgcgtaccgccgcatgttgtcccagaactccttcaccagcgggccctccggccccagcgccgccgtcggcccgggcgtcgtcgccgacgacagcgccaccgccgtcgcgatggccccgatcagcgcccacgtcgggagcccgcacgttctgtctgccccgccaccgcgttgacttctcccttcgct

SEQ ID NO: 35293 - DNA, 838 bp, Oryza sativa
  unsure (1)..(838): unsure at all n locations
attaacacttctgtagaccacattcattgaacaaaagatattactttggttgctgatcagtcaacagcaatcaaaggacatgtgtaaacagtttaattgcgtagagagagcattatagaggaacaatttatacattgcacttgcaagtcagaaccatgctgaattgctggccatctgcaaaaccatggtcattcacagactcagtgtagaccatccagccccaattccgtccaaatactagagtagagtggataactacgattggtttggttcatttgggttttcatggcgttgtcgccactacacgttcattggttttgacgagagaaaaatcgttcacatgatgcttgccatttgccaatggcaatcagtctaaaaatcaatgctttcacgtggcctcctcaactcgttatcttcgtttcacggacagaatcgatcatgaacagctcgtctcgttgaattcatcgtatgaatcaaatcaaatcaaatcaaatgagaaattgtgtgagtggagacgagctagcgatacagtgaagcaaactgtaatgtcggctactgcaagttcaagaatgtggagcactaggaggcggcggcggcggcgcggcggcggttgacgaaggcggtgacttcggtgagcagcctcttgctgtcggcgaggtcgtcgaagatgtagaacgcgtggatggcgtcggggaactcggcgacgacgacctcctcggcgccgcccgcggcgcggagggcgtcggcgtagtcgcgctgcctgtcctggtgcgcgtcccacccgccgnnnnnnnnnnnnnnnnnnnnnnnnnnnnnnnnnnnnnnnnnnnnnnnnnnn

SEQ ID NO: 35294 - DNA, 685 bp, Oryza sativa
  unsure (1)..(685): unsure at all n locations
nnnnnnnnnnnnnnnnnnnnnnnnnnnnnnnnnnnnnnnnnnnnnnnnnnnnnnttttaaataaaacgagcggttaaatattggacatgaataatgtaaagttacatggatggagagagtactttaccggaatgactacgcatacgactggtcaatacgactctgtagtccgtacgatcataacctgaacccacagaggtaattaatctaagcaatgtgattagtttgatgaggtgagacatacgttagtagtacgtatagcacttctcatactctacgtgctctattgcccgctcgtcagaaaaaaataataattaattttaaataatctaggtgtttctttagtgtgtataaccagttattcagacgtggtttctaaactgctaagattcgtaagtagtccaaccaattaatcaaacgtgcatctcgctctatgaataaccagcatagttatgcaaataaaaaactttgatctcaacttaattatcgatgcgcgattatcataaaaattcatgattaacacgatgatggtatggtcaaagtctgttgacctgatgttaagtgacttttttttttgcaagcttttcagtccataccaaatgccacgagggcatagtagaattattagtgcaaatgcagtcaaacatcaaaacagaaacacacatcacactgatatggttcttct

SEQ ID NO: 35295 - DNA, 671 bp, Oryza sativa
  unsure (1)..(671): unsure at all n locations
ttctgtcggcaacgggatgaagattgaaggcgagctacgtacgtacgtcatcaaccatctgtgtatgggcaaccaccagataaaacacaaagatggtcaataaattaatgatggtgtgctaatgcgattgccttttggtgttgggaagttcatagctatctggattcttggactgggggccagggatttaattttgcattccctaaacttccaaagtgctgcacaactcatttgccaattgccattcgtcgtatcgatctcaccagagggaaaaatacttggaaccttcctctgtccctccctccttcccagctactcgctcgccacctttcgcagcttcgccaaggtggtcactcgcaacgccactccagtactccactccccatcacatgaacaagtattcacatgccaatgattgcccccctccccccggatccggatatatgcagtagtagcgtggatttatgcagttgtagcttgtgcgttggatctaaatctaacggtaagaattagattgattactgcagtaaaaggactaanagatcgttcaggggtaccgtagcatgaacactgtagcaatngatttagatcattgatcacaanaataaatgggctgaaatacatgcagntttaaggtgtagtcgtaataggaccccaaccaatgcaaccaa

SEQ ID NO: 35296 - DNA, 834 bp, Oryza sativa
taggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatcgtgtaacgaggcttctgacacttcccctggggagtcctgaactgggctgccttcctcttacggttcattttgttacactgctcctcttgacgaatagccttgtccacaagcttctcaaagtcctcatagtctctagagatcaactggttggtcaattcatcatcaagaccagacataaacttctcctgcttctcggcatcggtacgcacgtcctcaggggcgtagcgcgcgaggcggttgaa

SEQ ID NO: 35297 - DNA, 699 bp, Oryza sativa
  unsure (1)..(699): unsure at all n locations
nnnnnnnnnnnnnnnnnnnnnnnnnnnnnnnnnnnnnnnttatgcctgtgcctttttttgtttatttagggtgttgagttgtgcatgtgaacagttgagttgtgatgttcttggtgtctagttggatcttcttccctttatgactatctgataaatgacaatgagaaccataatatactagtagtaagcagtacattcagttggagcaagttgactaatgattaattagcatgagcaagccatgatcagttgggtttgttcattagctcagagccatcagccatctgttctgaaaagtacagtatagttcaaaaatcaaaagcatggtaatacagaatactcctagtagtacatagataagctcatcagctgtcagcatgttctgatttctgagtgatgtacctgattggtttcactgtatagaaacatggggacccatatttctgtccatttgttggaacttggaagttggaagagaagagaagagatgcctatgtggagtacagtaaaatacagtgctggtacgtgcatggatgaggctgtccgtgcaatgtgttttggtcggccagattcgtttgtcgatcgatcatatgtgtccaatcaaacggccaatcaatcagtacaaaaaggagaatgcaaagtttgcaactgctgtctacctcctctcggaagcaagaactcatgcccaattagctattg

SEQ ID NO: 35298 - DNA, 1614 bp, Oryza sativa
cacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggacgatctgacaacaatgccaccaaaaagggatatcgagttccggatagacttggtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcacccaacctgatcacaaaagtctaaagtacatcttcacccaacctgatcaaggttgctctggtttttggttgggttttttgcaggtgcctaacatcaattgttgtctctttgggaaggtggtggcctctcttttgtattctttatatctcctcccctttttctgtttaatctgtaatggcttgccgctggtatagcccaatctctgtaactcagaactatctttctttggcaatgaaagatttaggtgaggaatctctcccctccggtgattaatcaaataaaaataccgttacaaatcggggttgaagtaatattcttgctatgtatcagcatcttaacccccttcataatacgtttgattagttgttctgttgttgattcctcttgattgaacacatggtggtttctctccttcaatgttcccacgtcagtagaatgaaggttgtttttagcccttgcttgtggaggcgtcgatgtgtttcctgttccatattcccacggtcccaacaatgcagtacaccagtagtgttgtcactaattctagggacatttaactatttaccactttttagattaagcattttactatttaacacccatatatcaataacacatgtgtccacatgtatctataagatatgggtttagtgataaataattaattgtcccatctaaaaataacaaatagtttaatatatcgcttctcccagcgccgcgttgcctccccatcccccgcgcgcgccagctgcgccttgccgcttctccttccccagacgccccaccccctacgccgccacgctgccacccgtctgttcatcttcgtttccaaatagccgatgcttctattaatttgtttgtcgccttctcatcccatcctctcatacatgtcacacacatgttgctgtttgctgctaatgatgatgcaggacgaaaagcagtgcaaaccttggtgctgtcactggtggagaaatcatctttggtcggtcgaccaaattcgacaatag

SEQ ID NO: 35299 - DNA, 21723 bp, Oryza sativa
gcattcattgtatttgattgctaactacatattttttttccaattttgccttgcagctgtccaataactactaatatatgtattatactgttttagtattctgtattgcgcatggagaactctgagtagtgaacatgcctattgaatcagtgaaattatttgatctgcagatcattttgtgcaatgcagctataaaatttcaatgtatagacatgagaaatattatgtacctataaaaacacctcacatacaaaaatgaaatacttcttgtagtgatttttttagcacactatgctaagtggtcaataaagttgagttgataaaatgataaatgataaccattgatatttaatttctattggatggttgtgatgacacatggaactcttattttgtgggtggtgtgattcaatactccctccgggctgataatacttgccgttttaaacaaggtttgaaggtcaaactttagaatctttgattataaatcatttttaaaatatttgtctttcaaatatggtgattacatgtatagattagtcttaaaaagtactttaataaaattatatatttgttaacaaatttatacatattataatgaaaaataatggttaaacttgtttttgataccgtgttcttatctaaaacgtcaagtattattaatccggagggagtagatatgccttgtttagttgtctcgcgggttagtaggagatcagtttcagtgcacatcatgataataagaagaccaaaacatgtctcagtactctctcaaataaacgggacgacgaacgtacgacgatgattaatacaagtggtccacgagcagtgatcagatctaggctacacggtagtaggtgctaaagaaaaccttgcacaatcttatcttcctgacatcatgtgatatctggaagaaatgaaattagtgagtgtttagacacaaagaacttctaacaacaaggcttatcgtaaaaattagaaggcgaagacttgaatcattgtaggagtaaaagcattaggtgggtataatgccttatagccctcctttttttttattttaaacctatatagggcttcactcgttcagttttttcgtgttatatttaatgaaattgatacatctgtgtggggttggataaagataaagaaaacatgggtacctttgcttgcacgacactacagtagtactagtatgtttagttcactagttcacattaaaattagaagtttagttgaaattgaaacgttatgatcgaaaaattaaaaatttatgtgtgtaaaaaagttttgatgtgataaaactgttagaagttttaaaaaaaagtttagaaataaactcgaccttggtcaaagaaaggacgacagatgatgcactactgttacggctgccccctcacagatttttttttggcccggtctagttcccgactttttaaaaaaactttcaacttttctatcacatcaaaacttttctacacacataaactttcaatttttttcttcaaacttccaattttagtcaaattttcaattttggcgtggaactaaacatttgtgtgttttttctgaggctatgggtgtgttaatttgcgaaaataaaattttttgggtgttacatcatacgtttgaccggatatcggaagagattttttttacatgaatgaaaaaactaatttcataacttgcctggaaactgcgagatgaatttattgagcctaattaatccgtcattagtacatgtgggtactgtagcatttatggctaatcatgaactaattaggctcaaaagattcgtttcgtgatttccatgcaaactgtgcaattagttttttttttatctatatttatactgcatgcatgtgcgggtagtaagatatgactgatgtgtaaagcaactattggctagaaatgagagagaaagtgagagatgggagagtttaatattttttatgctcttattactagatagtagtgctattgcctggtataattactacctcctctactacccacccctacaatagtaaagtagatagtaagggggtcttactacccacttttcatccacattgcggacgccctaagaagcgcaagagcacactagacgcaggagactctcaggatgtcaactagtatacaaacagtaagtagctagcaagactggacttgcttgtacacatatatatgaccaaatatgtgggaaagtgttttcatccctcgaggagatatctctcgttttgtgcgtgttatctaaatagttatgaaaaaattaaaaaaatcacaagatagattattatgaaatatatcactccacaaacatgtatgttaaaattcaacatttacaaattgtagcaaaaataactacgaatgtacgagaactattttcaaattaatttgttcttttttgcaactggcagaaatcgaatttggccttacatgctcgtggactgatatatttcatattaatttatattgtcaatttttttaaacttttttttgataaatatttagatggcatgcaagcaacgaggggatatcccctcgtgagatgaaaatccacatcccaaatatgtttatatattgaagtgaggggtgtcacaagattaagaaataaacatatgatatttattgatgtcaccaaattttcccttaaggttgcatatgcaagtaaaagttttacttataatgacgtgaacaaaatctcatacgttcatctttttcttcatacgataattttaggttttcacggtacatggtttacactgtatagtttactattcaagtgggcgtatcagctgcctgttttcctcatcggaggtaaaacttaatactcccttcgtcctaaaatataagggattttggttggatgtgacatatcctagtactttgtgtcatatccacctaaaatcacttatatttttggacggagggagtacgtaacatagagcattgagacatgcgcatgcctgcaccaaacatttaacgataaaagtaactgaacacatacacatcaagtgttcggatcggaggctaaacatacacaaaatgaaattccaaatgcatcactccgcaaaagtaaaccctgatccataaaacttggccgagagaaacttatcaagactatcggccatctctggcgtgacgtggttcacccaatctccgatgactcccttcctaaagaaagactcatgtgggtactcattggccatcatatgtagggagcctgtgctgttggcacccgaagccttcatcttctcaaaactgcaaagctcgatgatgctctcaacgatcccggcttccttctcggcgtcagagaatggctgggacccgatgaattccgtgattttctcgatgttcttcgtaggatcgcgtagaacctcctcgtactttaggaatagcaccttgtccggctttgccttactcgtgttccaatacccaaggatatgctcccagattgggcctcccaagtatgcaccctcacggatggactcccacacatcagataatgacatggtgatggactcccactgatcatcagataatgatgaggtcttagccttagaacagttcatgaaatgccataaagaaattgccatgtctttcggttgcctgcaattaataatataacaagaagaagaccataaccattaagactatgctttgggacgaaatggttggaaaccataaaaaaaatagtcccaatgattttaataaccatattttcttagaaaacaaagtaaaaaaaggcagaggcggatataaaaatggtattggaaatacggaaaattgaaaataaaaagatatggaaaaaaatgcatgtatcgatcggaaacatgactatgtaatatctgaaacaataatctgaaatcacatatttaacttgacatgattatataatatgaccacgtgaattcaaacttacactattctaaaaaaaagaaattcaaacttacactacgtaaatcacaaaccatctcttctttaggcatgtactcaaattaggaattgggttgaaaagttgatgggcctctagtaaaatagagacatggtatttagaaatatggtaattaattacagtattataaaaactataattttcgtgcaaatatggtaaataagaaaatggcaagtagaacatcaaaatcattttcgtttccgtattttcttgccttttgttaggttaccatttccaagctatgttaccccgatacgtcgctgagtgtcgcgtatctgtatcggatacgccaacggatacacgctccgatatgcatcccgtacgtatctgacattttctcgattttcaaacaaatgaaagaattacggatactttgctgattcgtattgatacgcccatattttcacatgactcactcccggtctccccgcatcgtctttgccgtcgccatcgtcgggcgcagcaccgccgtctgtgcagccgcaacgcctccttcgccggagggcactgcgcctccaaccccaccgtcccgcggcgcagccggcgcatatcctcctccgccgctggcgtcaggggctaggggatgctggggccgccgtccccagaacaacgcctccgcgcgcagccgtctatgcggtccgcggccagcaccacagtagcgcctccacctccgagcagtaggcacaagaccaccaagcagtttttcctttgttcccctgtgaggctgtgagtaaatcactgcatgtttgtgtttgggtgtcggttgaactaccattttagagcaagtttaatattatcgcccactactagctctaaatcatctatagccaatgtaataatcaattcatacaatagttgcttactacattattaatacatgccccacatgtcatacacacattacgtcttggagtccgtgctgcagctggctacagatctgtagcccgctgctcttctctctctttctttatctctttaaaatatgtttatagctggcttatagcctgctattgtacctgctcttagtgaaatccggtggttggttggtggcttagtgctggcgtgctgctacttgtgtactccctccgtaaaaaaaatgacaaaccctgagttttcgtgtccaacataaatattaatttttttacgattaatatttttattgttattatatgataaaacataaatagtactttatgtgtgactaactttttttaattttctcataaatttttcaaataagacggacggtcaaacgttggacacggatttctacggctgcacttattttgagatggaggtagtattaaaatcaaaattattatttcttgtgttgtcaactcgtcacccttctccgcgtgcacgctttcaaattgctaaatgatatgttttttcttaaaaaaattatatgaaagttgctttaaaaatcatattgatttaaaaatcatattgatttatttttaaaagctaatacttaactaattgtgtgttaatgaaacaatccgttttttatatggagttctcaccttcacctcccgaatatagcctaatagattgcttttcagtgaaactacgtgcacatatgcatgcataaacgggttaccggcaacccgtaaaaatgattttttttttggaaaaagtataaattaccccccccaactatcgaggtcgactgaattatacccccgaacttgaaaacagacattctacaccccgaactattgaaaccggacaaataacccccgactcaatttggagcggttttggatccacgtggcagtccaatcagcactttttaaataaaaaaaatcagtgggccccttttgtcagttctccaccactctctatctctctctactctatcccagtctctccccctctctctctctcttctcacctgcacggcggcggccgcgcgagggcgggagcaggcggcgctgccggcggcggagggcggctgagacggaggcggagtgggttgccggcagcttcgctgtggtgtgggctagcaaccacctcctcggcgacggccacatcgcggtggtgctcctccagtcgtggtcggagttcgcgcgcacggggacgttcgccggaggcctgaaccttgactggtcggtgctgagccgtccccactccccgccgaggtacagcgccgccgtcgacgggatgttcgtgccgtgggaccacgagcacgagttgaacccgctcacggcgagccgcggaggcgagcttcgtcgagcggctctactacgtcgaggccgctgacatcgccaggctgcgcgaggaggcgcgcgcagcgcgcgacgagcggctctactctttcttgttcgtagctaattttgctttcagtttttttggcggaggattttgggttggaaagacaaggtcgggatctcttttaaagtttgtttttcttttcttttccctcttgatcggtggatcgatgtactatcagtatcagtaatcagccatgccatgccatgttttgtcgagctcacaagattggaatctcccgctagggaatcaattttcaactgtaatttgccccgctttctgcggtgagatttgcaggtgcgcaatatgtaattcaccattttcatcgctcatcgctctcttgctcatttcacccggttgtccgatgcaaagtggcaaagcatagtacaggagataaacatgtctggcattgaaggggcgcccacagccgccggcgcgcggggctcggggtggtgggaggaggggacggcggagggcagtgcttggggcggcgaaggggcgcccacagccaccggcgcgcggcgcgttgaggcagcggaggggatgcttgcagccagcggtgctcagggaggtggagggggcagcgggcggagctccggcggcggaggaagcgcccgcagccatcgccgcgcggctcgtcgaggcgctggagccgtccgctgccgtcggcgctcgagccgcaaccgccatgatttgagagagagaggaaagggaaagagagagtggagagatatctgacaggtgggtcccttcgttttttaattaaaaaattgctgactggaccgtcacgtagaccaaaaccacttggaaaactgctcgggaggggggtttcatccggtatcgatagttgagggtgaaaaacgtccggttttaatatttagggggtaattcatactcaaccaatagttcaggggtagttcgtactttttccttcttttttttaaccagtgtatgaactgagtgagtaactgaatgtgccaaattcaccttgtttgaaacattgtttatggcaaggttactgaaattttgaattggaacattaatgaacagtaaacatttactaattacagattaattaggcttaataaatttatctcgtggtttaccgacgaattctgtaatcagtttttttattagtgttcgaacaccccaatataatacccgatgtgacacgccaaacctttatgccctagatctaaacacccccctgatcagcacttacctgcagatgtagatgattttacagcggtcgtcctcggtgatggaggccggcaggtttgggtacgacgcgtgcgtgctcatcagccgcggcgttggcgcggcgtcgagcttggcctcctcctcgtccaagtagatcccctccaggaacgggacgcactcgtgtgggttgagccggagcagcgggtgccggccatcaccgccggcggcggcgggcgggtacacgccgcgcgccgccgtggcgaaggccagggccttgagccacgtggtgccgcacttgggcaggctcgccaggaggacgtcgccggcgcgcggctcgaagcggcgctggagcgccacgatcccggggacccacgtacgcctcccggaaccaggcgccctggtactcgcgccaccgctgctgcggcgggtacagcctgctcgggagcgccgccacgacgtcgccgtactcctccgcaaccggtcgccgtgcgacggcgacggcggcgatgtccttgaacgggacggggcctgcggcggcgctggtcggctgcatgtctgaattctgatcgaacgaaacggccggggagacggtggagacgagccggccggcacatgagtcattatatagcgtggcagccagccaggcggtcactgatcttctacacttctattttaccaagggcttgtttagttgacaaaaaaaattgtccctgaacatcacgtcggatttatgaacacacatttaaagtattaaatatggtctaataacaaaataaattacagattccgccaggaaactgcgagacgaatttattaaacctaattaatccatcattagcacatatttattgtagcaccatattgtcaaatcatgacgcaattaggcttaaaagatttgtctcgcaatttacatacaatctgtgtaattggttttttcctacatttaatactcgatgcatgtatccaaacattcgatgtaacaacgtaaaaatttttattttgagaactaaacatggcctaagataaaactttcttaattcaccgtatctataccctataattaaccaactcactcttacatgttacatacttcatccatcaaatccaacactctgtattcgtctacatccgatcgaacggttgagattacctcccccatcacccactaagccactactcatcactctgccctgatcccacgcaccctccccctatgcaaccgctctcctttcctcgtcgcatatttcacgccgccctcctcgcatctcctctctcagcgccacaatcaccgggagcgttccatcctcctccgccttcttagccaccgcgctacggaggcgacgcccttcaaccctctgccactcccctcgccctcctccgcgccgtctgcgccgccgaggccccgacgatctttgcctcgacgaccggctctgtgccaccactcctcgcgatcccctctcatcctccttcgcaccactattgatctctgccgagcgctgctgttccctccgccggaagctccaccgctgccccacgccgagacatcgacgcccgcctcgctaatcccgtcctcccgcatatttttagatagacccataatcccggccccgcaaaggaagtcgtgtgaaaaacatcacctttccccgccccccacaggggacccggcgggtgaccggggcctgcatcatccggatggagctaatacttcataaaaatattgcaatacacttaataatattacgataaaattttaatagcccccggttgtgtgggttggttgaaggaaggaaaggaattatggttgaggagaactagggtgttgagcttttatatgtcaattttgaatgggtttattggctctacattattgcaatgagctacttttagataagtaactcacatcggtggcccctccaagtcacgcgcggattaattccaatccccgcccctatccccgaaagtttgcggggccctgtccccactcacccgcgggtgagaattctcctcggtccccaccggatcccggcctcaacggagaaattaccaaccctaccaaacatcacacaaaattgagcagatcatctcccattcagactcatccacccaaccaaacacaccaagttaggacttcggatcgttttgatgggcctcgatctcggcccatttaggttagccagcctaaccggcccgtatcatgcttcggtttcagcccgtttcgcacggggaactcacgcgacgcaaccgccgccgtcctcctccccgcgccaaagcccaacgccggtgagggttccggttccccaactgcggcggcggcggtccgggcgctcccggagcggagcggagcccccgatggcggagggggagagggagctccatgtccgggccctcgacgggcggtccaccgtcgtcgcgctcgccgccgccgcctccgtgcgggatctcaaggccgcgctccggagctccttccctcccgcgcaggtctcccccagcttccacctcttcctcaaggtacgcccgctcgcttctcctttgcgtgcgagcttgatcgtgctggtggatggatgcggcctgcgggatgccgtgtgtttcgtctcgcttcacgctcgcggcattgaggggtttcgatagggtttagggtggtttcaccatttatgttcatagtaatggagctccgaaatgtgctaaccactagtgttctcgtgatgaagggcaccaaattgcgcgtggaggccgagattggcactcttgctgttggtgagggggaatttattgtccttgttccattcgcaaggaagtcgcagcagtgttctccggtggcaatggcagaacaagggcagattactgaatcaccaagatcatcgcaagtgtcaactggggcgaattcagctcggagaggcattacggataacctctcatcaatcccaagcagcccacatgctgaaacggcgtccagatatttttcgagtggggctaattcagcttggcaagaaattatggatgatctttcatcgatctctagcagcccacaggatgattctgcatccaaaaacttttgtgcccaaagcactatcccttgttctgggaattctgtagaggatgtgtcaacagatcaaaggttacctactgggaattcaaataaaaggaggaagccatgtaaggaaaatggaaatgcattcaacgaaatgcctacctctggagcgaacagtgctgctggccagcctagcatagataagaaaagtagcattgccagatctgctgcaacatcttgccatgtaggtcactctgccgttatatattcccctgccaatttcactttttgactttcacattcatagaagaaatccaaattgcagcctttgtgttgcactgttccttgagggaggaggcattaaccacaacatatattacatgtttgtttgttagattgctttgagtaatacgatgaaaattgcagggcacgtgccatttagggcctgctgaaatggttgaccatctgaaacaaggacttggaaaggagggacaggtattcactcaatgaacttctggaactaacaaggccagtaaaaccatagtatttatgttgttgggattatattttcagattgtacatattgaagagataccatgtcgagcggcatcttttgcagaacttcctaatcatctttcagaggctacgagggaagcattaaaaagtattggagtatctaggttgtacagccaccaggtattatagggtgtgccatctatttggtgcattcagttgtagaagctcaccgattatgttgatcatttacttgattgcagtctcgagctatacactcttccattgctggaaggcatgttgccattgcaacatcaacatctagtggaaagtctctgtgctataacattccagtccttgaatctctctgtcaaaacctgatggcatgtgctttgtatatatttccaacaaaggtctagacaggaactttctgttttaggcttgattgtctgaaatcgggcagaaattcatctgtttgttgctttgcaggctctagctcaagatcagctaaggagtttactcgagatgaagaatgcacttcacactgatattgatgttaacatatatgatggtgatactcctagagaagaccgtacgtggatcagagataatgcccgtctggtaaacatgtgcttctgaagatatataattataaacagttcgtttcttttttaaaaagtgcatttgaactcaccatctacctccttctcagttaattaccaatccagatatgctgcacatgtcaattttgccatgccatggtcaattccaaaggattttgtccaatctcaggtggaacttattggccttttgtagttttgttttcttgatagctaatttcatcatctgtggtcaattatcttttaacttttagatgaatgcttattatctccataaagagtttccatttctgcaatactatactcaggtatattgtcattgatgaagcacattcatacaagggagcatttggctgccatactgcacttattcttagaagattgaagcgcatttgttcaaacagtatgtataccatgttgaaccagttcttttaattgttagttgacatgatgcttatatatgctatataccataactgtgaattttcttgtttttgcaaatgtgttagtgttacttcagttttcttctcaattaccaatcatcagctacctaaaatctagtaatccctgcaatttctaacttctgagttatatcttggcaaatttatggaatataagaagtatgatctactgatgcaaattaacatataattcttaaaagcatttgcttgttcgatttgcagtttatggcagtcatcctactttcatattttgtacggctacttcagcaaacccgcgtgagcatgtgatggtaggcttgatcttctctttatgttagcttagaaaaaatggttgcacacaagaaaaaaaaaaccagctgttgttaactactgctctaaagcacaagctatcctccaaatgtgtttcttttttctgaagagaaatattattatcactgttgcttatgttttcgtgcacatactctttcgagaatattggccgaacaacaagcatttttccttttgcaaaattctgttaatcacaggagctagccaaactggataatgtagagctgatcgagaatgatggaagtccttgtggttttaaatacttcctcttgtggaatcccccgctacatatgacgaaggaggggagttcaaaagatagcttattaactagacgctcaaggtattgacactttcttttcccttgaattaagctacttatttattttcattgtatttttacttttcaaatttgcaaagttccagatgattttattatagctcaataactgttgtctttcagatatacgcaaatttgttcactggccatcgatgcaggaattctaagaagttgtcctattaaatagtttcttggcaggatgatttgatagtcaagatagagaatacttctttgccaacctgaatttgaaaattttgggccaggggccatactgctttgccaacttcatctctgtactgtcctgtgatccttgagtggcatgttaatttccaacactcaacaacggatccttttatttgatgagatacagtaattgttgtggacttgaaagcaaaagttatgagttcatcacagtacaaagggacgatgtttaatttttaagccaaaaattgtaaacatataattgttctgtagtggcatgtaaatgtgttagttattgcagtttaacacttcagcattttgtttcttatggcatgccagtacagcagtgtttgtttctatattcataattttcttataactactatgtgtaaagatacactaataatttgtatttcgtgtattagtccaatagttgaggtttcttatctattatctgagatggttcagcacgggcttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggtcagtattctgttctgtctcacctaatgtcttctttcattgtacttatcaaattttttattgtttcttagaatgaattttggtttgataaaatatgacctcatttagaatttcatcggtgctctcgaactgtatggattcacacaaactgcaatgtatattaccagcttttgttttcttctaaattccatctagtagaatatatatcatctgaatgctgtagacatatcaaagatggtaatgttactaccttctctacttaaaaagaactaagaacttctgttactaatgttacagtgtacatatgcaaatcaagctttcgttttgtcctcttgaagagtatgctgtttgttatgtgaggggtggtgcattgaagcgcttcccacaaaataaagttgtgtactagccagaaactgactcattttctgataaattgagaaaattctaccttctgatatttgcttgctgaatctgaacattttacggttcttcatgtgttgactgttttgttcctgttcatttgaaaacaaattatttcaggacaggagaaaaattgaggccaacctttttcagggaaaacttcttggtgttgctgccaccaatgctcttgaactagggattgatgttggccatatcgatgcaacattgcatcttggatttcctgggagtattgctaggtaagtgagaggtggtctctccaatggatcctatatttctgtctgaagccctactaagtcatagaaacaatttaattttagcctgtggcagcaagctggaagatctggaagaagagcaaaacaatcattagccatttatgttgcctttgagggccctttagatcagtatttcatgaaattcccacataaactatttggcaagccaattgagcattgccaagtcgattcacataatcagaaggtttgtacatcagattttgttggtaaatttaaatgcataaggatctaaaagcttccttcttaatttgaacatttattacagcttttggaacagcatcttgcttgtgctgcttatgaacatccattgtgtgtgcaatatgatgcggattacttttgttctagcctgaacagtgtaatgatggccctgaaagacaaaggctgtctcataaacaatccctctggacctttctcatcaagcatgtggagttatgttggacctgaggtttgttcctttttatttgttatctttacaatacaactcttttggttattatgcaagaagtattttggttttctgcagaaaagaccttcacaggcggtgagcatacgggcaattgagcatgacaaatacagagtaatagacaagttaaataaccggttactggaagaaattgaggaaagtaaggcctttttccaggtaccatgttctaaactgttcctcaactcaaacgtgtgatgaactgtcatacttgttggatctttgaacatactctaatgcccgtaaagagatagataaatttatgagtttgttgaagaaagtcataaaatttatgaactcataagcactatatactgtattgttacctaattgatatactaattatagactgcatctgccactgtgtgttttcatattggtaacttgctatctgaattttttaagcattttcttcattcttaggtgtatgatggagctgtatacatgcatcagggtgtcaattacttagttgaggaacttgatttgtcatcaaggacagcattctgtaggaaagctgatttgaagtattacacaaaaacacgagactacacagacatcaatgtccttggaggagagtttgtaagtattcaaaaggattgtgcattagcctcatatacattctgcttataatcgtctatcattataatattaatccctgccaaattttattattagcaccatttttttgtttaaatctcttctatcctgattttctaggccttatcctgctcattaaatctgaggattattcatctagtctgtcttagcactaacatcttcttttccatgccatgcttattttgactttttaaaactgttttttgagttgttttaactcaatctagttttattcagcctattttttcatctttgttgtacgttttccctacattttttagaagcccatactctcttgaactaatgaaacaggataggacaaatgtttatggtactcctaccacagtaataggtctactaaaatgttttaccatcatttagtcaagaaactttccttgcctgacatgtgcatgagtgatttccatgctgatatttaattaccaatgatctcttctactctaatacatcttgaaggctcatcttccaccaagtatgtgtaaaactaacggggtgaagacaaccgcccaagcaaatgattgcaaagtgactactaaatggtttggtttttatcgcatatggaaatcaaacaacaaaatatctgatagcatagagcttaacctgcctccatattccttcaattcccaggtttgtatctaaaatatatttgtgtgaaccttatcaatatcatggtgcattgccgtccatgattgataccctcatttttcttctgcgatgcctaactaggctgtttgggtgcgaatcccgcactcggtgaaaactaatgtcgaggaaaggaaactacagtttcgaggtggctcgcatgctgcttcacatgctctgctgaacatagtgcctctgtaggtttttcagttttagctgcatcataataaataatcattaatgcagatagttgaatgtgcatacatttgtgcaggcatatgacgtgtaatgcttctgacctaggaacagaatgtgcaaatcctcatgaaacccgtggtattccagacagaattctgttatacgataaacaccctggtggtatcggcatagcattgcaggtaaaatgtttgatgatgtgtagcatacccaggaacctagcgcggttgtaaatatttaccagcaatgctacctctgaactatattatctcgtttatgactatgagatgatattgttcgttgattcggtaaaggttgaagtctagattttcatttatttaatggtgtagatcaaatcactctttggggaactactacttgctgctttagaacttgtttcagaatgcaactgtactagttcagccggctgtccaaattgtatccaagtaagttccaatgctgtactaaactcaactgttgatggaaaaaaacatcttcaagatgataagtttctctcttttttttcagacactaacatgcggtgaatataatgaggttttggacaaggaggcagcaattttgattttgaaggttaataatctgtgcttgctaaagttacctaaccatcttccatcctacacctttcaacgtaaaattcgcttgctctaagatatatattcatgtgcagggagtaattgaatatgaaagatcatattttgaaaaagaagatggttccgaccaaggagtgagatgaggttttaacttttgacgtcttcgtgaagacgagtgaatttggttgacacaggagccatattaatattttcttcacaaggctttctccattggaaatggtagaattgtttggttatcatacggaaatgtagctctaaccagagttcccattcaattataaattatttctggttcaattgtatattttattttgttgccatcctgtaaccaccacctctgtttatcctgaaccaggtcatgggatccccaaattgcctgccacctgcgatccccaagcttctgtgaagaaatatgtcgaaagatttgaacctgtgattaagatatctgcagttttcccttctgatgagatggaagaaaccatcaatttctgctgcgggtactgcaagaaccacatcatcacgtgtaatctaaacaagcctttgaagagttggttgcaatgtttttataagttccatgtttattatctggttcttttaatctctttttgggaaatctgggtgttataatctaggagattaaccaaccacagcactaaaattcaaacttctcagaaggataatacgttgattgctgattaatgaaggatggcgaaaaaccatgtcatagagcgggtggacctgttgcttcatgtggtttctgcacggcaggggcccggcaagaaatgggcctgttcggttgtcgtactgctgcagctgttgtcgatgctgtagagattggtagcggctggctgtattgccgccacatttaggcctatcgggcaggcccaatatatactagccgtttaatagcaagatggttctggcatcaaagtttgtaaacggacgatgtaatgggttaccactaaataaagcaaggttgaagcatgaacataaaacaaatattgaagcttagtattcttagtttactacctttcatttttgttttgttgtattcctcaattacgaggcttcaagtttaggtaatatttggctgtatgtatagaggccagatttctatatattatgatcgcaaacaatgttaagagaattgttttagttggggtgcaccacgcttaggctgtaggcaatgcttaaatgacactagaggacgctccctctcaaaaaaaaaaaaccgaagtaagcatatgctctctccgtcttaaaaaaaacctaacctattataggttaggtttttttagacggagggagtagctcacatgtaccgataagaacatatgctccctctttctaaaagtctaaatcctatttatttttcaccaaaaccaagtgtagttaactcattcatcatgtgataaaaccaatgaacatgcaaacaataaatactaaaatgacttcttggtttccgataaaaaatttaatatagcacagtgactacagataggacttagacttttggaaaaaccaacaaatgaaataggtcttagacttttaattaaaaggaggagtactacatttgatcttagtgaaaaggccgaaaaagatatgagtggtaccgtgtaaccacacggcctcttgtagtgtgcccctccctgcttgaatcgtcgatgtggtactactcatctccgcattgtccatggatgcgatacgcgatacatatacgacccgtgtgtgacgcgtgacgatgcgatgcacctcctctggtttttcctttttgtttcttccttgggttcctggctacagggaactaggaattttttctgattccaaacgaccggccttgccaggacaggctaggctcttggatccaaacgcaccctaagggaagctcgatggcatatgccactaccttaatttgcatgcagcttttcgcggttcttcgttcgttgacctccatcgatcgaggcgcgacgtgttttagttcggtcgagtaaatatcatcggtcggccactgataatatggatgcatgaatgcagccacccagacgtatccgttgcatttgcatttgcatgcatccatccaagtttggctggcctagctagctctccacatacgcattcgatcattttgcatattgttcgtgcaaccactgcatatgcaccgagcatttcatttgatttgatcgatcgatcgatgtggtgcgctgcccattttgccgtatgcgatcgagtattatatgcttcgtccaccacccaggccgtgatcgagtgatacgaccgctggcgctacctagctagatgcaatcacacaactgcaagctaatactccctccattctagctagttccatcatcatatttcaaaaaaccgaattttcaaatttgaacgttacattcgtagtcggcaagccgttgcatctcgatcgatctcgtccgacgtgctggccgtttcaattcgcacgcgaaatgggagcactccgcgcgcagaagcctgttgcatatgcatgcgaaattaatagcatttatagttgactacaagatagttggttctgccgcgatcgtcatgcatgcatgctggaccgttgacctgggagatgatatatatgtacatttgttatccttggtctttgcatcaagtcaaaatatgatgatcaaacttaaatacactagaagataaaaacgagtgaaaacggcatcatgtctataaaagtagttcttggttgattgggaattttccgtatgtactaatctactagttatttagggacaatatcaatatgacaccgatagatttttttttaaaaaaaaataaagttagcattcctcagtttagaaaaatactacatgacggtataccgttaggacagtataatacctctgagatatcggccaatataccccgttcagacgggataatacgtctgaggtatcgctgatacttgataggtatcggctgatacccaaatattggacaatatttctgaggtatcacgttcaaacgggatatcatcacgtagcattttccgagttacaagcctttgcacaattcgcctctgctctcgataaaacaagtcagaatcaattggcaaggggtcgacgattacgagaattgtttagaatcggagatggtactacttttgcgaaacgacagtcggttggtggagaatttcctccggtgttccattacgtgcaagctaacgttatcgttggctggatgaattgagcactagctagcaccaggctgctatatagcaccggagcagctggtgtttttctgcgctggatcgaggccgtgcagtggtcaaccaactcaaaggcaccggccactgatctatagtacttactttgttgtgctcctttgctactagcatctgccactgctgatgatcgatgcagttatctagctagctagtcctctcttgaatatctcgtcaaattacactgttacagaaggctgaaaatgatatcgatcgacgtcgtcgtcgccatcaaaatggtctgccgtgtactgttcatatatatagtggttgacctgtccatttatttttcttatggtaaaccgcaacccccttaattttcgggggaaaagatatacgtgtacaaagaaaatttgcaaatgttttagatgttgatgtatcacacactgtaagtaaaatcctgattttctttattacactttcaactaactaaatcgaactgtcaagatctttgtttgcaagaaattgttcaagtatatatgtatatcacttctcttaattttctccctggatcaactcaagcatgcttgcttgtagttgtagaaagtctcggatttttcctttgctttgtacttcttctacctctaaatacaaagaattttaattataattacaaatatgcacatgtccagattcaaaaaaaaggtgggcaagcgaaaattgctcttgcaagagcaacatcaagatataggtaggtggtggcagtcaggtaaaggtaggggtgaaaacattatgaaaatttcccgaccgtaccgatacctttcctgtaaataatacaataataatatttttatcgactattacagtttctaaaatttagtttttctaacttctatcaatgttgcgttgaaatcaacactaaatagtaaaattcataaatacatatatttcttgaccgtttcggacttctcgaaaaaaaataatattgtttccgaccgttttcgtccataggtagaagcccttgctcagatctgactcaaaacaagccccagatgctgccagtacaagcaagcaagcactattacatacaggtactgtacctgtcatccaattagaccggggagatctttccctggccaatggaatccagcctcacttgaccctgcccccaaaagcccagtggaagaaacttccacagtacacatatcacacacactagtgctcactcaattcaggcttcatccatccttatcctccctgcctttttgcctggccctttcctgctgcctacttgtctgtgactgatgaaagctaagtgcaactaactacttactactctatacttacttgctgataagctgattcatgccatgctatgacagggaggatatacagcaacaagaaaagcaaagaaaacatactgcatggtgacacctagcttgagaattatatatataagtgcttaattaagcagcattaaacttttatgttagcactgcataaagtatatgtagagggtcaggtggtgactgatcacagatcagcaatttggatgtcatgtcat

SEQ ID NO: 35300 - DNA, 2005 bp, Oryza sativa
  unsure (1)..(2005): unsure at all n locations
gggagatctttccctggccaatggaatccagcctcacttgaccctgcccccaaaagcccagtggaagaaacttccacagtacacatatcacacacactagtgctcactcaattcaggcttcatccatccttatcctccctgcctttttgcctggccctttcctgctgcctacttgtctgtgactgatgaaagctaagtgcaactaactacttactactctatacttacttgctgataagctgattcatgccatgctatgacagggaggatatacagcaacaagaaaagcaaagaaaacatactgcatggtgacacctagcttgagaattatatatataagtgcttaattaagcagcattaaacttttatgttagcactgcataaagtatatgtagagggtcaggtggtgactgatcacagatcagcaatttggatgtcatgtcattgcttgcgcattaaggatgtgcatgcaggtagcctctagcctctctggatattttattttatgctctcactagtcactaatactgtatattagcagtagaagatagtactaggtagtaaaatttatttattcattttccaaaggttatctgtgccgacacctgagatcacacagccgacactctgaattccagaggaatccaaaacagcatatatatagcaccaatcaagcattctactaatatcaattataaccaagcaaaaaaacaaaattgggagaaataatgatggagaaaaaaaaagcatccatcgtctgtttggtcaccacagaacatcatggatacctactcatcagtaccatgccaaaataaactgcaccatcaagaaaagtcacccaaattaactaattaagcttgtttaatcatcttagcagcccaaacaaatgaaccatgggatcattattaggagaatttaagaagaagtcaatggaagcgaattagtagagaatttagccatataattgactcattttagcacattgagaaaaggaaagataaaagagagagaaagaaaggtaaaaaaaaagagtgaaaaaacagagattaagattaattaacccgacatgtcctctgattaattaattaccaaaacaccaaccaagaaagcaagctcatagcctgtcttgccggccgtatcccgacgacggggagggcccgccgccgccgccgccgccatggccatacgcacctttccctcccatcaccatctggtggtggtggtggtggggcggctacggctgcgcgtacccagctgacgacgccggcggcgagccgtacataggctgtcccatcatcatgatcatgccgccgccgccgccgtacatgccgtatccgccattgttccgggaagcatcctggtggtggtgcgagccggagccggagccggagccgccggaggaggcggcgccaccgccgccgctgccggcggcgccgatggccttctcgccctcgagctcgcggaacttgtggaggtagagcttgagcgggtcgatgtagtcctcgaagccgagcgtggtcatcgcccagaggaggtcgtcgccgttgatggtcttgcgcttctcccgctggcacttgtcggaggcctcgccggtgatgaaggagatgaactccgagacgcactcctgcaccgtctccttggcgtccttgctgatcttggcgttcgccgggagcgccctcttcatgatcctgctcacgttcgcgatcggcaggaacctgtcctgctccctcgccgacgcgtactcccccgcgttgctcggcccccctgactcgttgtccgaatccggcatcgcaacctcgatctcctcgatcgaagcagtcgaagcgaagcgaggaggaagacgaagaggagaggagggcgcgggggatgcagtgggatgaatcgtggggataagaacgcatcggggagagcgacgtggcagaagcgaagccgtttgtttttgtcgataagcggtgtgggnnnnnnnnnnnnnnnnnnnnnnnnnnnnnnnnnnnnnnnnnnnnnn

SEQ ID NO: 35301 - DNA, 659 bp, Oryza sativa
catattttatcaaaccaaaattcattctaagaaacaataaaaaatttgataagtacaatgaaagaagacattaggtgagacagaacagaatactgacctcagcaatgtagcctgcacgatatacacagatagtatctaccaattctttggcagtctcttgaagaatttcacgcctacaatacaaaatgacatatgaagaaataagtgaatacaagtaatgtaaaacaagaaaaaacaacacaaaaatgaatagcagagaagaaaatgggttcttacgtgtatgctagaacaagctcacagagcttccttgttttacagaatgcaatgcagcgaagcccgtgctgaaccatctcagataatagataagaaacctcaactattggactaatacacgaaatacaaattattagtgtatctttacacatagtagttataagaaaattatgaatatagaaacaaacactgctgtactggcatgccataagaaacaaaatgctgaagtgttaaactgcaataactaacacatttacatgccactacagaacaattatatgtttacaatttttggcttaaaaattaaacatcgtccctttgtactgtgatgaactcataacttttgctttcaagtccacaacaattactgtatctcatcaaataaa

SEQ ID NO: 35302 - DNA, 740 bp, Oryza sativa
  unsure (1)..(740): unsure at all n locations
aagcaacaggttcaaccgctctatgacatggtttttcgccatccttcattaatcagcaatcaacgtattatccttctgagaagtttgaattttagtgctgtggttggttaatctcctagattataacacccagatttcccaaaaagagattaaaagaaccagataataaacatggaacttataaaaacattgcaaccaactcttcaaaggcttgtttagattacacgtgatgatgtggttcttgcagtacccgcagcagaaattgatggtttcttccatctcatcagaagggaaaactgcagatatcttaatcacaggttcaaatctttcgacatatttcttcacagaagcttggggatcgcaggtggcaggcaatttggggatcccatgacctggttcaggataaacagaggtggtggttacaggatggcaacaaaataaaatatacaattgaaccagaaataatttataattgaatgggaactctggttagagctacatttccgtatgataaccaaacaattctaccatttccaatggagaaagccttgtgaagaaaatattaatatggctcctgtgtcaaccaaattcactcgtcttcacgaagacgtcaaaagttaaaacctcatctcactccttggtcggaaccatcttctttttcaaaatatgatctttcatattnnnnnnnnnnnnnnnnnnnnnnnnnnnnnnnnnnnnnnnnnnnnnnnnnnnnnnnnntt

SEQ ID NO: 35303 - DNA, 1142 bp, Oryza sativa
  unsure (1)..(1142): unsure at all n locations
nnnnnnnnnnnnnnnnnnnnnnnnnnnnnnnnnnnnnnnnnnnnnnnnnnnnnnnnnnntgtagcaacttagcaagtagccatggcagctcagtttcagtttcagtttcattgtctccctagcctgcaccatctcttttgattttcttttttccctccagaatttcaaatggtagttacaagccccaggtttccctccaccctttcaaatttctgttacattggcagtgtagccgatgtattgccaactctcaaaactgtagtttccctccaaaggaaaagcccgggaaatgccccccctttcaaatgccccctcaccctcagtagccgttgctccccctccaatttgaatttttatacttttgccctagttggttgaactgtgttgctgtgtgtggtaagagtttctcactggggagtgtggacgacggtgccaccaccccggggggggcttctgtacgcgggcgctgcgtgctttgagataggtgaaacggctgtggttgcagcgatgcggaggcgtccgcggccaaccaacgaaccagccacctctgtgggcgagagggcgggcaactgggctcccggtgctcgcagcagtaagagccatttctttaccaatttttggaccgagcagatgcagcagcacagcccgcggcggctgcgcccgtgtccacggctcacggcatgggtcctcctctctcactgctcaccgggccccactcgcaggcaattctgttgtggtgggggcgggtggtaactggaccgggtggtgaggtgaaccacggcgcgggagtgggtgggtgggtgggtgggtgggtgcgcgttgtcggtgagcggctcgaggcgaaggggaggagaggagattcggccggatttggatggatgccttcttttcttccttggatgcttctccctcttgaaatgacggtattgccctccccctcctcgtcgttggtgggggcccaccggcttgaattaggcgcacacccccagctggctccccaactttgacacgtctctctgccgcgggatccgaattaaagaatgggcgaaacgcctagagaccacgcatactttgggtgtgggtnnnnnnnnnnnnnnnnnnnnnnnnnnnnnnnnnnnnnnnnnnnnnnnnnnnnnnnnntt

SEQ ID NO: 35304 - DNA, 974 bp, Oryza sativa
cctgcaaagcaacaaacagatgaatttttgcccgatttcagacaatcaagcctaaaacagaaagtttctgtctagacctttgttgaaaatatatacaaagcacatgccatcaggttttgacagagagattcaaggactggaatgttatagcacagagactttccactagatgttgatgttgcaatggcaacatgccttccagcaatggaagagtgtatagctcgagactgcaatcaagtaaatgatcaacataatcggtgagcttctacaactgaatgcaccaaatagatggcacaccctataatacctggtggctgtacaacctagatactccaatactttttaatgcttccctcgtagcctctgaaagatgattaggaagttctgcaaaagatgccgctcgacatggtatctcttcaatatgtacaatctgaaaatataatcccaacaacataaatactatggttttactggccttgttagttccagaagttcattgagtgaatacctgtccctcctttccaagtccttgtttcagatggtcaaccatttcagcaggccctaaatggcacgtgccctgcaattttcatcgtattactcaaagcaatctaacaaacaaacatgtaatatatgttgtggttaatgcctcctccctcaaggaacagtgcaacacaaaggctgcaatttggatttcttctatgaatgtgaaagtcaaaaagtgaaattggcaggggaatatataacggcagagtgacctacatggcaagatgttgcagcagatctggcaatgctacttttcttatctatgctaggctggccagcagcactgttcgctccagaggtaggcatttcgttgaatgcatttccattttccttacatggcttcctccttttatttgaattcccagtaggtaacctttgatctgttgacacatcctctacagaattcccagaacaagggatagtgctttggg

SEQ ID NO: 35305 - DNA, 716 bp, Oryza sativa
  unsure (1)..(716): unsure at all n locations
nnnnnnnnnnnnnnnnnnnnnnnnnnnnnnnnnnnnnnnnnnnnnnnnnntaaacatattcttaaaaaatataaaatacttccttcatttttatttacgtgacattggttagttcaattttgatttgaccaatgtcaaatagaaaaaacatatgttgtattaaacatccaataagaacttagtgagattagggatttgcaactgctctctatctctttaaacgagtattcagcggtcatacttgttgtgtgtagtggcgtatgtgcgcgtcccttctaaatagaaatagaagtcggtttttcttataggattatttctcatggtaacagtacactactgatccttaccaagaattaccacaaaaatacctgtggttaatttgggcaacatcctgacttaattagacagtagtaaaaggcagcaacagtagtagtaacagcagctgtggtttaattttatttatttattagttacctggtacaaggaccttgcgttgccaaagatgaaatcgatggagccctggatgtcgcagttgtagaggtagtgcctcccgatgttgtcgaacagcgtgtcctgcgtccccagtatcctgcacttgtacagcaccgtcttgtcggcggacaggctcagcgccaccggctggtggtccaccggccccggggccggcgccgccgccgagttttgcaccaccaccacccttggtacattcaggaaca

SEQ ID NO: 35306 - DNA, 757 bp, Oryza sativa
  unsure (1)..(757): unsure at all n locations
nnnnnnnnnnnnnnnnnnnnnnnnnnnnnnnnnnnnnnnnnnnnnnnnnnnnnnnnnnnnncactggttaaaaaaaagaaggaaaaagtacgaactacccctgaactattggttgagtatgaattaccccctaaatattaaaaccggacgtttttcaccctcaactatcgataccggatgaaacccccctcccgagcagttttccaagtggttttggtctacgtgacggtccagtcagcaattttttaattaaaaaacgaagggacccacctgtcagatatctctccactctctctttccctttcctctctctctcaaatcatggcggttgcggctcgagcgccgacggcagcggacggctccagcgcctcgacgagccgcgcggcgatggctgcgggcgcttcctccgccgccggagctccgcccgctgccccctccacctccctgagcaccgctggctgcaagcatcccctccgctgcctcaacgcgccgcgcgccggtggctgtgggcgccccttcgccggcccaagcactgccctccgccgtcccctcctcccaccaccccgagccccgcgcgccggcggctgtgggcgccccttcaatgccagacatgtttatctcctgtactatgctttgccactttgcatcggacaaccgggtgaaatgagcaagagagcgatgagcgatgaaaatggtgaattacatattgcgcacctgcaaatctcaccgcagaaagcggggcaaattacaggtgaaa

SEQ ID NO: 35307 - DNA, 975 bp, Oryza sativa
  unsure (1)..(975): unsure at all n locations
nnnnnnnnnnnnnnnnnnnnnnnnnnnnnnnnnnnnnnnnnnnnnnnnnnnnnnnnnnnnttttttcaattttgcagggataccactcgaatgacagtgtgtcatttttgcatttttctagtggcagtcttgcaataacgattcaatccaacagcaaatttgcaattgcccctagcttggaaggtcaaaattagatacggactgcagaaggatctattttatcaaaacaacttgttgtttttcattggaagaaaggaccagaaaaaaaaattcaaaaaggaaatttacctggaaaatatatttgtaggctatcagctgaaatgttgtctgcactgactagaactccttcccaccagccactaaattgccatacatcaacagcagctccaggtaaaagattagttccgtcagccaaactattttgttgagggcgtggcctaactctgcgtcgctctgggcatctcaatcccagtttatcaggacgagccaatgttgatacaggtacccactcctacaaagaagcatagaataatctcatcctcttatgaaagcatacattttacacagagttaataaaataaatcatggcattacgaaaaagaatagaagtaacaacaaaataccaaatattatggcatattctgcctttcaaaaatacatataccacttaaatttcaaactaagaccagtagtcataccttcaatctcccactatcatcagcattctggagatcatcatactgaaccttcaatttgttatgattagtacatgacttgagaactgtacacctgaaccagcagcctacaatcccactgtcctgagacaagacctctattctgtcaccaacattgtaggttggcatacgctgattctggggccctatgaacttgactgaaagatgttttctgggagaatgcttactgcttggtttctgaaagatgctatggagtcttcttgtgggcctcggcagattt

SEQ ID NO: 35308 - DNA, 688 bp, Oryza sativa
caaaccgttgacaccatctccttctcgtctgcattctgtcatagtgtcatcgccaaattaaaagagaatgaaatgcatcaacgataagctgcaacacatttattttggtagatctttgttaaacaataagagcatgcttgtcaaaatttcaccataaagtaatgtgttaacaatgaattcggtgcattagcaaaatactagtgaacttgacataaccccaaagattggtcagctagtgcaaatagggaaaagatgtgcgcactaattttttttaaaagaaccattacaaaagcagatgtttcacattgtgactgaatcttgacttttaataaaggcaaattgactcaatcagttaacatttttgttagtaagaagtttgtaaagaaatttttagtacatgtagcattgctcttgcaaatacatatcaatggaaatgttattattgtggattttttaattagaagttttttcccaactgtttcacagacagagtataaacaagactaaccagaatcttagaactggaagaatacatcttctgcatgataaccgcaattttgtacttctccttacggaacatatcagggggcgtacgcttcaaaagatcaaaattagaggcattaggaacaacaaatataaatctaaccgcaggaaagtttgctaataatcactgactcaccttataagg

SEQ ID NO: 35309 - DNA, 1331 bp, Oryza sativa
gttgcagtcaaaagagaatttgtagaggggtccaaggcgaagctaccatagtcttcttgcaagcaatggtgaacggaatcagtggtgtcagcggtacgggcgccggccaagttcgggatggtggtgcatgtcgtgttagagctcgatttagcctaagggaatgcatgcatgtggtttgtagaggctctagagtactcaccgaatcgcacacagggttcggcaaggtctagacatcgatggtgatggagaaagtctccaggcggcgatgcagagcttcacgacgacgatgatggcgcgaaagggtcgatgagccgctagcttgtggcatgcatgagcgtggtgaggtcatagggacagcacgtgtatagggaatcgggcaatggctcactggtgtggacggatttgacgaagatggcggtagaccggcgccggagaagaaaaggttgatctcccttctcgcttcatcgatcttggcggttcttggggcgttttgaagaggtgctcgaggtgataatgatggcgaggcagcttgaccggtaatgctccacggtggtcggaacgccgaggtcgctatggcggcggtgctcggagcatgctcccgagctctggtggcgaggtcgcgttccaacgccgtcactgcacgaaatggggtgtgattagatggaatggagatggcactgaaaggagatgatggaacgggcaaaagatagagacgaccgcgactcgatggcgatgacggcctttgtcttcaccacggccggcagagaagatgagggcgaggaggatgagatggaacacctcgcatcagtttcttggcaatggggtgaagagtgatgtcgtgcgacgttgctgggtgagctagagggcgaggagaagcttggagccgtcgacacgtcgtggtcacgcaacctcatcaccgttggcgacaccgcaaacatcgctgctaccctacctcccatccaccacctcgctgacatgtaggcccaaccccattagcggactctgactgggactggttcgaccagacccggtcgagtttagattgtgcaatgtcaggggcaatctggtcatttggaaaattatctcccctcttttgtgttggaaattataaaatattgcctccggtgtcctacagctaattacacaacttttgtagtgtccatggacagtgtcacgttttttcggtgtctcctagctaattacacattttttgcgtgtcctgtagcaaattttgcctttattataaccttcaagctatcttttttctgggctaaaatataataaatctgaggttaagactttaaacagaaatataatgctattgaaacatg

SEQ ID NO: 35310 - DNA, 708 bp, Oryza sativa
  unsure (1)..(708): unsure at all n locations
taaggtgttaaggactcctagtatgagtttggttcgtggctttaggctgcctacctcatgtataaatagagggggagcgtgaggcttcccggtatcgctttagagagcaatagagttgagttttgagttagggtttcgagtttagtcgaaatttttgtaaagattgctgttggtgcactttgtaaacacaaagagaatcaataaagtcgtcatctactttatgagttcttcgatttgtgtttactgggtttcggcggtctaaccggcgatctacgggcggtcagatcggcgggagcacggcggtcagaccggcgagagcacggcggtcagaccgacggcggcgatagcgagcggcaggcgatctcggcggttaaaccggtagatcaacaccggtcagaccggcggctacgcttcggtcagaccggctaatctacttcggtcagaccgatctcatcgaaattgagggtaacttttattttcgctaaaagttttcggtttttgggtataccaaccattcacccccctttggttggcttagttcttgtgattcgatcctacagctgctggtcttgtaaccaatccaatagaacaatctgaaaaggtatccaagagccatgcatgagataacatgatgctcgatctcttgttgcagcttgcatgnnnnnnnnnnnnnnnnnnnnnnnnnnnnnnnnnnnnnnnnnnnnnnnn

SEQ ID NO: 35311 - DNA, 739 bp, Oryza sativa
  unsure (1)..(739): unsure at all n locations
gataacatatcttgtgctttcaaaactagcacggattgtgttgacggtgccagtgtcgacggtgtcctccgaatcggcctccagtctatgcgcccgaatcatcgaagaccggaggacgactttgcgaagcgaccacatcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaattttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaaataccattttttcttttttttaacattagcaaatcattactttttttaaaaacttttatttccattttttaaataccattttttcattttttaacattagtaaatcattacttttttttaaacattttatttccatttttaatttttnnnnnnnnnnnnnnnnnnnnnnnnnnnnnnnnnnnnnnnnnnnnnnnnnnnnnnnnntta

SEQ ID NO: 35312 - DNA, 676 bp, Oryza sativa
  unsure (1)..(676): unsure at all n locations
actatagggcgaattcgagctcggtaccccgccgccgtctcccgcgccgccggtcaccgccggtgaccgcgcgtgtcgccgccggtcgccatggccgccggtcggctttgaggccgagccgagcccggccggcgcctccctcgcctcccctttgagccaccgcctggtggggcccacctgccagccgccccctccctctccccttgtgccgctgccagtggggcccgcatgtcggcgccgcccccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35313 - DNA, 947 bp, Oryza sativa
  unsure (1)..(947): unsure at all n locations
nnnnnnnnnnnnnnnnnnnnnnnnnnnnnnnnnnnnnnnnnnnnnnccacatgtttttttctcataaagatacatatttttttctcgattttcgttagcacgttttttaaaccgtacgactactttttatatagaaattgctttaaaatattgaatatattaatttattaagtttaataataattaaaacttaattaattatgtcctagtagctttctcgttttacgtacgttgaattcatttttatcttcatcagttttaaacagtgatgcactagcccagtagcccatcactccggcagattgaacggcccatccagctcgggctcaaatcccacgagcccaacatctcggcggcggcggtcgccctcctctaccggtgccaccaagcaccaacaagcgagattccacgtacgcctcttcgtcgccacaaagcacaaaataaccgtactgctttaattatgctcctgctgcgagtcaaccagcaccaatccactgtttagctttctgatgtacagtgacatgtccgatatcaccatcacctggctggcaaaatctgactttgttctcttagcacgtgtatatttgtactccctccgtcccaaaaaaacaaatctgagttttcgtgttcaacgtttaaccatccgtcttatttgataaaattatgaaaaaaattaaaaagacaagtcacgcattaaatattaatcatgttttatcatctaacaacaatgaaaatactaattataaaaaattcatataagaggaacaatcaaatgttgaacacgaaaaactaaggtttgtcttttttttttggacggagggagtatgttaagattcagtgtatttttggtccgttcctttgctttgatacgtcacactttagtcgtcgtgcactnnnnnnnnnnnnnnnnnnnnnnnnnnnnnnnnnnnnnnnnnnnnnnnnnnnnn

SEQ ID NO: 35314 - DNA, 9313 bp, Oryza sativa
  unsure (1)..(9313): unsure at all n locations
nnnnnnnnnnnnnnnnnnnnnnnnnnnnnnnnnnnnnnnnnnnnnnnnnnnnntgtgtttagtttcattaacatctatatgtatgtgagtaatgctagaaagtcttacattgtgaaacgaatggagtatttgactccatgttgaagcttaacaagcaaagaggcctccatcgtttgcccaaatgaaatcaaccatggctaaaatttgaattttaaaacttgatttaaaattttcatcaaagtttattcttcaccatgaccttttaacttgataagaacacatatataacagttttatcaacaaattattattatcgctaatatgttatatggtgtattattggcttatgccttatgccgatcaatggggacaaaagttgcaaaatatgtatatccatggttttaaaatccatttggaattgccaccctttgaacacattgattccaaatgggtttcttttagtatgaaaatagttcaaaaaaatattgtatagacaacaagggcatattctatactacttcctccatttcacaatgtaagtcattctatcatttcccacatttatattgatgttaatgaatttagacatatataactatatagattcattaacatcaatatgaatgtgggaaatggtagaataacacattgtgaaacggaggaagtactacccttcgtccaaaaaaaaacatggctgtgtatatggacatacatacatatgtccagatacatagttaggatacgcatgtctgtatacatagccagggtttttttttatgaagagagtgcatgtttctaacttctactccttcgttttccgctcacacgcttttcgaattgctaagcatgattttttctaaaaaaaatatatatgtaagaaaattgctttaaagaatcatataaatccttaacacagcaaagtcagcaattccataaggagtttttagaatgaaatatgctagttcaaaatcttccgaatcaatggagcaaaaattcttttgattcagagaagcacaaaagtttcccggataaaatgtgaacagtttttgtgccaatttgtttgattgagtaaagcataaatcaaaggtgtgaagaagcacttggtaatttacggatgctttaagctttataatgttctcagtttgtttgcatgcatactgtaacaagaaggatatagtagcacatctgcacagcgaacaaaattgcttcagggaaaataaggcactttgcttagaccaaatgttattacatttcacacatttggaccaactcaagcatacacatgtttggcctgcctacaatggaatagctatcttttttttgtatatttcacattctaggagatatcaaaggagaatacagattattgtgtaactacagatatcttgtatgatggtttctatctcctcccagggaggatgtgattacagctgcttcttagccagatttctgctttgctcaatataagggtgaactctttggtactgtagtatggcccagacaaggtgcttgaaagagaactccggccaaagagggtctggattctgcaaatgactgaacgtcgtctgccacagaaggaaattgctcaggcgagtctcgcctgaggtccggatcacaatatcaggatcggggcaaccagcgctgtacatatggtggtccagatctgccactgaaatatctgaatgcacaccattattcgcaacactgtcaacatcctccctctgcagtatatccctcctttctgcacagaccttattgaccgcaatgacaatctcagaagtggagttgtatggcatgcaaacagagaagaccagtcccttgttttcagcagtgctaaccatcagtttctcagctgctaccctcaccggttcgctcaacatgtccaacttcccccagaagttgatcttacagttaaccttgttgatgacatttctgttttctagcagttcattgatcttttcctccattaactccatcaaggatttcacctcagtcagatctcgcttaaaattatcgatgctaaatgcatacactgtgatatacttcacgcccatttcatagcagtagagtaggctggcaatgagagcagagaagcccatcctgtgaccagagccttcctggatactcctgaatttagcatatctacggttaccgtccataataaatgcaatatgtttaggcattgggccatatgagaggacagctacgatgcatttgcggataaagttttgcagactcgcaaggacaccagtcgcaattaactcatcagggttctccgtctttggattctaaatgaaaaaagcaaaacagaagtatacgaatatcagcgaatgtcagcaataagcacaaaaaaaaagtcacagatctttgattatctttacatgactaataatgtttccacctgggtacttgttcagcataagagattaatctatatatcactgcatatgaatctaaaacttaccactgaaggtgagtaagagataagtgaaccaagcattttgatggggagggaccaacaggcagtatcaggcctgcaaactggaaaagacataaaattttcagacttgcttgctctgatcaagaaaaaggagcaagcgtttgccattggaacaggatacacaaagaagctatagattgctactccatccgtttcacaatgtaagtcattctagcatttcccacatttatattgatgttaatgaatctagacatatatatctatctagattcattaatatcaatatgaatgtgggaaatgctagaatgacttacattgtgaaatagaggaaatatctgctattttaagtatgttttccggaagggaaatactaatttcagaagaatggataccaaaaattattgatatttgatataagttctctggaaacaacatcaaactctttatatttagtaaagttttatcaaggagtatttgatagttaaactgaaaggcgtaacctttggatttacctagattttaattgatttcacttaaatttcctaacaaagtgagacaaagatgatggctagctatgcacggttgggctccaatccacgtgtgtatatcgggaatatctccattctcccatctacttagggcccctttgaattggaggattgtcataggaattttagaggatttaatttcctaaggattttttcctatgaaaccctttgattcataggaaagtataggaaattttccttaggattgcattcctatagctcaatttcataggaaaataagcaagaggttcaacctcttggaaactatcctttgctttgtttgtttcctatggtgctatcaaagggaccctcttcatatttcctgtgttttccattcctgtaggattaggaaaacatgctacttcaattcctacgtttttcctattcctgtgtttttcctattctgcgtttcaaagggacccttaagttttatgatgatatactactactcgtgggataaaggcaaaaagagcatacttttctagagtttggaacaacaagacaacaaataaagcatctgcacttctctttcattaacaagataagcacaccttttagctatcgaaatccctatgccgttgtaggctaaagaagctttcgcaaaaaaatgacgactttttagccagaagctttctaacaacgactagtaataacaagcacaaataagcaatcaatccagcacaaataacagctggattagcatcaaccaaaccacagccacagcacctcacctcacctcacctcacaggtattccatcaaacacgtggtgagcaagcaaacgcgtgtagcaaatcaagaacccaaggaggagcaaccggagcgcgcgcgcgagcacacacacagaggagacggcagctgatgagtagcgggatcgggcgctctctttccgccctctttatagccgtcgtccgcactccgcagccaagcagccccccctgcagcgcgccaccaccactccctcgcctctcccgcgcccgcgcccgcgcgcgcgccagtaaaaagagaaaagacactggcgaaacgggcggtgtatgtggagcaggttggccgcgtctccgcgacgccgccaagcttttggttggttcgacctcgagctggattcccttttagggctcaggaggaggaagaacgcggcggcggcggcggcctctccgccggtgagcaattgattgcggggaagaaaggggatcgggccacctaactcagcttttgcacagagcccatctcattgcaggctcttagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcacggcccgtttcgccagcggcccgtcaggccgaaagcgccagcggcgcactgacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttatttatgtcggtttaaattttcagaatggatccgaactttccataccagtcgccgtcgttcaccttgggtgatttcgaccccaactacatgtcggggtttgacgatacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccggtgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgtaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcagattgctgcatggaagaggttttgcaatgcggccggtgtgaaagctcgtaagtttgccaccgatgcagagcatcggtggaatgcaacatatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttatcacaagtttattatccaactgctaatataattttgcacaaccttcttgaaattgctaatttatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcgcccgaatcatcgaagaccggaggacgactctgcgcagcgaccacatcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaattttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaaataccattttttcttttttttaacattagcaaatcattactttttttaaaaacttttatttccattttttaaataccattttttcattttttaacattagtaaatcattacttttttttaaacattttatttccatttttaattttttttccttatacatttcctttgcttttttttttaaaaaacactgtgcactgggcctcaggcctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatacaggctctcacggccacctaactcctaattaaaccaattttgtttgagatgtttatttaagtatataggtaggtggtgtttgaaactcatgtaaataaagatgaaaattaagtgttttaaaataatgtggtattaacatatgattagttgagttttaattattataaaatcgaaaaatagatttatttgatattttagagcaacttctattttttttttgcgatttagcagttttaattagtttaatacagatcatgctaagcccaaggcccaccatcaccaggcctactttcacatgcgttagcggtttagccaagatttacagttgtttggcaacttcgagttaaaaggcttaaagctctcggtagcttaaaattcttattaacaattgcttggcttataagaatttacaaaggttggatttttcagtttttgacttcttgtttattttgtttatttcgtggattatataactatacatatattttttactgagaatctatagagctacatatgttaaaaggaattgtactcctcccgtcttaaaatataacagcttttagcgcttaaggtttgtcccaaaatacaataactttttcatcaacattctcttctaaaccaatcacaaccctccacaattcaatcttctcatctacctttacttctcaaccaatcataatcttatctcatttaattccacataattttttaataccggtgtctaaccataaaaatctttatattttaggacggagggagcagttgctaaaaacttctagtaaagggtcttggtgtcaacagttagtgatgatatactatccatcactgttaactgttcaccattcatactagtttatttaaatataaaattgaaaatgagacatagatgaatctcacgccttgaagtaaggattccacctaggattcccggcaaatttagttggggtgtccaataaaggaggcctaattagttcatcttgtagctcaccaacagcaagaaacactttgttgaaataacgtctaactgtttctccagacctatcaaacttagtgataactaatctatttctaaggctgtcccctactgtatttagaaacatagttacttgtttcttaatagatatgtggatggtatcgttaagcaaaccacgatttctaaagaacttacatagccaaaacaaagagtcttttctaaaaggtggtaataacgtaagtctaagtatgttgatacaagtggtatcgttcctccaaatttttgtgtctagatactcaattctcatcctatctcttttaactattgggccatatttaacacattctctcctagcacttctctttcttttccttgagtgaataatcatagccatcattaacaaaaatagattggcagcaacatcaaaaattaaaatcttggtcctcttatcaatatactctctccgaaaaaaaaaaaagaatctagtacgggatgtgtgacacat

SEQ ID NO: 35315 - DNA, 8334 bp, Oryza sativa
  unsure (1)..(8334): unsure at all n locations
aannnnnnnnnnnnnnnnnnnnnnnnnnnnnnnnnnnnnnnnnnnnnnnnnnnnnnnnnnaaataacgtctaactgtttctccagacctatcaaacttagtgataactaatctatttctaaggctgtcccctactgtatttagaaacatagttacttgtttcttaatagatatgtggatggtatcgttaagcaaaccacgatttctaaagaacttacatagccaaaacaaagagtcttttctaaaaggtggtaataacgtaagtctaagtatgttgatacaagtggtatcgttcctccaaatttttgtgtctagatactcaattctcatcctatctcttttaactattgggccatatttaacacattctctcctagcacttctctttcttttccttgagtgaataatcatagccatcattaacaaaaatagattggcagcaacatcaaaaattaaaatcttggtcctcttatccatatactctctccgtaaaaaaaaaaaggaatctagtacgggatgtgtgacacatcctaaaaatatagacatatgtatttctaaatttattgtattagaatatattatatttaatactggtttaattttttattggacgtagggagtacactacaactatcaaagaaaaataaacacgttgctcaaatcatctcatcaaaaggtagagtaattgcccacatcgcccagtcccagacccagctgctgagctcccactgccaccgccatactcgaggctggccatgaaggctcccgccgaccaccaccaccaccaccactcctccacgccgccgccggcgaccaagatctccatccccatctcggccgccgccggcggggcggaggcggcgctgctcgggaaggggcggtacaaggcgtgggcgctcgccgccatcgcgctcctcgcgctctggtccatgttcgccgcctccgtcaccatccgctggtcctccggcgacctcgccgccgagttcggggacctccccgacccgcttatcgacgacctcgaccccctcgtatgtctcccctaccccaacattcccttccttccttccagatcttgccgccactcggtggtcggtgcctaatctcttccattgttcctcaactgtccgatgtgtacatgcatttttcccaagtcccaacggtctgacattgcgaaaaaggagatgcattattggttgatttcagatttcatagtggggatgaaatgggtacttgtttcagcaaagtcacaaacagcttattttattagaaattcacatagtagactaagcattctgcaatctagtaattttctctgtttatagagtttcatttggacatacattgcatattttctcttctgaaaggtttagttctgtgctaagaaaatgctcattatcaaaaaaatgctaaggaagggtacacgctctgctggaaacatgatgatttttttttttggtctgatggtattttaagttgttccattacatggacgagaaagcagtcacctttatttcttgattttggtgtctggaacatatgctatttgtgttaacggtttaatttcccaagcttcatctgcataattgtctagtcaatatgaccagcagaatcctaagctaaaacatagacgagcaaaactatatgcattttttagttgtgaatgaaatcttgtactgaagttttgcctaatttttaaataatgagtaggagatggaggacagagagaagctagtgcgccggatgtgggatgtgtacacacgcaccggtgttgatcgggtacggcttccacggttctggcaagaagcattcgaggctgcatatgaggagcttgctggtgatgatacgcaggctagtgagacggcagtatctgagattgctcgcatgtcagtccacaggcctgaacttgaacaatcgtcgaacaagtattaggtatgaacaaattgatcctatccctgatcttgatgctgcatggagatagattttccttcttttaaattatttatataatcaaatatctatgtttgcttcgctgtgaggattatgctggtcataagtgtgattatcagatatgaaatggttaccaacttttgtaacttaatgaaaaaagggttacttagagactagagttgctagcttacgcaatattttctaaatttctggaattctaatacctaagtctgaagtttgagaattttttcaagcgtggatgcaacaaaatcagggctgtgaggcctctcttatcgaacatggatcccattactgttaagccgttaagggtgtgcctttcactatacctagttcccatttgtatgcttcttggttggtactgtattttctccactgactattggttcaagtatagaaagttcctatgactaatgacgtgcctgtgtttatttaggagggaaagggatgtaaaacaagatgccacatgttaatttcaatttaataaactataacatcatccaaggcatcttttggttgttagcatttccaattttgtactatttctatctgtggatgtctcaacgtagatgttaacaaacaatattatgggctatggcataacgacttaacgcatgaaggatgaagcacatggtcatcattgcagactttagctagagtaccatgttgtactggtgtagtgggctagggacattccgctccggtttccaaaccttacttgcctcagtatatcactcaatcgcttaggctagtgggatataatatcatggtactcaatcgcttacttgcctcagtatataaatactgccttgcatttgtgcatcccctgccaaaaaactgccaatctgtagcaatctggttgtgctgtctatgctgaatttgtttgttcctaatatatgcttttctattttgcagaaataaatgtgtaacatttggtgaagtggagatggtagttggaacctgaataagtatttaggattatgtaaaaatttaatatcccacttgaagatcacttgctaaatatgatcacagtttacttggtttgttagccaatgcaaaaattccacttctctgcagtatgcaaagcttaagcatatgctgatgacacagcaaaatcccacttccttgtaaagttttttgggatccagagtaacccaaatgagaatataccaaatttcggtaatctcctgaacatattgtgatttgtgaaaagatcaatcacaataaatttggaattcgggaatcacttgtacccatgttttaatcacccatgaacaaaaactgtttttgtatgcatacatatatgccatatctgtttgtgcatatggtgattctagaagcttctggaaatttccacagaacagcatgacaattacgaaatctctaaccagtaaccagtccatgggctgaaaccacaggaccatttcattgttgcaaggctgagcctgaaagtactagagcctatattgaattcatcaatccctcatacaaatacggactatttcagtccatttttatttggcacgaccaaggacatgaactcgttttaagttcacacttgtacaaagttgtctgactttataggctgactttgattttgagttgaacgacaaagtgcggtctgaaaaattgctttcaccgtgctcatttgtaaacgaaattttgatgaaagttgtcacgaataagcgtgtcgatttgctgaatttttgagtaatttgggcatagatcctacacaacccatgttcatttgattgcacagtaaacggctttacttgaactgcaggtttctgcagaagattacctaatcgtcaaaaatagctctagtgcattgaccttttgacagatttcagcagtgttaggctcgcacttacataatgcttcttcgcctaatccattataactagcaataggaaacaaaatggcattgaccattgatctcttgccattcttctcatctgaagcattagcgctttgttttagaaaacatttttgccaatctaatttttctccatttaggtcaagaaaagcagttaactatggaccatcacaattcacaagagctaggtaaaaagggttgagaaagtgggacgtgcatgctagactcaaccgttctgcactaacaacctactaactaccccgtttgatcagcctaccttgtccaaattccaccacgaaaattccccaaacaaatcttggtctctctcgtgcacaactcatgaacaacctttccaattcttgtaatcaataaaacaaagcaccaaccattatgccatgacatactaattaattaattaattaatcacaaaaaaaatactatgcaataactatcacacccttatgagttcccttcccacaaaacaagtccatgcaatgcaacaccatcgtgctagctctaccaacaatccactcttaaagaaccatcacgaaacagtcactgacaaataggtccccactatcacgcaacctggatgaaagcggcttttcgagcgacaaaccgctaaagtttttcgtggacgaaattagtctcatgaaaaaaaaatggtttttcgcggtcgacgaaaccgtgtacacaactccataagcaaaaacacccacttttgtgccctaaaatgttaaaaatctttgatatatctccaatgggcacaccaaaacacccatggctttgtgtgtggcgctccccatatttaatggcatcatcacttcctcacgcctccaacgtcttcttgcattccatcctttcttctcttcttcttcttcttcttcttcttcacatcgtcgtcgtcatcatccatggcgtgtgtaatgtgaaatcagcgagctcgatatatactccattaagctaagctggttgatctctcgtgtgttccaaattaatccgcgtggttaattagctctagctagagatcggtagctctcgactagttggacatggccgccacgggcgtgctcgtcgtcgttgtggcgctcgtgttcgccgtgacggtggctggcggcggcggcgccggagtaggaggtgatggcgggttcatcacgtgggaggacctgagcatgccggccggggcggcgcggagcagcacgtgggacgacacggccggcggtggcggcggcaaaaggagcggcggcggcggcggcggcgagcagcggacgacgatcgtggtgtcgccggacgggacggggcactcgcgcaccgtgcagggcgccgtcgacatggtccccgccggcaacacgaggagggtcaagatcgtcgtcaggccgggcgtctacaggtacgtgggtgttcgaccgatcgatcgcctccccactacctgtccctctcgtaaccgccatggacgagttaatgtcgtcctatctcgcgaagctttttaagactggaattgaagctgcaatggcgctgacctcgccggcgacggcgtgccgtgcagggagaaggtgacggtgccgatcacgaagccgttcgtgtcgctgatcggcatgggcaccggccacacggtgatcacgtggcactcgcgcgcgtccgacgtcggcgcgtcgggccaccaggtgggcaccttctactccgcctccgtcgccgtcgaggccgactacttctgcgccagccacatcaccttcgaggtatacacacaccgcacgtcgtcgtcgtcgtcgtcgccggccggctcgccggcggcggcgaaacgtgttcctggatgtaacaagcgtggtggtggtgcagaactcggcggcggcggcggcgccgggggcggtggggcagcaggcggtggcgctgaggctgtccggcgacaagacggtgctgtacaagtgcaggatactggggacgcaggacacgctgttcgacaacatcgggaggcactacctctacaactgcgacatccagggctccatcgatttcatctttggcaacgcaaggtccttgtaccaggtaactaataaataaataaaattaaaccacagctgctgttactactactgttgctgccttttactactgtctaattaagtcaggatgttgcccaaattaaccacaggtatttttgtggtaattcttggtaaggatcagtagtgtactgttaccatgagaaataatcctataagaaaaaccgacttctatttctatttagaagggacgcgcacatacgccactacacacaacaagtatgaccgctgaatactcgtttaaagagatagagagcagttgcaaatccctaatctcactaagttcttattggatgtttaatacaacatatgttttttctatttgacattggtcaaatcaaaattgaactaaccaatgtcacgtaaataaaaatggaggaagtattttatattttttaagaatatgtttatgtatagcatgataaaatctttggacactctgtcccccacactttgctctagttgtcctctagactagtagtactataccttttatgctgtgtctcctgttggtccgatcagagctgtcacaaactcacaattcaggcattcaccaactcttccattttataccttacagcaaaagaacttctcactctggtgaggcacctagattagcaccttgcttaacctagctatatagctaagtgggataaggtggttaggcacttagccctgcaccaatgccaccaatgctcttacacaaatcggtgttcagaattagtggtcacattctctttctaccttcggcacaactgtcactgaatgaaaaatgccggagtgagtgttaatgagagtgacattacatggcaatgtggtgccatgatcaatttatttttttcacgaacatgcaaaaaccttacacgtcaatatattattattagatcaatatacaactgtaacacgtggaggcagtaatatgccatgattaaaatggacaattagcttcttggcagtctgaatttttgtaactttgttttttctttttgtcagggttgcacgctgcacgccgtggcgacgagctacggcgcgatcgcggcgtcgcagcggagctcgccgtcggaggagtccgggttcagcttcgtcggctgccggctcaccggctccggcatgctctacctgggaagagcatggggcaagtactccagagtggtgtactcctactgtgacctcagtggcatcatcgtcccccagggatggagcgactggggtgatcaatcaagaacaaagtgatcaactttcctgccatttaatcacacactcaatttgctgctcttgattaaaattacagttacaattataattgcagctactctgtcaggttcacatggcatattaatattattgatcgaagagattatattttagctgaattttactagttaccaacttaccatcctcgatgatcaaatggcataggaagtggttgggagttgcattgcaggctcaccaaacagtcttgataggggaattcagttaccacatgtgacaaggctgttaccaaatgagttccttttcttttctgaaatcctagagacgatactgccatatcatatccgtcagaaaatgacagagaatgtgtctgaatcttctgacaggacggtgctgttcggggagtacaactgcaaagggccaggggcgagcacgaagcagagggtgccgtggtcgcggacgctcacctacgacgaggcgcggccgttcatcggccggagcttcatcaacggcgagcagtggctccggctgtagatcatcgccgattcttcacaagttcagaaagttcagactgctgctggttccttctccactgcagtctgcagatagaacatgtacctagtagatataatagctgacatgtaacgatgtaccatgtaacaaactttgacatacatccatatgtagtgagatgagcagccccatcatttcacttatctttatgcttattcgtatcgcctattattagcaaacaaaaagtaatttataggtaaaatttaatgatacaaaagcaaaatgttgtaaaataaaccacgatgaaaccataaaatcaacttcaaagattgagttttatagaattcaaagtttgcgatataatgggaccggagatttgttagaccagccaatcatagcagatgagagtttgcatgtgtaaaggaactaggtaatgcatcatatgaatgtgacatgctcgtgccagggacatcaggcctaacataacagaagataatgatatcatgggatggcattggcatcaggtagaattgacttcagatcccaggatgccacaaatagatgatacagaacttgaggaggagaaaaaaccactcattttgcaacttcttcagatcaacatgcgcaagtgccgttcatacttgatggatgtgcaattgcacaccatacccaatcacaatgtgggtaccgagctcgaattcgccctatagta

SEQ ID NO: 35316 - DNA, 2702 bp, Oryza sativa
  unsure (1)..(2702): unsure at all n locations
acttcttcagatcaacatgcgcaagtgcagttcatacttgatggatgtgcaattgcacaccatacccaatcacaatgtgtgattgttagtcgttgaatcttcacaacagcttaaatgcagatatactcttgtagcacaagcaagctaggacaagaatgttattcatatgaacttaaactatattaacaattgagaataaactgaaactatagtccagactccggaggaaaacataagagnnnnnnnnnnnnnnnnnnnnnnnnnnnnnnnnnnnnnnctggtaagggtaatatttagtttgcaacctctgtatctggtgacagaaagcctgaaagtgggaagctaacagtaaaacaagggaacacgtgtatgaaaaaagatgtcgatgctcactgatatcagcaacctagtaaaaaacccctctgctggggtccaattaccatatctatagctatgtacatacgtctaatgaggttgcgcttcccaaacttcacaatttgccaacatctatgcctacttccccattgcaatgttgttcagcatcatcatccctaggtcgctttcctagaactgtttgtttctggtcctctgcaaaagcagaggccatatcagtcaaactaacttctgctggctgatcagctcctgtttgtttatcttcactagagtttgtttgtatggctgcaagctcttggtcagacattgcagaatttctggagtccggcctctcaacagatgtcagattatcaggttgccttgtttgaacaccaaccgaaggtattttcgataacacatctggtttcatttctatatcaacccagtggctcttgacccaatctttcgaaattcttaaattctttagctggcatacactaaagaagttctcgcctgtaaaaacaatagaaatatcaacatgttgcagatgaaatagaggattaaagaacataggaaatcgttgtttgatgataaggaacatggtttagcttccatacgcttgcaaggaataccactggggcatttgcaaatttgccaatggttttttcaattttgcagggataccactcgaatgacagtgtgtcatttttgcatttttctagtggcagtcttgcaataacgattcaatccaacagcaaatttgcaattgcccctagcttggaaggtcaaaattagatacggactgcagaaggatctattttatcaaaacaacttgttgtttttcattggaagaaaggaccagaaaaaaaaattcaaaaaggaaatttacctggaaaatatatttgtaggctatcagctgaaatgttgtctgcactgactagaactccttcccaccagccactaaattgccatacatcaacagcagctccaggtaaaagattagttccgtcagccaaactattttgttgagggcgtggcctaactctgcgtcgctctgggcatctcaatcccagtttatcaggacgagccaatgttgatacaggtacccactcctacaaagaagcatagaataatctcatcctcttatgaaagcatacattttacacagagttaataaaataaatcatggcattacgaaaaagaatagaagtaacaacaaaataccaaatattatggcatattctgcctttcaaaaatacatataccacttaaatttcaaactaagaccagtagtcatacctccaatctcccactatcatcagcattctggagatcatcatactgaaccttcaatttgttatgattagtacatgacttgagaactgtacacctgaaccagcagcctacaatcccactgtcctgagacaagacctctattctgtcaccaacattgtaggttggcatacgctgattctggggccctatgaacttgactgagagatgttttctgggagattgcttactgcttggtttctgataagatgctatggagtcttcttgtgggcctcggcagattttagttcccaaacattttgagtaaagcctctcaaactgcttaggaaactttgtcttcccaggtgtccattgctcaaaagtttttatgatatcagaaccatcatccttttcttgctctgggggaagttttaaggacaaaacaacagcttgactaaaatatccacgcaatgatctcaggtcaaaacgtttaaacttatttttactgtattggcgaaagcagaaacggattcccaccatagaagaatttggcaatgtattgacgcatttttcatagtgctcaggagttaacacagttgcaatatcatcgacacactccacactgattacttgagaataaggagtgatgaaaacttcgcaaggatgaggagggggaggaggtatagcgcaagcaaattcctggttttgatgaaaccatcgcactttaaccttcttctgccccttcttatcttcgtacatatcttccaagtatgcaagatagcgactttcctcctcagacatgacaagcacaaaagagtgggtctgcaaagaagatggcacatgaagctcagaaaacaatatgggcaattgggtatacacacatgaccatgaccatgacaaaatacttacagatattgtggtaccattacgacaaaaagctttatagtggtaaagctgcttgccacaagtccaggacgaaccagaccacataatgtccgagctacaggctttcccctaacaatataaaaaagggtaccgagctcgaattcgccctatag

SEQ ID NO: 35317 - DNA, 719 bp, Oryza sativa
  unsure (1)..(719): unsure at all n locations
tcatctctgtactgtcctgtgatcttgagtggcatgttaatttccaacactcaacaacggatccttttatttgatgagatacagtaattgttgtggacttgaaagcaaaagttatgagttcatcacagtccaaagggccgatggttaatttttaagccaaaaattgtaaacatataattgttctgtagtggcatgtaaatgtgttagttattgcagtttaacacttcagcattttgtttcttatggcatgccagtacagcagtgtttgtttctatattcataattttcttatacctactatgtgtaaagatacactaataatttgtatttcgtgtattagtccaatagttgaggtttcttatctattatctgagatggttcagcacgggtttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggacaatattctgttccgtctcacctaatgtcttctttnnnnnnnnnnnnnnnnnnnnnnnnnnnnnnnnnnnnnnnnnnnnnnnnnnnnnnn

SEQ ID NO: 35318 - DNA, 692 bp, Oryza sativa
  unsure (1)..(692): unsure at all n locations
actactccgggcttaccaaatttcactgttaccagtattatatgtttagggttaattgaattcatgccatattataaatttgactgttttaaaaaataccattataattcgtctaattggaacgatgtcattaaaactcttctaaaatcagattcatgctatcctatacacttgataagctatttgaatccttttttaactaacatattttcgtatggaccaaattgcccatttcttcttccttcatctcttctcctctctctcctgttcatccttcccatctgttagatcctatcgatctcatcttaatttctttttccctaactttgggcctcatctctaactgaccaacaacacaaagaaacaagcccccngacccccccccccccctctcctctttcggtgagcaagtagcaacagcagcaagggagcaagcggcggcggtgacgtaagcagcagcaggggagcaagcggcggcgagcaaacacgacgggtctccggcgccggtttctggtactcacctcgctcggccgaagttcgccgctacattgagttgagctcggtgctgcagtgggagggcagctcgtgtggtggtcgtcgccggcgagctattgaccattccatgccgggtgggcagctcgtgtggtgggcatgtgtannnnnnnnnnnnnnnnnnnnnnnnnnnnnnnnnn

SEQ ID NO: 35319 - DNA, 506 bp, Oryza sativa
atgggtaccagaaagaagaatctcggccggggagcacaatgcgacgattgtgttccacttctactcgcatgcagggtgcaagtacatctctgtcttcctgctgctggatgagaatgagatcgaccccaaaatcagcattatctttgaggttttcttgatggacaaagacgggaaaccttcctcgcaccatgcaaagaggaccatggggccaaacatggagacagcatcgggtctccggttcactgggtggcgtcacttcgtcaagcagagtgatctacagccggatcatgtcagcgacaaaggcacggtcacattcgtgtgtgggttcatggttgtgcgcaacgacgtccacggcaatcctatccccgtgccgccccccaatctgggtgcccaactcggagctatggggggcagcgccgacggctcggacgcgtcgttcgccgttggcggcgagacgttccacgcgcaccgggccgtgctcgccgcgcgctcgccggtgttcaggg

SEQ ID NO: 35320 - DNA, 1556 bp, Oryza sativa
gaacctacatgtagcgtcataggagccctatgacatcaaccatctcctgcatctctatgcacagatggctgatttgatctcatcttttcacttatatttatacttatcaattaaaatttaaatttttagctttaaatttaaagttgattttgattttttttttatcaaaatttatttttcagtctttaaatcgttaaaaacacttatataaaaaagttttaggtataaattattttttatttacaaatatgttgtttgaggccgtttttcagtgcgaagtgaacaactgcatgccaaacgcatcgccggagaaggaaggggaaaccggtgacggtgagagtcatttaaggcgttctggtagcctacgctttttattttttttggcagttggcctgcatcggtgaccaacccccgaatgaaatcaaccgttgcaatctcgcaatttctttctgttggaacgccattgatttctttctcccccaagactaattaacatgtggatgtggtgtcatctttcttccagccaccaacccaccgcaggagaaactctccagtcaacttggttttgaaaaacgcgatgagtgttctgatgatgtgtacagtacgtgcttcgccccgcacgccgcggcgccaaggaacttcgaataatttaccgagttgtatacaggccgctgccgctgctgagactgagaccgtgcttgctaaattgatcgtcctcattgtgtcgcgctccttccacgtagggctgatgtttcttttcgtatggcctctgactatgacctcatttaccccgtgtttagatccaaagtttttcttcaaattttcaacttttttatcacatcaaaactttcttacacacataaacttcaaacttttccgtcacatcgttccaatttcaaccaaacttccaattttagcgtgaactaaacacacccttaaacgagttttacactatgagaagccggggaggagaatgtatgcaaacaaagaaaacaaacattgatcatcatatgataagaatccaaaatttctcaaattgatcatcatataactacatgaacacggatttcgtcggaatataattaatgcaatataagtgaatgtgtgcatgctagagtgtaattggcatggggttttaagagcatgtacaatagtgctattaagaaggctccaaaacttattaatcagcctaatacgagattagaaaaagaaaatcgctaggagagaaacaaatgggcgcttgttttagcgctagcgcttgcacagcaccccatgcagtatcggtcacgggagatgagaaaaaaaatgctaggtgggtcccacacgaaaaaaaaatgttatatttaatgtatgtatgctttaaccaaggcagcttatagctaacttgtagttaattagcatgttgtatgagttggctttgtaagttagctctaccttgacatgataaaattttggagcttgccgctagctgcactattgaccttgctctaatcaatgcatgtattgtgggagaatgtgtgcatggcgtcttcattgatggattagttttggggtat

SEQ ID NO: 35321 - DNA, 604 bp, Oryza sativa
cagtgcaaaaccatcggtgaacacggccttcctgaaattctcctcgacggcaaagaaatcgatgcacttgttcttcagctccgggcagttgtacatctcggcgcaaaccaagatcgcggcgaccgaatccggcgtcatgttgtccagcaacctctgtccgcacatgatctttagcctgtccagcgcgtacctgtcggccatggcgagcaggtgcttgaagaacacgttcgtcgacgaggagccctgatggagtttgccggcgtctgcaggcaactcgtccgtgtagatgaatcggagcagagctctgaatatcgccggctcgattccctgcagcgtaatgcacgacgacgacggcgaggtggattcggacttgcagccaaagagctccgtcctgaacaccggcgaccgggcggcgagcacggcacggtgagcggcgaacctctcgccgccgccgccgacgacgacgaaggtgacatccgcaccatcctcgctgtccagcaggccgccgagatggaccccgatgttcggcggcggcagcggcaataagccgccgtcgagatggccgccggtgacccccggcgacggcagcggcacacggttgccg

SEQ ID NO: 35322 - DNA, 461 bp, Oryza sativa
atgaataatggctaaacatttatatggtcttcaattctgaactcgtttttctttgtattgtttcaacctctatacatgtacagttcagtagcttaggaaatgaccattttaaataacctactcaatctgattttgatgttgtaatctatgggtatctcttcagcttaccttgcttcgacttaatatgctcctgtctgtattctttccatgatatattgaatcgcaacatcatacatcaccactgttcccttttcatgttaatttgagttgagtatcttttgtctctgtggtctgtgctaattctccctttctctagcttcgggatggatcaacacatcaaggaactgtgacttcaatggaacaaaacaacgatactttcgtgcttcattctgagctggagagggtaaggcaacttcttagagacaaatattttaaacatcttgatatgaaatgaaaggaag

SEQ ID NO: 35323 - DNA, 14842 bp, Oryza sativa
  unsure (1)..(14842): unsure at all n locations
ctatagggcgaattcgagctcggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtgaccacgatgtcgagctgcgcagcacgctcaacgatctccttgcgcttcttcgtagagacgttgtgggcaatctcggcacagtaggtcctgtttacaggagaattagctcattagcagaaagtttgtaactgcagctggtgctgacaacagaaaacagcaatgctgaacaccaccccgctgaaagtaagcttggtgaacaaagtgattacctgttgtgcatcatgagcaactccagctcagagacattgtgcaccacaaacttcttgaacttgttggggaggtagtgcctggtcttcttgtctgagccgtaaccaatgttgggcatcaaggtgcatcccttgaactttctcctgacacgggagtcaatacccttgggcctgcgccagcttggctggacaagtatgaacaagttgaagttagtctcagcaaatatgccaaatagccatagttacaaacgaggatgccatgcccactaatgaaagcaataacatgcaggaactcatatgaaggatgataacagtaaacctttaaacggtggcatcacattagcatccatgaaacaataacatagtttactattaccaggacaactggtgcaatagaagtgcatagaagtccataacagactttgcaaacaaacttcgatatacttaaacaaaaatatcacaatgaagtgttggtccaacaacaacattctcagctaagctgactagtagatagcaaaattgtcagtagtgctatacatagctcaatatctgcacacaggccttgcagttctgataatacgaatagaaggaggcagcactaggagcaatgttcacacttcacaacaaaacagtttcttgacgcaacaatcctaatttcaagtaatcacatgcaagaatgatgggagatatcttgcctttcattgcgtacaacatcatgcaaatgggtaaatttaggttaaccaaccacaattgaaagagcattcagctactgggaaaccaaccacatctagttactatacaagcgtctcttgttactggacactaaactacttcctcaatttcacaatgtaagtcattctagcattttccattttccacattcatattgatgttaatgaatctagatagatatatatgtctagattcacaaacatcaatatgaatgtgggaaatgctagaatgacttacattgtgaaacggagggagtagtagttagcaaaatagcacttgtgtgtatcaagactaagcaaatcaccacatacttcaagcaaatccaaaacacttccatagcctactaaaccaacccatgaatttgaaacaaactacacatatccacaaatcggtcaaacctgagcaacacgtatgacctaattcaaaatcaagcaggaaacccagctgatctcaccgcagctactactactaccactaatcgaaatggtccattccagaaagcacaaactcgtcatcaccttgaggcataggtagcggtcactatggggcctcttgaactgcttgaccctcttcttcacgatcttcttcgtcagcagcggcaccgccatctctgctccaccaaaaacaacaaaaacaaaaaaaacttaagagacgagatcgacgatgcagcaagcaacaaatccaaccagctgcgtgaagaaaaatcttgattcctgggcaagaactgacgctgtaccttcggatcggagagggaagcggagcgacgaatttgggggaagaagacgcggcggcggtggcggtggggaggatggcgaagggttcttatacggggggagaaaccctagcgggctcgtggccttggtcgaatcgacggctaggatctcgtgagatggaagcggacggccggatcaagttgtatgggtgggccgtcctggcattccaaactgggctggatttgctgggataaatgggccacgtgcgtggttaggcccatatgatctgaactgggctggttctgctcggataaagctgcttctgggctcgtttgatgggcctcatcccacccggccacttagatgggccaggaaattctggcccaaactatacggagattcgtgatgtccaagcagcttgtctgttcccgtttggatttttctgatttgcagaattcagtagaccgaggagaatttagtagggtgtggtccgtagatttggaaggattcttatcaaattttcggcaaaagcgtctggataagacaagccaaatgttaggtggaaaagtataattttgccattgttgtttcactttgaacaacatccattttaaacggcatgagtcaccaaactataaatcctaaatttggtttgtataattgaatcagactgtgccaatgttacagcccatgtgcagtgtgcacgctcctcacatcttggtaggagtagctaggagcgcactcagctgtcgatcgcccttttcctgcactccagtgaagggggtccaacacaactttagaagaagaaaacgaagaaggaattttcaccatctcggcacatgatagacggacgtgccgggcccgttcacttttgccgacccatcctcttatcacacaccctttttctctgatccattgagtgctcatcttgcttgtgttcatgcatctacaactcctcatcctatattcctatcttgatttctgctgcatcagtgcatacacgattcggtcatttcagactgcatgtgcactcattgtactctcgctgtatttggattgctaccattgcatttttttttgtcagtgctaaaacttagttaaattttgacactactaatttttttagggtaagattatatttggtttgctatcatataaagccaacttatgaattctagttaagattgttctagatattgatgtcaaatctagcatgggcattaccaataaattggttttagtccaaactaaacacatgtactatttaaactaacaaaatattggtagggctaagttttggtagcaacccaaaatggctcttagacttatcctaatgctacaaatctaaggtatatttagattcatagtagttttcatccctaattactactgtctttatcttaaattatgaaaacctaaatgaaatactagtattttctagtagtacaatctgaccatgaggtagtactgcatttccttttcgagtgcatgctgctgtactgcatcctcatcgattcagagacacagtacacatggtagtacgaaagagaaataaaatgtgcgtgacattatcgccgttttttactgcaaccatgtgtccatctgaacattcatgctcctgcaggtacacggtatatgtacacactagctgctactactagtacagtattagtaggttattttgtgaaggagacgagacgcaatctggaccgtccgatccatggcttcatacaaaccggtcaaccgtgtacgtttggcaccgtagcagttggatcgtcgctatcatcggtgttcgtttcggcaagctgacaattcctgctgctactggtgcgaatcatcctgctcgtagcgtccctgattctcagttacaccgaaaatccatactactttaacaagactctaataatgataacagtgaatctgtcactccaactgcttccatcgtaaattttacaaaccattcgatgaacttctttatgttaaaaaccaatcaatctaaatggatagcgacgtatagaatcaaattgagacaaatattttccatagcagaacgacgggtagaacatttcaccaaaaatgcattttatccgtagtaaaacacgggctttagctagtctaccaaaattctctactaaagcatgtacatgtgtgtgtggaaatatatttaccactgcctttatcttaaaatatgctccaataactttgtctcggttcatagttgctatattagctattaataatttggataagtcagtatctagattaataattaaaagttaatacttccttttggaaagaaagttgaattcttggctatgaacttagacatggcacatgtctatattcctagtcaagattcatttgttttggaattgagggcgtgtatatctaataggacatactctctccgatctttccgtttcaggttataaaacgctttgactttaatcaaagtcaaattactttaagtttgaaaaatataataacattttcaacccaaacaaaatttattataaaaatatattcaattattgatttattaaaactaatttggtattaaaaatattactatatttgtctataaatttagtcaaacttagtttgactttgaccaaagtcaaaacatggagtaaatctgaacatagctatatccatatttatagctgaaaagtgagtactattttgggaaaaaaatacatagtactacctccgtttcaggttataggactttctagcattgtccatatttatatagatgttaataaatcgagtcacatatatatgtttagatttatttatatatatatatatatatatatatatatatatatatatatgaatgtataaaatgctagaaagacttgtaatatgaaacggatgaagtattattagtatatcttgttaattgctattgcacggacgtattactgcaaaggattaatcctcagtaaaagctggcatttacactccctcccaacggtctccagctagctgggctggtgaatagcgtaaacaaatgcaagctcacatgcacactctgttcagacattcatagttgcacagtccttgtacctactgcagtcactgttgccaacctcactgacaagaaatacaagacaaattcatgggtaattaccccccggcaacacataattatatcgcaaatacataatcaaatccagataacgcaactgcacagtgcacactcttccctgccaacgcacaggatgttaaaacactgtaccacactgatccggagatccgaaattaaataaccccaaattaccaccagatcaatggcatgtacaacaatagtaaaatcactgtactaatctagtgccgaattaacaacaagtgctgtgcaccaaccatttttttattgcaaatggaaaaatcaaagaaaaactaattataacaaaaaaaaagcaagagaaaatgaaaaaaaaaagaggaaaggaaacaagaacagtagggaaataattgttcaagaaatgattcatcatgcaaacatcaatgaacaccactaatcatggtactaggacgtaggaacgtagctgtcaataatctttatcatacaatcgccaagaaacccaccaacgccgccacggcgagcgccggcgccgacacggcggcggcggtggtcgccgcgttcttgccggcggtcggcgcgacggaggacgacgcgccgctgtcgctgccggaagagggggcggggccaccggcgacgggcgcgggcgccggctcggacgccggggaggtcgccgtggcggccttgctgccggcgaggacgagcttggccttggaggcgaggttggccgggccgaacgcgtgcttgtcgggcgcgccgccggtgacggaggagccgacctgccacacctggttcacggacttcatccccttgtggagctgcagcttgccgtagaggcggatcttgccgccgctgccctcgtcggcggcgaggtcggtggccgggaacgcgatgggcgtcgaggcgccgccgagcgcgacgtagccggtgatgttgtatgtcttcacggcgggcgccgacgaggacgagccgcccttgagcgccacgagcgcctgcgtcccggccatcccctcgccggtggggttcagcccccacgccacccacccgccggcgcccgccggcgccgccacgaacgccaccgacagggacgacttggacgcgtcgtacgtgtagtgcagcgccgcgccgaggctcggcaggtcctcgcacgccgcgtacgccctccccgccgggaacttctcgccggcgcacgccgcctccgccgcgcgcattgccgccggcgaggcgaggaggatcagcgcgagcaccgcgacgagccgatgcggatgcgccattgccgagggcgagtggatctggagctcagtggagggagaagctcaagtggttggctgatttgctttgcttggcctcttcttctcctcctccttgaagtgtgggagtgtgagggtttataaggagtggaagtggggttatgtgtgattatgagggttatcagggggttatttgttaatgttttttgaattttttgaagatggaaagggcaaatttggtccgtatttagaggggtgtgatatcatttggttggtgacaaacatgcatgagacatgaatcctgactcccgtgagtttgttgcgtgtgttatagtagccacgaggttgtggggtttgtactttgtacctctgggttttattatatttgcaaggtgtcatttgtcgttagattcaattttgtttaaacactactcctagtactttagaagtacattctcacgctataaatattaatgactagggtaagattcggttaaactttcaaaattccgacgattggtaatttttagaatgtttaatttggaaatagaagaaatggtatacatatatttgtcttaaaagcactatcatattgttagtattctaaatatgagatatcatatacttctcgctccacatatgtactagtattagtggagcccactatataccaaatcatatacggaatcaatactgctatggcaagtgtaataagtagataaggaagtagtcatgtataagaaaaaggaaacagagtcctatttagatctaaccaagagtccaagactacccgaattgtatacataattgattttcctagttttacttgatcaagagggtatttataataacagtataaatacaaaacctcacagaaggagaggagacacgaatccaacaaggagggttctagagccacctctcaatcttgccaagtttgttctcaaggaagccgatatcaattagccatcaagcacatgcctgagcttcacactggtgtactagcaaactagattaggttctactccctattatatttatgagagatattgatatataatggtaacaccggtttcggtcagtaggaataggaatattacttgtcaataggaggttggaacccgtatacttttagagttttgtttgcattcccatatcagttggtccctacgttctcaaacatcctgtatatatatatgaataccgtgatcgtggtataactcgtcgacgaatactgtaataattttttactagattatataaggttgttttaaaatagatgatcggaattttaaaaggcaaaccaaatcaatttgtccaaattttcaaatatttgccaacaaagcactattttatcataaaggtgcggtattgataaataaatcaataacaccctctctgaaacagatgaattttacaagcactaccaactactactacacacgtccaaatatagcaacttcctggatataggatatagatctggaaaattacttatacttatccacattcatctcaatataaactaacttttacgcatgaatttggatataacgtatatttagattcatatataaaagttagtatattttgtgacggagggaacatattttaggacggatggagtattttccaaataaacagtaaatcttcgtaaattccaaacaggacatgaatatttgtcaaaagagctttgaatcccaactcacaagtcatctaacttcacaaagctagtccaatattgacttgcctaactccaaatccttcaaaaccgtgtgcagagagttgacggtgggttggctgaaaaatgtaaccacacacgtaaatgatccatgttaggagcaccgccactacagagtgtaatacacatgcgaatttttttattaccaaccaatcaatggtcaatgcatcttggttaatttgttactagctggccaattttttttttgtggagatccaacagaacagaacaccaagtctgaaacattcagaattcagacgagcagctctgaatctggccatgtgtgacccatgtgagaacttgacgcgtgctcccaacggccgggtgattagtagactgaatgatcagtaaaagacttgcaagcttgctaatcttaatcagtctaaattaaccctgaagctagtatatcattcttgactaagggcacatgaaccgatgcatgttcaactctgcacaggctatgacaggcttagggttaatttgattctgaaggttgacccgtgaattacgagattgcatgacgaatgggatgacaactaggtgatgtaattacaggatacacatggaagcattcaggatggagtgattggattaatcaactacgataacatgaaacagaatgtgatagcatgaagcgtacatgtgatcgattgattggagattatgttgtctgaaatgaacccggagatctcaatgaacctgtgttactgtgtacctatagatttggcagatccagaaatcaatacataaacacatcccttcgccatctcacatgatacgaagtatgaaacgtatccaaccattttggattcatctcaacaagctgctcaaaaaaaccctgtaaaattcacactcaaaacaaatccttttgcctctttcacctctgaactctgaacatgtctgttgctaactacaatactgtgtatcatgccatcatgcaaatcaaatcatcgtactctgcgcaaattgccaagtttgcaacggcaggggtcagcaataataggcaagaaaacaaacacatcttccattttagtattaccaaatactacattggagtacttaaattaatctgaaactataaaccccgtgatcattgataaccctatctgcagtactcgccaaacggccagctaggccatcagatactaaagcttcacgcaacgccatccagaagctgcaaaaaggtgacaggctacacacttgattattgcaaggcgggttatgaacttaatcagcatgaaatggaaggagataaaaatatgatatactcgattagatgagctattatacgggaagaaaaagttcggaggtcactgtcaattcagtataagtaaagcactagtatcctaaacacatcttgtagaagcaactcaatgatcttgtagaagcattgcatgtgattgtatgaaaaatgatcaacttttggtcatcagagtggctagtgttttacagggtgtaagtgaccccatctcgcaattggagatagcttcaaagggaaaactgaacaggatatgtgccaattaagtgattaggtgcctgcatatatacgaatgaatcatttcttcaatgatttgtgtctggtatacatgccagtattgaaatgattttggattcatggacttttcagtaactatcttttcatgatactgtatctgccagggtctgttttggattgcttagcttatctgaataaattcatttcagttttcaagatggcatatattcatttgaggttaggaatgaaagaatggacgcacttctcgagtaccatgtgattttcgtagaaacttttgatatatgatttttaaaaaagaataatcagttttaaattttataatagttaattcattcgtttgtactctcgaatagtgatcacaaaatcattcagccgttcagctctttagggggggggggggggtcactcttagctactactacttgcataggagagattaggattggaaatttgagcttttcaacttagctgaatctgagtctacttctgcaaaacagtcggtaaaacctaataaaaagagatgggccagagtgtcctatgtaagttctgattctttctaaacctgaagaaagctgttgaaaagctcctcgatggacgatgccttttggtacaaattaatctcttttcagatccaagcgttcccatcctgttgggtggttaggtttcacattagtagcaagctctgcacgttcacaactcttttgtgctggtcacagcgtttctttagcatcctatctcctgtgttttcggcgtgattttcaggtttcaggttcgaacaattagctttttgataggaccactctgagactatctaagtgggcattagccgttgggaattttggtaatgacaggttacaagcatcagaattaagacatactccttccgtcccgttccatactataagttattttagttttatcctaaatcaaacttcactaagaactttaattgagtttataaaaaaacactaacaattacactaacaaataaatgcgctgttaggacacattttctagtgaatttaatgaaaccaattcgatgttatagccgatcaaaggtaaagaagtttgacttatgacaaaatcgaaaatgacttatataatatatatggaacagagggagtattagcttatcttaacttttttttatatatgctagcttatcttaagtttggtttagatagtgagggagaagaagaggaaaaagaaaatgaactgatgacatgcatagtaatggtaatgggccaacttccataaacgttggatttgggccaaatactttaggtcaactgaacgtggttgaccattgatgggatgatgaaagcttcaaagccaccaactttttttctcctcctaacatatgggtgtgtttagttcacaccaaaattggaaatttggttaaaattgaaacgatgtgacggaaaagttgaaagtttgtgtgtgtaggaaagttttaatgtgatggaaaagttggaagtttaaagaaatagtttggaactaaactcggccatattttattccaacttccatgtggatgagagaaaaactggaaggactttttattcggctgtagtaattctgaagtgaaccacacttcaattttcttcaggtaataatgcccaagtccacaaaattgtgctgaaacaagtaataaaagttcacacgcttgactttgataaatcacagctgcggtagactgtatgaatcttttttagataatgaaaatggtttgtgctagtatagaaacaaattattcactgggttattcctacggattatctactttattgtagagatgagttaattattttggaattaagcttaataaatagcttcgaaccagtggtctaaacaatacaatagaagaaagttctttttttctttaaaaaaagttatgtaataaataaatctgtgacaataatccagtagaacagctaaaaagaactggacctaaggatggattggttactgaacaatactacatttttcttccatgctaacttgcccacgggggatttgcaattatgacactgcaaacattaacctttgctataatgacactggacccacatttcataaatacagatgggcccatttgtcatccactcggagtgtcaaaacagcgaaacccctatgtttgcagtcccaatattgcaattttctccttgcgcaccggtatgaagtccaaaagagacaattcaatcgtcacattaataagagaataaattcatgattgtagaacgagtttcaactttcaaccagcagtagaactcttcttctttgtgcgtttgtcgtacctctacagtgtaagtgcttacaaattttgtggacaagattttcagtggtcagcgagtacaaattcagcagggaaattcaatgccgaggattttcgtggcatttgtaggtccaaattgagcacatcacggttgaaaccatgcaagtatgcaacatgatagctgccattttcgtcgagtttcagatcgagaagcacggcagtttgactgacgaactcaaaaacatggcgtctttttttttaaaaaaaattgtttcaggaaatttgttcatgggacatgggggaaaggcgtgtggctagcgcacgtacggctgttgctgtcaacggacgagtgattcgtgatgcatattggaattggattcgtgattttaatttgctgtgtgctttgtactacagggtttagcagaagttgttctgaactttttgattctggttgcgttgagaatgagaactcttttcggggatatatatagagacagcgactacacgaaggtgataattaaatggagatatcaaatgtttgatcgagcaggagtcgctgatttgatttgatttcagttttgatgacctttgtgaataatcaatgtcatgcaataaaagctttttgtgcagaaagcgaccggtcagcagattgtaaggagtagtaataaacttttctaatttgtttggcttggggcatggcaaagagcgtgacgtcaggcgggcgtcaccgtggcgtcaccggggccgcgtccctctcaaccgcggcgcgtccttttccggctttgggcgacgggacgagacgacgacgagaggggagagaatcgcatcgcgaagcagcgggggctgcacgattcgtcgtcgtcgctttcctcttcatcctctcctcgccgtgtgcgcggtgcggcctcgttcgcgtcggcgtcggcgtcggaggcggagacggaggcgaaattgcaaggaaaacgacgacgggcgtcggggacgggaaggagcggagggaggcgtacgtggatgtgaactgattggtgcgtaggcgagccgcgagcggcggagctagcgatgctctactttcgaagtcacgttactttgtcaccgatacatggtgcgacactctgccccctcctgttggttggagttacgtttttaatcgtcgtaatagttgctagctcgggttttttatttttctttttctccccctctcccggcataagccagtctgactgtttgttttgtgtaacaaaaactcttttcctgttaatatattgatgtgcaatctttttgcgcgttcacgaaaaaaatatgggtgcgacagatattattcccttgatctcaaaaagtcaaaataactgtatttttacactgttcatctccaatgtttcaccgtttgttttatttagattttttttgttagtatttttattgttattagatgataaaacatgaataatagtttatgtgtgactaattttttatatttttttcataaaatttttaaataagatggatggtcaaacattgaacacggatatactttgatcattgactgaatccgatagactttgaacctatatgtcagcaactaagacacggtgatttcgaagatagaaattcttgatccgtgaagtgaacggcatggagcgtgaataatatgggccaagtgtgaacctatcttatgtgggagtgggacgacgtgctgcacggttcgtccctacatatgatgcaagcaacagcaaacccgacgctggaggatggatggatggctggctggatgctcattctcattctcattctgtttctcctttcacggctggtgtttcttttcccacggcctcaggctggctatgacctcgtttaaacgagtttttttttttacgaatcgacgaggctgttaattttattgaataaaggagacgaaaaatgtaaaaaaaaagaggtaaagtatagaaaataaaaaacccagggccgtggccctaactataggcagttacattgtcaaccagacggcaagattttttgcgcccgccaacccccatgtttttgcttcctcctttgtcttggctagcagagttagcgacgacagctccttgtgctggaaagtcctccggttcctttcgttccgtttaaacgagttttacactataagaagcagcggatgagaatacatagaaaagaagaaaacaaacatttaacttctaatttatcttatatattttaccattatagattcttataatatagacaaatagctaaactatttgtgaagaaaaaaattaaaaaaaaactgagctaccaggatatctctaaaggtgtgtttagttcacgctaaagttgaaagtttggttaaaattagaacgatataacggaaaaattggaagtttgtgtgtgtaggaaagttttgatgtgatggaaaagttagaagtttaaagaaaaagtttagaactaaactcggcctaaacaacggaacctacatgtcgtgtcataggagccctatgacatcaaccatctcctgcatctctatgcacagatggctgatttgatctcatcttttcacttatatttatacttatcaattaaaatttaaatttttagctttaaatttaaagttgattttgattttttttttatcaaaatttatttttcagtctttaaatcgttaaaaacacttatataaaaaagttttaggtataaattattttttatttacaaatatgttgtttgaggccgtttttcagtgcgaagtgaacaactgcatgccaaacgcatcgccggagaaggaaggggaaaccggtgacggtgagagtcatttaaggcgttctggtagcctacgctttttattttttttggcagttggcctgcatcggtgaccaacccccgaatgaaatcaaccgttgcaatctcgcaatttctttctgttggaacgccattgatttctttctcccccaagactaattaacatgtggatgtggtgtcatctttcttccannnnnnnnnnnnnnnnnnnnnnnnnnnnnnnnnnnnnnnnnnnnnnnnnnnnnnnnnnnnnn

SEQ ID NO: 35324 - DNA, 16651 bp, Oryza sativa
  unsure (1)..(16651): unsure at all n locations
tcggtcacatcgttccaattccaccaaacttccaattttaagcgtgacttaaacacaaccttaaacgagttttacactatgagaagccgggnaggagaatgtatgcaaacaaagaaaacaaacattgatcatcatatgataagaatccaaaatttctcaaattgatcatcatataactacatgaacacggatttcgtcggaatataattaatgcaatataagtgaatgtgtgcatgctagagtgtaattggcatggggttttaagagcatgtacaatagtgctattaagaaggctccaaaacttattaatcagcctaatacgagattagaaaaagaaaatcgctaggagagaaacaaatgggcgcttgttttagcgctagcgcttgcacagcaccccatgcagtatcggtcacgggagatgagaaaaaaaatgctaggtgggtcccacacgaaaaaaaaatgttatatttaatgtatgtatgctttaaccaaggcagcttatagctaacttgtagttaattagcatgttgtatgagttggctttgtaagttagctctaccttgacatgataaaattttggagcttgccgctagctgcactattgaccttgctctaatcaatgcatgtattgtgggagaatgtgtgcatggtgtcttcattgatgtgattagttttggtgtataaacttatatgatgatcaatttgggaaggagggagtgctattcacaaggtttttcttaggccctgtttagttcccagaacaaaaattttcaccctgttacatcgaatgtttggacacatgcatggagtattaaatgtagacaaaaaaaattacacaaattgggtgtaaattactagacgaatcttttaagcctaattgtgccatgatttgataatgtggtgctatagtaaatatttgctaatgatggattaattaggcttgataaattcgtatcgcggtttctaggcagaatttgtaatttgttttgttattagacaaagtttaatacttcaaatgtatatccgtatatccgatgtgacaccccaaaacaaaaatttttgtcatctaaataagcccttacttcctccatcccagataaacaaattcatagtgtatcatatttgtttattttaagatggatatagtcttgttttaagatgggtttaggaaagaaggttagaaacttctcctatgcacctaaaacagggtaactcattaccacatgattaatacttactaggtaaaacaataccgaaaaatagattaatatgattaaaaaaaagtcttccctatcaacttttttactttttattaaaaacatacctcatccgtcttaaaatataagaacttttagttggatggacacagattcaacgtactaggatcttatattttgggacacagaaagttattatattttgggacgtagggattatcttctaaccgttcatagaacgtttgcgtgaaaaacgagaaaatagaagttgagacatgtactttcaaacatatctttattctccttttgaataataggttcccaactttaattagtcatgacttaatgagttactcgttccatctacttttgatagtcatatttctaaatctgaaaaatttatttttgataggcatatttcaatccaacaacctatcatcttaatgactttctcggatttaatacatgactctctattatttcacacatgattggctacaagagcattgagaaatgtaaatattaatgaattgcttgtttacgtgattataaaagtagatagagggagtatttcgttttctatacggagaaatgatttacgaacacatccaattgtattacggttaccgcggcgtgctgactgaccgcttaccaaccacggttcacacccatcttcctggatcaaaccggctagtaagctagttctgtgatttatgagtaattaattaagaagcatgcgattatctttctcatcatgtgccaaagattcagggcggcgaggcaatctcatatattctcaacggacaaataataacaacgctttatctgcagcagccatccgaatccatcggcgatgcacagcgaatgcattgactccgatgagtactactgtacttgatggtgttctagaactgaaggaaggaatgaattcggtttgagtccgtgagtggttgattgatacaggtagtaccactgtaccaccatttgtggggttcagtttggcatccaagtgattgtgctgattaattgtctcattgttcagccaatcaacggtacaagatgagatgagatgagaggatgggctgttatctctgatgtgttttctgcctctcatgtcatcatcaactcgcccataacttaaaccatattatttttagggatttagggatattcagtttatttaccattttcaagcctaactaattttagtaatattaaaattttgtaaagtttgataatgccacaagatttggtaataaggtaaaattatgtatgcagtattgtttagtttgttaccttgtaaagaataatttggatgattaccaaattaattttggtatggtaggatgtgataggttattcgagacatgtttggattgttgtcattttaaattttggcaataccaaaatttaatatgtttgaaaatagtaaaaaaaaagtgaacacgcccttagtttatttatccgattattgaaatggcttatttattttatgctttgaaaaccaatttccttttagaaaaatagtactgtaattgatcaggctatttattttaacttatttataaagttcatcttttaaaatacttaatctattttaaaattgagtagataacttacgacgataatccaaatcaaacaaacctaactttaacactgcaagagaaaccgacaattatagcgagtaaaggaatcaagagatacgttatcatggaaacggtaagtactgaaagattagcgagcatacattaaaacggcaggtaaaaaacccaaaaaccgaaccggtgaacgtggacgcgaaaaagggcaacgtgcaaaaaaccttcctcaaatccaacctccgaccgcgtcaatggccgcccaatcacacgtccccacgtgtcccccctcacctccgccttcttaacctcgccacctcctcctctcctcccacctcgcctctctctcctctctctctctctagtttacttttcttggagccaccaagaaaccagccatgtccgtgctcggtgtcttcttggcgtcgctgcttctggcggcggtggcgccggcgagggcggcaggaggggggtgcgcggcggaaaggttcaacagcaaccgcgtgtacgcggcgtgcagcgacctgccccacctgggcgcgtccgtgcactggacctacgacgccgcggcgtcggcgtcgctgtccgtggcgttcgtcgccgcgccgccgtcgcccggcgggtgggtggcgtgggggctcaacccgaccggcggcgggatggccggcacgcaggcgctcgtcgcgctgcccaaggggggaggaggcgggtacgaggtccagacgttcgacatcgaggggtactcgctctccgcgccggggaagctcaagtacccggcgaccgacctcgccgcggaggtcgccgccgacggccgcgtcagcgtcttcgggaagctggcgctgcagaacggcaccgccgaggtgaaccaggtctggcaggtcgggccggtctccagcgggtccatggtgccgcacgccatgagcagcgacaacaaggccgccatggggaagctcaacctcctcaccggggcagccacctcttccggcggcggcggcagcaacctcaggaagaagaatgtgagcactcttcaatcttgatttctagtatcattttgtttgcctttcttgaattcctaatcaaatttgagtgcacaaatcaaattgtagttagaaaaggggggcgatttcagctcgaattccaccagggaacttaactccaaaagctaaaatcctggggatttttttttttagcaaaagctctcatattgttgttttcttttattgctttatgaattagcaacagtagtggttactgaagtctgaagcggtactggtatgagtcaatttaatttgaagtatatgcttatgaggtggtagagcgttgaaaagaaagaaaaaaacaacacattttttaatgcttaagagtcaatctttggttaaaataatctttcctgcttctgttgccatgtgaaatgctcaaatgtttatacatatgttcgactgttatatcctggttggtttgagatgatttcaactgtgttaaaatctgtaggaataagatgacgtttgctgactgattatgtgtgacaaaatgccttctttgcttccgtactacacactcaaatttctatgctttcagattgcaattttcttgcctgtattggtttcttcctgctttggtggacttcagcacgatttgtctttcctgttgatggctacatcgaaatgctcatttcacacaatgcaaattcagtagagagtagggagccgtggtgttattgatgttctagtgaagggatcgatctttggttgcaaaccaaacaagctttttcttcttctgttgattcacattcacaaattgcttgaccatattgataatgatattatgatgtattactaattggttcaaacttttttctaattttatatgtgcagacccatggaatcctgaatgctgttagctggggtcttctacttcccatgggagccatatttgctagatatctcaagacattcaaatccgccgatcccgcgtggttctaccttcatgtagcttgccagctgattggttatggtgtgggagtttctggctgggccactggcattcatctaggtaacctgtctaagggaatcacctattcgcttcacagaaacatcgggatcacagtatttgcgcttggtaccctacaggtatgttctattgcacacattgttatgacctctttatctgccaatatttcaagcccattttgtgcaattgtacgatcatactgattgttctatgtgcactctttcttgaagatctttgcgcttttcctgaggcccaagaaggatcacaaataccgtatctactggaacgcctaccaccactcggtcggttacaccatcatcatactcggcatcgtcaacatcttcaaagggatgtccatcttgaacgtggagcagaagtggaagacgggctacatcatcacgatcagcatcctgggtggcattgccgtgatcctggaagctgttacatggagcatcgtcttgaagaggaggaaggaggagaacaagtcctataacggcgcttcaaacggtcacttgccactctctatgtaattcttgtagaggcaggagggacttgtgatccctacttatatattcaggaggctatattcagttatgtttatgcttataggattaggccttgtgatcttggtatctcttcttttgtatgatatttgtatactgcacactatactggagatgagagatgccagtacagcttgtttgattttttgttctgtttgtgaattgctgagttgaacatccactttgtatgattttggtgccattacaaatgttccttttggaaaagttgggcaaaggtgtcccaagtggttggtgaattggagaagaaagatgcaagaaaatgcttgctagtggaagcatgatctctctagaaagtttgatgctcgtagcagcctagcagaaaggaaagggtactgaatactccatttgctgctatgtttttgtgttgttcaagaaactgaagggagtgtggtgatgtcagatttcactttgtttcagtagcaaggaaacaaaatgtttggctattgtttcttcaattattagcttcattcagaagagtggcatgtgtccaaaacatgcaaatagaatccatctaaaataactgtgaacatgcaaacaactgaataattgacatatcatggcagttttaagtttgatgtaatagcaatttgtctgctttccatgcagacaactttattcaagattttgtgccaactggtccatgcattagagtgactccattgaaagaatagtacaccctccgttttttttatatagacggcgcgttcacttttaaacatatgtttcactaatcattttattcaaattttagtttacaaaatgtaaaaaattaagtaatgcttaaagtaccttttatgataaaccaaatcacaacaaaacaaatgataattacttttttttataagacggatgatcaaacgccaaaagtctacaacgttatctattaaaaccagaggaagggagtagtagttagagtggagtgtgtggttcaatcagactcagctaggagtcctgagcagaaaaagggtttgtggcgcgtgatttagtgcaggtcagttcacaactttcttgcttgcaaataggagaaaaaagatgctagatgttgtggcaaaccagggaaaaagttcagaaagcaacgaccttggcgagatctgtgacatcagagatgcccctagctagctgattgcacagatcgccagcaaacaacctcatgtcatgtgaatcccctgcgagtgttcgagtgatcatgctatctggcactaatcaactaaaccaaacgttaaacccttgttgcaatgatgctaatctgctattatcaggtgttaaaaaaaatgcatttttgactgcaacatttggcgaactctgatgcacctcgtttatttaagtgtaaagatgttgaatcattgactccacaactactacaagttagatataaagatgatgaatcattgactctctacaagtaagagataagtagattattagtagtgctcaagacgtgcagacattgttccagaatcctcactttccagatggtctctgaactcactggtaaacacctaccaactcaaaaaattaattatagtagacgacttcaccaaaactgtccaaaagggtttccagcagtagtggatccacaacataaatgcctgatcatttgtgagtgacacaccttctaagtgaacttggccaaactcaactactcctgcattttctgaactattagtattaagctgcagcaaaatcaggtagaaaaccaaattatgaccaaatctctgcatcactgaacttagatgacgaattgacaatgcagtccatatgatttgacctagcctaactcattgatttttgtcatctctgaatctaaacgtcatgtagctctcaactcaaacccttttcaattttctaatcgttagtcatgttcaaaccagaattccatcagattgtcaaagctaccaaacagtttggttgtgttgagtatgacccatcatcactcagtagggttcatgcaaagtcagttttgcttgagcttggctcaaacttccatcttagctcaaccagaactttttgggtggtctccttcagttgagtaggtagaactgcatccatctctggaacaagttgcaggtcagaaggagagttgagctgtattaggcctgaaaaaatgttcagaagtgactagcaagcatcaaaagcgactcatggattagaaaagcttttgctgctttatggaaggaagcaattcttgttgagctatagtagaacagtgcaatgtgtgcagtaggagcaaagcatcaactaactccaaacatcttattctcaacagcagacagcttggatggtgctatcaagttcccagcaatcctgcaaagctggtatttgttgaactgcctgaatattagtttctggaagaaaaaaaaaaggggaagatatgtgcctgtttggatgctttcagacagattggaatcttgttaacaaaggacatagcccacacaaattgcatgtaccatttgctgtaaaacaaagtaaaagaagattcgcaataattcattgaagtaaaattatagtgttgatcggtcacaactcacaacaacttctgaaaggaaaagactcgaagtaactttctttgtattcaacctgtaaagaatattttgtatcaccatgtgtcctctataaaaagaagaggaaaaaaaaaaactacatgagatatcttgtaactatgcacacatttcctttctgatgttactcaacgaatggtgagaagtcagtggtgaatatctacagaattaacagtgggacaccttaattctccctttggtaagtaacgtaagactcaactcctatacagaactgctacaccaaacagacaaaaacacacagacacactcatttttacatgtttcacaaggggcacaaatcatgcacctctgagctgccgaatggcttaaagtcagaacgttgcaaataattcaacggattcttctttgaacttcttgtagatgcttcacccgatagaacatcaacggatggggttgtgatagacggtggattgatgggcggggatgcagaaatcgttgagcagcaatgcctgacattgatcctgtgtgtaatggtttcagttgaggtgctacctgttacattgaccaaaagaacggcctccttatctctggtgacttcgcaccaacagttctgcagtactccattgacaaatacttcttgggtgtaatagtcttcatggtgcacggtaacttccattgtttgcccaggttcaatgagaccaactgatggttcaacctgtaaaacatagcacgatgaatgattaaattaccaaatattggtactgtgaaaagcaaaatggaacatgcaaagcactgaaaaatataataaactagtataacactcaagtcaaaaggcttgttatgaatggttagtggtagcagctgttcttgtctgttgactgtcatgacaaactggtcagtcagcaactccactgagatccatatccagtttaggcttatatggatgggttaaatggcagcccatccacgtgtatgggatgggttgggaatttgagctaaaatcctagcccatagatgtggataggccaggatttgggttcatgcaaatgaggcattaggatttttggctgaaacacatttatgaactgagcactgacagatatgatcatatgatgttgtctatcaactcatgcaaagtttggtatgattttgaccaaatatatgtccacaaagagtatcctaaatgaccactagaagacaatacatgcaaccaaacctgagcccacctccatgactgtctaggtacaaggtgatcgaaattgtgtttcatctcatttgcttttgcaatttttttccttcagtttgctttctcataattaaaagaaagtctgatatagttctcacaaagaggttggagtgcagctgatacagaaagtgcatgtcatagaagtaaaatactccatcccttctcttttacattatgtgaggggagtatataggttccatggttgtccaaaattcatattctagaatgacaagatatcttctatatttatgagctaaattttattttaggtcttgcaaactgaatacataatggacagactttctatggttttgaacttaacaggctttctatatacaagcaaaagaatggtcaacactacagatagaaatagaacactcaactgagagtgtaacactatgggttttcttttttcttaataagggaaaaacacaatgggttttaagactaaacaaaagaaaaaaatgaatgcaggaataaacaaataaacatattaatgcatacctcaagccaaagcggcaacccaaaggatgcccttggaggaaactcggatttagttccatcctgcttgctgattgactggctttcacacaggatttcaaaagcagccttgtttctttgacaatcatttgttatccggaggacaacatgttcttggttttccaaaattatattgtttgtgctgattatagtgtctggaacaaaatgggactctcgaagcaaactgtgtaatcttttgtcagattggagtatttttccatattcctgtcttcttgtaaactcatccactcttgcaatatcaacactaaatgcacacctcactggtttatgatcactatctgtgacacccatgcaagcttcatacctaccagaagagcaataaaacatcaaattatgtatgagggagtgattatgatcaagacaaaacaacatgtgtgtcttagattctccttctcaaaacgagtggtaactggtaagttgtagaatcttacgatgtaattttagcaacaacagggcattctaatgagcactctgctgttaatacatcacggctatctcgatacagtattctgtcgcaccaagcaggtattctcttcttctcacccgagtcatatcctaattatttttggtgtggaaaaattagctccaaagcagttgcgtcaatttaatcagcacataaaagaacatttgaatcttgtgacagaactggaactatttaattaaggaggtgccgctagcatcaaaagtaaaaacaggccatacctgcaagacctggtaggtgtctttggaatttgtaagtcggaggaaatctgatcaaaccttcacgcattccttggaaaacctttcctgccctcatttctgcttgaagttgatccctttctttaagccagtcaaagctcctttgagagaccatgtcccttgcttcatcataggtgataccgtaaagtcggtagttgaaatcaccaagaaagacaaccatatcagcttctgccatctcaggtatatcttcatcgacctgatttccattggcctgccattatgacaatagctataaataagtattctttatttccacggaaaaatctgcaatgcagttcagcgattacatacattcacggttttatgcaattgaacagatgtagcagaagctgtagaggaaaccaaaaaaaaaagatgttatagaattcatttacaacaaactagtatttaaatatacttataagatgaaagttgagaatgaagtacctgcagatccatgaggtttgttaaaagtcatcgttcgatagatatgatcaaaatcagcattacgacggctaacattttctagatgtgcagcaaaatgattgttcacaaaacatatcctgcgatcatagactctaattcttaaccctacaccaccctgcaagaagaatgagatatcattattcaatgcaaaataggaaaaagaatagagcaatatattgctaactattaaaataattttcctctgaaaactgcagctgcacactttcacctctaaccattgcacgctcacaaattgtttctagttggatgaagtatgtgaagaaaaacatattttgagtatcccatgattatttatcacagcagtataatgttctttgcgtgaacgaaattcccagttggtatagtgcacatatgatacgctcaagaacaaacagttaataaacattttgacaatcatgtaccttgttgccaatagcacgcccaaagccacatggtactgcagcagcatcaacatcaccaacatgtggcttaaggtccttccttgcccttgaaattatcatgatgtacatgccatacatatcgtatgagaaaagtacaaaagtgcaaaaaaaatgataattatataataacagaaaaatgtttcactaagaaatggttttaagataaaccagtaccatgcagcaataagtaatccagccagctgccttgaaccaactcggtggaaggatatcccctcatcaagggtcctgccaatattgtctatccaccactgaccattggcactaccctcaagccctacctaaggccataaagcaagaaatgttgaataaaatgctcaaaactcacatagcaggcatgataccagtacaggaaatagcccagtgcagtctagatatgaaaatcagacagaaacaggaagaagggggagatgatgaccagataggaaattaaattaaattttccttccagttctcagtggtagctttattataccaataaaacaccacagcaaacaaactagcatgaaagcaaatgcattgacttcccaaacatacagctgcaataactgtaaaagacaactcttaacttcagtttcagtgttcatcatttttatactaacagaaatatacacagttctcctgtgccttctcacaaaaaaaaaactgtaaaaaggtaatctgcacctagagctctagaatgaacccttatgcttaggtatatgcagtatttgtttcaagcagctaaattagaatcatatgagctccagatagagataagaaggataaaaattaaaatgtaacatagtacaaccattttatcagaaagacaagcacaccacttgtgtttttcaaaagacagtagcgcagatacagtcatattatcagaaataatacaaattaagctgtaatgcagaaataatcttattgtgctcactagtaacctattttcctatctcaataatagtttctttttccttgattgaaccgagcaagaaaacaatgaaacaacgaaatcaaaggtagggttgagtatttcatatcttacactttctttggctgcagccatggcaagaacaccagcacccatctcgacctcttgtagaccaaccaccaccaagtcaacatcaaaaaatgcacgacccaaccatgacatgagtgattcataagatgctttctcctggccaacattccaagtcccaacaagcattttaatgttcactagccttctatacgacaactccctgtttgacaattcagttcgcagaatatcatccagagggccaggggaagctagaggccatcctctaattccaccatgatgagcaagagtaaagacataagaaccaccaatcgccatctgtatgaccggacagctatgcccagtccattctgccagaaggttaccttccacatccatgacttgaataatgccactggcatagcccacccacaccctttctccaagtgccttcatgcactgaacagaagaacaatgatgctggaattcttgcagtcggttcccatttccatcccacataatgatcaaaccatctgtgcaacctgaccaaaccgttccattcattgcctgaaccactgcttctgttcggcgattatcttcaacaaatgtcccttttgtagcaactctgcgtactgcaccagctgctcccatcagggcattccttgatttctggaaaaaattgaaagagctttgtggtttatccttcttcacgggttttgctttgatttcttcctctataaattgctctggcatcacaggtgcctctaaccgagctgactcaatttggccgtccatgccaaacacttttagcagttccctggtccgagcatccctacaggaaaaatatcagaaaaaatagttcctaacttttcaatgggccgatgaactcaaggataatgcaatttatttatgaaagcataccaaacagcaaatgccatgctagttaaacaccaaacttttgcccgggaatggtcagcaagcatgtgtttcacatcagcagcggggaacgaagatatgttgccagctgctgcattgttcctaaggtcaatatatgacctttcaatccgtaaagcagccacatgtttttcttctggcattagtgagagggacttagcaatgacgtcccagggccatgcctttataacacccccttcggatcctgaccatatttcacctgtttccaagatattgaaatgaaataaatcatttttgcaaaacgttctacctcttttagtggacattgtgaagtttaaatcttgtatggagcagaagagatgccttaatgtcatataactacgaatgaatgattcagccattgacagcgatccaatgcaacaaataaagctgaaaattaagtttcaaaaggaacaacaataaagcatcttccaagtaggcttttcacatagtagacaactaaaacacaagtgaactttaagacttcaattattaacagacagtttcttaatatttcaagaataacaaggatttatttgtattattcgataaagttctctatggtatgagtgttcatttcgtaggctaatcctattgtttgtggatgttttttaggttacttttaccttcccaaacttctccacatttatgcaaagagaaaaacgcgcccaagtgattacatccatgcaaacgcatctaaaaaagataacggaagcctaccatttgagaaaacttctaacactaatactcccatatatggatgtcatgtcatacagaacagaaaaaaaaaaactagttcaactttcagattttccatttgcaagatgtcaatattactggaccccaccccccaaaagtgtttttcctaatttatttgtaatagactaaagttgttgctaaagccctgttattttcagacgcttaaaatcagctaaaatgaaacatttcatcagctaaaatcattcttcgtgctcttttacccaataatgctattgcctcactatgcacggagccaatttttatccatcccttgcgtaatttgctcaatgaaaaatagaattgattgagatgatcaaagtaagtaatcaagcttctcaccataagacgtgatgaccatggagagcactggcgtgcggctgtgtgcctgccacgtcagggccttcctgaacaacggcgcgtcatcgtcgtcgctgccggcggcgaggtccattcgccacgacatgatcctcccatccttgtggcccgtccacaccagcgcgttcgaggcgtccgcctcgacgcagagcacgggcggcacgggcacggactccctgaagggcgcgctctcctcgtcgccgcggcgcgccccgcacccggcggcggcgaacacgtcgtcgagcccccacacgcggaccccggactcggagcccgcccagagctgccggcgccgcggctcgcacgccagcgcccgcaggaaggaccccacctgcgtctcccgcagcgggtggggccgcacctcgagcggcggcgggcggcccgggtgcatcgcggcgcgcagcggcacccggtagatcccctcgccccctccctcaccaacaaactccggcaacgccccgccccccgaaacaacccgctccggctcctccaccaccgccaccggggcgccaacctcgcggcagcagcgctcgaggcgcgcgtcgcacgaggcggaggcgacggggccgtcgtcggtgctacgcgcgtacggcgacgacgacgacgacgacgcgctcttcctcagcgtctcccgcgcccgcgccgccatggccgcagccgccgcctcgtcgtccgagtccatcctaaatccgagctcgtttggatggaagggaagagggtgacctgtcgcggaggcggcgcgccgtggagggaagggaaggggaggcgagctcgtcgtcgtcgtcgtcgatggcgatggcgaaaggcggaggagaggggaggtggggtttaaatgggtggatgcgtcgtggaccgggaccacggaggcagtgtgaaccgcacagctgctgctcctcgcccgccgcgatgtcggaaatggcagctgagctcaggccggctggttttttggttgctgctctgaaagcaacggggtttccctttccaaatggaggccgattttgctgcgatttttgtttttccttctctgaagattctgtgacaggtcaatgtaggccttgtttagttgatgaaaaattttggatttatttatcacataaacacatagtctaataacaaaacaaattacagatttcgccagaaaactgtaaatttattaagcctaattaaactataattagcatatatttactgtagcaccatattgtcaaatcatggcgcaattaggcttaaaagattcgtctcgcaatttacacgtaaaccgtataattgattttttattttgtccacatttaatactccatgcatgtgttcaaacatttgatgtgatgggtgaaaggtttttattttgggaactaaacaagaccgtattttggaaccgagttagtgacaaatggtattatactacatctgcctcattttaggtgtaaccatgggtttccacgctcaactttgatcttagtatttttgttgctatgagttgatacaatatgaatagtactttactcataacttatgtttttaaattttttaaaaaaatttcaaataagatagacgatcaaagttagacgtgaaaaaccatggttatacttgaaatgggacggaaggagtacttgtatactcgagtactcactcggttttttaatatacaacacagttgacttttaaatatatgtttgaacattcatctaattctaaaattttatgtaaatgtataagatataaatcatgcttaaagtaaattgagtgataaaacagaggtattatttggtagtactgatttgatatagggtcttatcgtttgcactatggtttataagccgttgttgaaatttaaattttaaaatttgtgtttgaagttgatcttgatgttcttttaatatagtttttttgcatttgtttttaagtcgctaagcactcatatatatttaagttatatataaattatgttacaactaattatagtacaattacatttgaaagttttttaataatcatgtgacggttttttggagactaccaaataaataagcataagtagttgtctgtatctctcagcaccaacacctgtgatcaagcaagtcaaaccatgatacttaaactcaatttactttaagacaatgacatg

SEQ ID NO: 35325 - DNA, 4157 bp, Oryza sativa
ccccccccccccgccaccaaattgagcagctgaaacaggatgctcacatcatggttcttggaccgtgtccatgcacatctcacattacagcaaaaggcttctttcaccttgatttcctctggattctgtcatctcgctttcggttgcccatgagtccgggataaataaacgaactgaatcttgacaaaatggttgatcaagatgttgtctccactaatcttgatcgccatactaagtcttccctggttggaaatcaagcagcaggcgccgaccaacattaaagcgcaattaaggttgcctccaagagcaaggcaaaataatttcttcactcgaaaagcatcactcgcttcctttgcaagcagagtctcacatggccatgtaagtaccaagtccttgcgtttgcatcatgagcagatcgagcactaggcagtgagcgagtgagtggccagtcgttgcgagcgcactagtgcgtactaggcgtcagctttcctttttcttcttcttcagtcgccatcgccgtgatcaaaattttcagatcactcgatgtctcatcgctcttgacagtgtcagtgaagaacattgtttagaagtttttttttgtcacatcggatgtttgaccggatgtagtaaggggttttcggacatgaatgaaaaaactaatttcatatctcgcctgggaaccgcgagacgaatcttttgagcctaattaatatatcattagtatatgtgggttactttagcacttatgactaatcatagactaattaggcttaaaagattcgtcaagctattcctcctccaactctgcaattagttttttttaaaaaaatctatatttaaagttttatgtatgtatccaaagattcgatgtgatgtttttggaaaaaaaaatttaggaactaaaccaggccatagtagatgtgttcagcttctggcctttgagctggctacctgtgaagactgagtatgacgttgcggtgatatgagggtgatgctgcaagcacgattgatcgatgatggcccctgccaattattgagcgatgattaattcgtacagtgcactaagtgtcagtcagtctgaataattttcgtctgttctagtgaggctccaaaacgtgttattttggtcgattcagacgcgtcggacaggcagagtgggtgagcatgataattcactacttctagtgcttgacaagacactgaatgctgattcgtttcggtttggataagcaaccatttttgcattctttccgtgccaaaagaacaccgaaaaaagaggatagaacagttggagcagaagcaagttcagcagcaacaaacagtcttacagcaagccgggatcgagccaacgcatttgataacgagattaattgagtttgcttatcaacgaatgaacggcccgaccgaactctgaagaactcaatccagtttaggacagccaaacactctactgaaccagctgtctgagctagctaggtaggccaaaagcaaagatgaacatcactatggcctttgtttagtttggaaaatgaaaatttttaggtattacatcggatgtttgattagatgttggaaggggttttcggacacgaatgaaaaaactattttcataactcatctggaaatcgcgagacgaattttttgagcaaaattaatccgttattagtacatgtgggttactgcagtacttatggctaatcatggactaattaggctcaaaagattcgtctcacgatttttatacaaactgtgtaattagttttttattttatatatatttaatgctctatgcatgtgtctaaagattcgatgtgatgttctgtgaaaaaaattttagaaactaaagaatgcctatattagcaaagagaaaagagattttacaactactaacctaccctattgacgcagatcatagggccgggttacagcaattctagcattctggaaccagcccaactgtaatcctaatcttttagaccaccagatgtgagccagagctactcatcgcctcatgtgtcatgtcatgcgccacggcaacgcagcggggtggtcgctgtcgcgcgcggcggcggccggcggccggcggacggcgacggcggcggagaagaaggcgatggcggcggctagatcgcgagatgggcgggcggaggtaggtggagcggtttcccaaccaccagggccacctggcgcagcgtgggccccacctctcaacggctttgacctatctcgcgcgccgctgacgtggcgacgcctcattggtcacagcgatccacgtgtacacaaaccttttcgttgcatgcgaaaaatcgagaggtgtttttagctgcagcgtgcaggtgcagtattagttgaccacggcagtgtaaacactgtgcaagactatatctacgtgcactcaacgtaggagtactacgtgtgctcccgatctcgcaaaatcgctcgtgctaattactactttgatctggtcgatcaagtcaaatcgacacagtatcctggctaattgatgcagtatcctggctatggcttgatcggaagaggcaattcgtgatctcctgtacgtttcgtgtcgatctggacttgccagaagaatcagttcatctggtaattaatcaagcaattaattaattaactattaaggtcactgacgtttgatgacattggcaccgatcgaggataaacaaattgtgtggctaatcttcagggctcagggcgctgatcaggtggattataaaatcgtattgtccaatcgatggcaaggtcctgtgattggattggatcgtgtttatgcttaattttaaattggaaaagtctatacgtacgaaactttttattacgaaacatgtacgaagagcacatgcagcctgtcttttcggcttgtatgctctataatcatcttgcaagtacctaagcccgtaacaaatacaggcccacgtatggtgcaaacgaaaaagcaagagttatatctctacttgtctgtaaaaccatgtgctacgaaaatctatacacaggctgcagatgttcaaactataaacaagtaaatcgtgttcaaatcatattgaggaattactactgcatgctcatatcactatcgactaccacacaactaatatatattgtcctttgcagcatcgaagtgatcagctagcatatcaaacaagtacatcggtgcatcaatgtatgatttattattagtgtgggcatggtagatcctacctactatgcaggaagcaacccaatatttactgctcgtattgtggcggcagctgaggcggtgaggcctaggcatatagccgccacctagctcatatgcttgattgaattgaatttttttagaactgattaaatttattttatccttgctttctgcatctccactcaagcgaagctctgaagtttgaatgagtagcatgatattgaacctatcaatttgatatgggcttttcttattgaataatctagagtgttgtaggcctgtgatcttgtgtgggcttctagtgttctagccatggaaatcacgtaagcaggtagttttcgtacgaatttcgtacagatttcttcgtgtgtatagcagggtgtcggtgacatgggaccgggagtatcatgactagaggcttgaggcagacacaatcgcccacgtggcctggcaccctcggggggcgtcgggcccgagggtgatgtgttcgcccttctctttgtctccccgaggggtcggaccgctcccgtctcggccccgagggccgaggcgccccgaccccttgtgggttttgtgccgtgtatatggggtaggtgagcatagcggggctcacctaaccacatttattgtggtttggacgagcgcgtcacgccgcatgtatcgcagtgcagcacgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcttggagatggcacgttggtcccggtcagatatataccaggcttcatcctaaccattacaagcaagacattgtatgaagaggggcgaacatgcagattaataaactcacccgtggtggacgtaatgaccgatttgtgaccggtct

SEQ ID NO: 35326 - DNA, 4994 bp, Oryza sativa
  unsure (1)..(4994): unsure at all n locations
aggggtcggacggctcccgtctcggccccgagggcccaagccccccgaccccttgtgggttttgtgccgtgtatatggggtaggtgagcatagcggggctcacctaaccacatttattgcggtttggacgagcgcgtcacgccgcatgtatcgcagtgcagcacgctcgtttatccggtcagtgaccagtcatagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcatggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaatagataggataagtccccacaaaaaagagagagatggtgcatgtggtatccccttgaggtataaaaggaggaccttgcccacttagaaggaaaattttttcggatcccagaacgatcgggggctggctcgcactttgtagcttcttcatacacagatccaccaaaacacaggagtagggtattacgcttctcagcggcccgaacctgtatacatcgcccgtgtcttgtgtttccactctcgcgaactttccacagaccaggagcttagaatctcacccagggcccccggccgaaccggcaaaggggggcctgcacggtctcccggtgaggagccccacactctgtcatctggcgcgccaggtagggggttctgcgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgagctcgtactccaccgccccctccacgccaaagtcctaggcgggaggaggcgctcgagagggtcgaaggatccgcgacttcgacatccacgggtgatggaggagggcgccgagatggggagcgtcgcctcctcgtctatggcgacggcagcacgccccagggcgcactccaagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggcggttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggatgcggggatcagccctccgtgcccccggttggtggtgtcggctgtagagcctttgtggcgagccttcgtaacgtccgttggcccccaaggttccggcccaccatcgccgaaaaatatgacgggagcatcaaccccgctgagtttcaccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcactatgaactttcaaggcacatatccgcacccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagcttcttcagctcgcggaccgagtggctcgcaaggaggaggcccagacttggaacccctccggttccggtgtggcagcttcggccgcccccgggtccgccgctcggtcagggcggcgggacaggaggaggaagaagaggtcggcccattccgacgacgagggtcatgtcctcgccgtcgaaggtgtttcgctggccacccgaaaggggaggcctgcgagcgacaaaaagaaggaagccgacgctccctgacctcggctacttggaagagcgaaggtggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgacggcacagagctgcctaacccgtggaacatcgaacacattcgtcgcttctacccctagtgggggttgggtgtcaggtcttgggctcgggccaaccccgcacccccccgggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccccgggacgtggtgaactccgggggggaatcggcaaaaacccataatcgggtcacccataaccctcggtcaccacgctcccggcctggccagtctcgacatgtggatctccccaggcactagccttgacccgcgccgtttgaggctgggacctgggtacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgcgcccgggtagccggcctcgccatcgctgtcgtccgcaccgtcgtcaccgcactcctcgttggagttgaaggcaaacgcgagccgaggggccgctcattattgtcggtcggttttcctttgctgatgcgcgcaatttgcgaccgccgggattctgcccgaagagagagagagagcagggaggagaggcccccgagccaaacggcggcccaaggcccccgacggccggagctggccctccgcctgcttgtccgacggtgccaggcgcccccgacccccaggatggcctgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagtgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcaatcaagagccaggccctcgccgactttgtggtggagtggaccccagctcccgagctcgtctccgctcccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgcccttctctttgtctccccgaggggtcggaccgctcccgtctcggccccgagggccgaggcgccccgaccccttgtgggttttgtgccgtgtatatggggtaggtgagcatagcggggctcacctaaccacatttattgcggtttggacgagcgcgtcacgccgcatgtatcgcagtgcagcacgctcgtttatccggtcagtgaccagtcatagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagannnnnnnnnnnnnnnnnnnnnnnnnnnnnnnnnnnnnnn

SEQ ID NO: 35327 - DNA, 1974 bp, Oryza sativa
ccgtcccatcagaaggtcattcgggcgggcacccatacaagtctccgtctgtttatgaatagataggataagtccccacaaaaaagagagagatggtgcatgtggtatccccttgaggtataaaaggaggaccttgcccacttagaaggaaaattttttcggatcccagaacgatcgggggctggctcgcactttgtagcttcttcatacacagatccaccaaaacacaggagtagggtattacgcttctcagcggcccgaacctgtatacatcgcccgtgtcttgtgtttccactctcgcgaactttccacagaccaggagcttagaatctcacccagggctcccggccgaaccggcaaaggggggcctgcgcggtctcccggtaaggagccccacgctccatcacagggttcttttaaatttcttggagtggatttgatatattggcaggtaggcataggtatggagctccttcttcctccttcatgtagggctatcaacgagctaagctcgagcgagtttggctatgtaggcttgagcttgacatgaactcgagctgagctcgagccgagcctggatactgattgagcttgggagtgagctcgagttcaagctcgagcgagcttcgagcctactcgagcttgacagcttgacttggtgaaactccaaagaacttacttttgtataagagatattaatacaaattattggtagtcaaaattaatggatgctacttgtattgaatgaagcctctgtagtttttctcatgaattcatgactttgaaatgttgcaattaacaaaagctagctactacatctaataggaatgtagtactattactagcagccggataagtgctttattgagaagcattgatgaggtcttgagacttgagcaggtcaagcacgatgaccagtatatattgtcccatcaagaatatcttcttacatgcaatacatcttatgttaatcaagccctgtcgagctattcgagctcgagcttgctaggcttgcgagcctcaacctaggcttgagcttgacttgtctagtattcgagccgagcttgaatcaagcctgtaacgaatcaagctcgagcagcttgcgagcttcgagcttttttgatagccctactgtcgatgtttgatgtcgcgattccggtatttgcatagcatggggatcattggtactagggtatatgcgagattgaggtaaaagagatggagatagggatttttatacaggttcgggcccctgaattgtcaggtaataaccctacatcctgttggccgaagccggtatcgctcttattcaccataatcaaactagtacaatatttggggtagcctatctaactgttgtcgacttggcggtatgtagtactggctcgtagtcgacaacagggtagccttcctcctcgaatccgtatccggcgagattagagacaactctatatctctcctaacggtatctgtaggcaccgtaggggactagccatgcctatctctgaagtcgatatccggcgtcttgtcttggcgtatgttggcttgtatgttgtggcttctgttgttccgtatcttctatggggggtctgtcccttctcctcctagggggccttatatttatacccataggtgtcctcttgtccaagtagaactagggaaatcaatatggatacaatccgagtagtccttgtcgtttcaatgtagaactctagtcatccttccttatgcgaaactcctcttatatccgaaggttgtttccgtataagacatggtatgtggtggatcctgtcgagatttagtcaactaatattaggtatgtggtatccgtaaccctgacacctacctccatggcaatggttggagctacctggcactgttccatggaatctatgctgtcattcttcttctctcttcatctgttgcaagtttgcgatctcagctatatactacctccgttttttaatagatgac

SEQ ID NO: 35328 - DNA, 7438 bp, Oryza sativa
cagcgtcatctattaaaaaacggagttaatagtattttttttgcaaatgatatcataactggaaaccattatgggagccaccacgaatttttcatttggtgtttgggattattggttgtggtggatacaaatgatacaagcatcgctaagtaacgatttgaatttgaactcggtcgcatgaaaaacaaaaaaaaaacaatagtttcaatgcagtgataaaatcagggcccatttaaatcctgaggcccaaggaaatccagcccaatatatggatctcgacctctccggaggaattgggccgaaatcccatactgggccgtactccttcgtgcatattgggcttaactcgagaatctcgtgttcctctagaaaattctcctcatccttctattctttcctctcctgctcggcttcccccccaacccccgccttctcccctccgactccggccacctccgcggcggcggagcatcctagggtttcgcgccggctcgccgccggcgtacggagagggagggtgtaacacgcgcaggcctgcgccgtcgtcctgctctgggaacttccgcgtgcagcgaggtaacgcgcatctccgctgctccttcagatctgatcgtcttcttccagcccacgcgctccgctcgccgcttgctcacccccacctccgtcgcctcgtttcgtgcagggatggacgagtgggttcgccaggccgaggtgtgggtgggacaagccgagaggtggatccggcagcagcctcccgagcaggtttacgtcgccgtcgcggtggtcgccgtgacggttctgttgctggtcgcaggtgatgtatcaattcaactattcaagcctgcctagtttttttttttggttgcttcaaatcttgcatacgagagtactggtttatggaagagctaggaagcgtgggcacaagtgatactgaaattgcttaggcttcgagaatttagcaactggctagagttgtttccagtgcaactccataatccagcagtttgtttcatagccataattgcgaattaatgaactagtttgtgcatctgatcgcgtagctcaatagccagccataatacagtatattgttgccaagctcaaataaggttacattctgaagcctgagcttaccttttgtacccttgtcgctgttacatgttgcgataatgtttgagtaactcatattacctagtttgccttcaatccatctgatcaattgcatatgtgtatctgtttaatttgtggcacaagcgcacacacaaattcctcagtatggtataagtgagtccaccatcaccaaaaagtggaacttctaaagtagtcattttgctacattattttgatggagctgcatgtgcagtaattaatatgcaattcctggcttctgttttatttcagtttcgtgcctgaaatcctcgaaagcaaacaccatagtgctatctgggctcagtggtagtggcaaaactattctcttctaccaggtaattttctgtttcaatcattcaatgcccatatatggttcctttttatgtgtgtttctcactccttcagtgacagttattttttatttttgatggattaaagcggagaaatgaaattgtatcaaattgatgaataatggctaaacatttaatggtcttcaattctgaactcgtttttctttctattgtttcaacctctatacatgtacagttcagtagcttaggaaatgaccattttaaataacctactcaatctgattttgatgttgtaatctatgggtatctcttcagcttaccttgcttcgacttaatatgctcctgtctgtattctttccatgatatattgaatcgcaacatcatacatcaccactgttcccttttcatgttaatttgagttgagtatcttttgtctctgtggtctgtgctaattctccctttctctagcttcgggatggatcaacacatcaaggaactgtgacttcaatggaacaaaacaacgatactttcgtgcttcattctgagctggagagggtaaggcaacttcttagagacaaatattttaaacatcttgatatgaaatgaaaggaagactatcctgttatatagaaccatgcatttgctgactacaatatattgatgcatgttcttgttcgctctgcagagaggcaaagtaaaacctgttcatgttgttgacgttcctggtcatgcaaggctcaaacccaaacttgatgaagtcctgcctcaagcagctggaatagtttatgttgttgatgctcaagatttcttgtctaccatgcatgctgctgcagagtaatttcgctgacttacatcctgttcttagtaaaaatatgtggtgtttattttagcttaaattgaaatccatctcttactggaatgagattagaagtgtgactaggagcttccgtcttgtcatgccgagacaaatacggagtaataaattgtgtgctgtgtcagccttttgttgcagttgctatggtcttacaatattctctttccgcaggtacttgtatgacatcctgacaaaggcaactgtagtgaagaagagggttcctgttctgatattctgcaacaagacagataaagttacagctcactcaaaagaattcatcaagaagcaattggaaaaggaattgtatgttttttcttctaacatatcatattagtataactatagtgcatcagattgtgatggtgtttatattaaatttctacaattttaatgcgtccacctataacttatgatgtagctttagtggatacaataaattattctgcaatacaagtctctagagtacacatgtttacatacttgaaataaccgaggtcactataatcagcaactcatttaacttaaactacttgtgtgctgattttactgttgtgtagaaacaagctccgggaatcaaggaacgccatatcatctgctgacatcactgatgaagtcaagcttgggaaccctggagaagcatttaatttcagccaatgccagaacaaggtgacagttactgaaggtgctggtctgaccggtaatgtttcagcggttgaggagttcattcgtgagtatgtgaaagcttaggccttagagttgtcggacctttacagaatagagtttgtattcgttcaaaattgtcatctaagcggagactgattttcctgatggaagaaggaaaaccttcatcatctcatctgcatctgcttcattccattcatgcgtgtgagaaatttcaacattttcttgaaaggaaagcatcggacattcagttgaacttaacttttcgttgctaactcttaacagacacattgctcttgcctcttggcatgcatgaccgtcttaatattatattatggtgtattatgcttgccctggaggcctgaactctttaacgtttatcagactctcgccttgctaagctatacgacttgtatttaaacaagatctctctccggatcaaattatgaacaccggcattgcaaacacgggtacccctcgcaagatgatgcttgtgcaggggcacctcgagtttttcggcgaccacaacagatggcaagcgacatttcaccagatgcaaggggaccttctaccccatcggcgtcccggagaacaagccttggtatgaaggggctgtttgaatgctagggagtattctaagagcgggtacaatagcaggctataagccagctgcaaacatattttaagaagataaataaggagagagaagagaagcagactacagatttgtagccagctgtagcacggactccaagatgcagggtgtgtatgacatgtgggaccaggtattaatagcgtagtatataactattgtatgaatgagctattagattggctatagatgaattggagctagtagttggctatactattaaacttgctctaagtttgctagtagtatcatttatcacacttgttcaagttatagctagcaaaaagtgagccatacattagccatatgatatgtgaaccataagaaatgagataattttatcatccataagaaatgagatattttctagttcaaaatttggtatatctaagtactaaatatttcaagttaatttaggtatcttgagatatttttttaacaactgtgaaattcctctaggaaataagatttttcagttgataatatgtgaaccatgagaaatgagatcttgccacaagtgcgtctatacataaaaaagggggcgaactcggtcaaatttacctaatacggagtataaggtatgaaaaacttaaacaatgtttggtaaacttatattttagtgtagatatataagttacaatatatttactctacatttttttacatttatcaattttttaataaaatttattgataaacgtatggcaaatttgaaagaaaaaactatttctgccagacatttgtttctttaacaaatttctgtcaaaatatttgtaaaatttatgggagaaggccaagaagcccacggatgctgaagaggcaacatacgcaacagaataagcagggttttttttttttagatttaagcgttgtccatattatagctaaaataaaccttaccaaattttgttaagttgacaatattgtagaatttcttatgtatttatcaaaatttggaaaaaaatgtatgtaaatatttggtaacttttaaaaaatgacatggtttaaaatgacgtaaaccatcgttatcctcttctcgttaatcgcgttccatctagcacgaaacacgattcgatcgccatgttggacggcggcttcatcgagctgaagctccggtacgaggacctcgccgccggcgacttcgtccgctccgacgacatctacgccggcggccacacgtggcgtgtcctctgctaccctcgcggcggcggcgcgatgaacagcaatggccagcggatcggcggcgagtacctctccatcaagctcgacctcgtcacccggtccaccaatgtcagggccatcttcgccgcgttcctcgtccacctcgacggccacccgtccccggtccacgccaagagcttcgtcgccgtctaccctctcggcgccggcggccgcggcggcggcaaggccgccgccgggtggatgtacttcgcgtcgcggagcgagctcgagaagaagttcgtgtccggcgacggctgggtcaccgtcgtctgcggcgtcctgatcccgagcgacagcccacaggcgctgtccccgccgccgccgccgcctccgtcgtccggtggaggaggcgggcacatcggccgcctgctctacggcgccgccgacgacaccgcggacgtcgcgctcgtcgtcggcggcgagacgttccgcgcgcaccgcgccgtgctcgccgcgcgctcgccggtcttcaaggccgccctcttcggctccatggcggaggccaccgcgccgtcggtcgcgctccgggacatggacccggcggcgttccgcgcggtgctccacttcatctacacggacgcgctgcccgacgacatcgacgagctcgccggattctccccggtggacatgttccagcacctgctcgccgcggcggagcggtacgagctcggcgggctgaagctgctgtccaccaagaagctgctcgacaacgtcacgccggagaacgtcgccgggatcatcgtctgcgccgagacgtacggctgcccggagctgaagaagaagtgcctcgactacctcgcgcgcgaggacgaacacttcaggaaggcggcgacgacgcaggggtaccttcgattgttgcaggatttcccttccctcatggatgaaatacgagctgtgattgagagatgagacagttagtgcggatcgatgtggtggctggatttaaattagaaatagaaattccagggattaatgtgaggtaaatccgtttggtttgcttttgttttaaggctgtgttcggtaggtcaaacacgtaaaacaaggtgatttattagcacgtgattaattaagtattagtattttttttctgaaaaatatattaatataaacttttaaagcaactttcgtagaattttttttcatcaaacataccatttagtagtctgagaaatatatgcgtgcgaaaaatgaagagatgtagttgagaacacaagctgccgattcatagttttcgaagttgagaatattgattaatttatgacctcatggtacatatactgggagaattatggattgttgtcttgtgcttgagtgtagcggtctgtgatctattttggaccataaatgttaaatggtcttctatttttttcgactgaacattttgtcaatatatattcgtagtaccgctaaccatttttatatgacatcactacaaagttcgtgcagtgtaacaatagtttgatagtgtgtctggactttcgagaatttcaaatacttcgttgatttcagcttaaatttttaaaccagatttaaaattatggtagtgttttaagattatatggcagacgcgcacataaaccactacactcgcaacaccacacctcacatcttacgaacgcgtcgcctaacacatgctctaagagacggaaaccaatggtacatccttgatctcaccaaagtaatattgaaggtctactcgcatgtgcgtaatattggtggacaccaaaatttaatccttgtgggtgaagtcatgcactcacaagtcacaactccaccactacaccacctctgcttccccaaaattttggttgtggtagtttttggctaaatatacattagaaaaaaattacacatgcccaccacacgagctgcccacccggcatggaatggtcaatagctcgccggcgacgaccaccacacgagctgccctcccactgcagcaccgagctcaactcaatgtagcggcgaacttcggccgagcgaggtgagtaccagaaaccggcgccggagacccgtcgtgtttgctcgccgccgcttgctcccctgctgctgcttacgtcaccgccgccgcttgctcccttgctgctgttgctacttgctcaccgaaagaggagaggggggggggggggtcggggggcttgtttcttgttgttgttggtcagttagagatgaggcccaaagtaagggaaaaagaaattaagatgagatcgataggatctaacagatgggaaggatgaacaggagagagaggagaagagatgaaggaagaagaaatgggcaatttggtccatacgaaaatatgttagttaaaaaaggattcaaatagcttatcaagtgtataggatagcatgaatctgattttagaagagttttaatgacatcgttccaattagacgaattataatggtattttttaaaacagtcaaatttataatatggcatgaatccaattaaccctaaacatataatactgttaacagtgaaatttggtaagcccggagtagtcatcggattagagtcagcatcggcttcgaagtcttgagattagcc

SEQ ID NO: 35329 - DNA, 2356 bp, Oryza sativa
tgtggcatggcaagttatctattaattaggaatagtttgttagtttccttttatctttagtaaagtgtgtttagtgtcctataaggactttatcttttccttttatctttaggaaagtttatttcttgtccgacaaggacttgtatcaacccatgggtataaatatgtacacctgggatctatgtaatcttcttcacgatcaatacaattccgcacatcgccaccttttaccttttctactttattttatcgtccggcgggacttggcacccgacgcgaggctgcatcgtcttcgatctccggcgaagggataagtccaatgttccatcggtccaagcaattgtatcatctacgtcggcgtcgttcaaggctacatcagtacattcgacctcttggattactctgctttggataatatatttgcctacctatttatcatatgtctctgttaatctagtcttagcatatcaatttagctctatcggctgcttctcgttttagggtttctgctggtatcggctaaattgcgttgctagattagattagcttagacatctaccaccctgaaaactcagtcaacggcttgattgtctagatattatgtttcttttcatacttagtgctgcatcagttaagtttgatctactaagtcgtgcttagaaccataatctctagcttgcttcttgattgtcaataagggtttcatcggggtttcagccggtgagttatctggacgttgcatcagctcataaggattgcatatacatataagttagatttagccgatgacaacaaaggtttcactgtttaatctaatcttgtggatttcatgacatcggacctccagccgatgtgtgctttaacctttggatcgatgcttattctatcatatcaatgctagccgattggtttatactggattatattgttattttattacatcatcatcatcatctgattgcctttatatcattatctacattggacatatagccgattgcttaaaccctatcgctatcggctattatcggctatcggctggaactactccatcggcttgtcagccgataggctgttttatctactgtttacatatcttgtcagttgcaggatcaaactgactggcacgcccgcatctcattatatttggacctgcactggagctaagcagatctcccaggccagtgtgttcgattttttcgttaacaaatacacaattaataactggtcccacttgtcatacacacatgtatcttgtagtctgtgctgcaactggctacaaatatgtagtctattgcttttctctcttctcttttatcttctcgaaatgtatttatagctggcttatagtctgctgttgtaactgctccgtactagggatgaaaatgatacgaaatcggatggaaactacctttatcttttcgttttcatattttttacggaatcggaatcggaaaccccagatacgaaaacggaatcaaatattgtcgaaaccaaaaacggaccggtgctgatacggtaacaaaaatttatcgaaatacaagtctcaaactaagctttaaactatgtcaaatccaattctcaaatttcaaatttcaacattacatcacaaagcacaatcatgtcaagtccaattctcaagtttgaattgggtgtattgggttgggctgaattgagtgacttagacacactttcattcatttcggtggtcttacatgccagcctcaaaagtatcgattaaagctagtggacgacggaaaaatgttaaattatcaaatttctcggtagccgctcacgccagtggcggagctagacataaaatcaagggaccacctatacatttgtcgacaaattttctactaaaaatttgacagatgtaattatagtacaatcgtagtgtaattacaatgtaacttgtatgtaattacactgtaacttgcatgtaactacagtgtaacttgtatgtaagtttcacgtaattttgaatcgttagatctattacaagatttgttctatggaggaagaaaaaaatcacatcacacacatatatgaaagaatttgttcccacgacctctattttactgaaataacatgttaccgagagattcttgaaagttacatacaagttacattatagttacagtgtaattacatgcaagttacagtgtaattacactacgattgtactgtaatttcatctgacaaatattagggggagaaatttgatgacaaatatttagcaaaatcctaaaatcaaaggggggccagccggcttttgacagctcaaaagattggcaatttctccttttttttcatgcattggcaatacataaaagccaatggtttgcacaagtgg

SEQ ID NO: 35330 - DNA, 4692 bp, Oryza sativa
ttgaagctgatgtgtgcgcagaagctgtgggagaaagtatcggtggaaaatgtcgcgacaatgctgatctacgccgagatgcacggctgcccggagctgaagacgagttgcctcgacttctttgtgcaggaggagaacttcaaggtggccgtgctgaatgagggttatgctcagttggttcagcattttccatccgttattgatgaaattaaaggtttgttgggagctaaaacaatgcaatggagtgaaaattgatgtggtatctattgagtttaagcttgttacaatgtctatgaatagtactactccagttacttgtatccgtattacttcttctgtcccaaaatataagcatttttttgacttcgatagggtcttcgagatactactttgactaataatatctataaaactaagatgttttattttaaataaaaagagttgcgcattatgatagtttggttaacgataactctaataacaccaattttacatgattgatcatttttatttttattttgctattaatagttaaagttaaaaatatttgacttgatactatactaaaaatatttatattttaggacggagggagtatcttataaaactcagaaaagtttgacagcatgttctataaaacatcgtactctaggcagctagctgttgttttagctatctcaattctcaactactccattcttcccaaattgatcatcatataatatcatataatggaatttaaaatttctcaaattgatcatcgtataaccgcacggacacacatttcatccgaatacaattaatgcagcatggaataatatgtgcatgctaaggtataattggcatggtgttttaatcgatgcatggattttagagcaagtttaatagtacagccaactactagctccaaatcatctatagccaatataatagccaattcatataatagttgcttactatactattaatacccggtcctacatgtcatacacacatttcatcttggagtccgtgctgcagctggctacagatctgtagcccgctgctcttctctctcttcctttatctctttaaaatatgtttatagctggcttatagtctgctattgtacctgctcttaagagaaaatgtgcatggtctcttgattgatgtgatttaaattatccttggtgttggtgtataaacatatatgatgattaatttggaaaggagccacgtgggtgaaagcggggcgagttcccttgcggtagttcatctattcgggagacgtgtcctaacccatttgttttgcccttgtaaaagtcttaagtatttttaccactaactttgttgtatcaatatatatgagatacaacttttatcctcttttttttcttaaaaaaagtagtttcaaaatataagtaacttttgaattttaggcacgacccttttaatatttttagtggtaaagatgaatatttttatgtacaagctgggtttttcctaggcaggcctgtaggtggaccaggcggcctcgtagatgagagcaaggctaataatatagtcgacgtgttggctataaggttctttatagccttctcttagcatacccatataatagttagctctttataattaatatatggccaacttgtctctctcacagaattttttggttcttgtgtccaagccggctgtaagtttacaacccgtttttcctctctctcctctcttctctcctccacctcagcatttagccggcttatagcctaatattatacttgctctgaatctgcgtactgaagtatggccggccgttgcagcgccagatttaatgcagcggctgaaccgaagagacgaggctcaggtgatcgaagagctcagcgcaaacccagagagatcacagctgcagtaacaataacgcgggaaatcaaactgctactcattttgatgacaaacaaggagaattactgctactcgaaactcgaggagttcgatcacactgtactgatcactttgatcagtgtatataatcaggattatgggagttggatactgttcgaatcgatagatagatacatctccgactcaatccctctcgcgattgcgttctggtttgcagctccatatgctggcatgccggactctggttctctcgagctcatactagattacgaggcgaccaaccactgtgccatcctcgtcgacggcgagacgttccccgctcaccgtgccgtgctcgctgcccgctcgccggtgttccgggcggagctccttggctccatggcggaggcgaagatgtcgtgtatcactctgcacgacatcgagcctgtgacgttcagagctctacttcggttcgtctacaccgacgagttgcctgcagacgacggcggcgagctcaatacgacagcaatggcgaccgagaggaagaagggaggaggctgcctactgatggggagaagggcggggagcggcaaccatcaggctgggaagctagcgagcgtgcgcggagagggaggaggcggggaggccgatgagcaggacggagagccgacgagcgggacggggcgaggaggccgacgagcgggatggggaggccggcgagcaggcgaggagggtggggaaaggggcggagggcgatagccatcgggcggggaggccaatgagcttgcgtggagagggaggaggcggggaggccctcagcccgtcgatctccctatcctggtggccttgactccccacgtcttcgcccacgacgccgccggtagtctccatcctcacagcgacgctgccggtttcagtcatactacttttgccacaccctcggtgagcacccatgcacaaagcctctttgaaattgctaattagcgcgtatgcgccatcagactaactcgcgcgcgtttctagcccatactcatacgcgacccacacactcgcgcttaccccatcgcttcctttttttacgcttcttctggcgattgttattttgggtaaatctttccttttttttctccacatgcgtgattctttttaggatattttataaattaaatctttacctcccatttcacttgagaattttgaatttgaattgattttttttaaaatttaagttgaatgttttgaattttaagatgaaagttttcaaatttaaattgaatattttgaattttgaggcaaaagttttaaaatttgagttaaaagtttttaaatattgacttaaactttttttaagtttgagttgaaagttttcagatccgagttgaaagtttcaaatattgatttgaaagtttcaaatcttgatttgaataaagttttcaagtctatattgaaaattttcaaatccaagttgaaaattttcaaatccaagttgaaagttttcaaatctgagtttaaagtttttaaatcttgacttgagaatttacaaatttgagttgaaaatttcaaaaaaaattgagttgaaagtttcaaatcttgacttacaagttttcaaacataagttgaaagttttaaatcttcaatttaaaagtttgttgcagttaaattttcgtacctatcccaatttgtcgtgtcctaaataaaaggaataaaatgtgtgggcagttattttttcaaataaaaaagaaaagaaaaaagaaaagaaaagaaaagcgagaacgctacccgtactacccgtaccgccgatcccgcgcgcgagttaatctccccacgtgcacgcgtgggataggaggcccccatcctctttctcatatctcccgagcacaccggtggtcgagctcgatgacgttgcggccgtcgcctagcacctccccaccagccatcggccgccgctccgctagagagctagacagagatggggaagagggtgagagaggaagaagccggcgtgttgtatcagtgacatgcggagggacctgttgcatctggtattgcagttcagggaggaaaattgaactcggtgtaaagttaagggacccaaatgaacttattcctttatatgaggttgtgcgtgttgtccatgggcctggacgtgcaaagctgggcttctcctagacaggcccgtagacggaccaaggcctggtagatgccccctggaccacgtctggtttgcacgccgggcgaacaagcgcgcgagctgaaccgaagagacgagcatcgggtcaaggtgatcgaagagttcagcacaaacctagacatcacacagatgcagtactagtaaaacaatgatcttgttgtatagcagcgctgctagtcattttgatgaataagaatgagaattactgctactcgaaactcgaggagttccatatctcagtgctgatcaattttctttttcgaggtggagtaaatcactgctgatcacttgatcagtataagtataagggcaagttttataatagatgtggtggtcacctccaattttatccacatcatccattcaaaaaattaaaattaacttatataaatgcattgcatttaatacactagtcccaatacacttgccaccaatcagccctcttattttctcttgttctttgaaatttgtgtggaggttgccccttgcatgagggatggctcctcccctctcttctcttctctcctccacatcattatttaagcatacatggcactttggagtttgtgcttagaaccttagggcaagtactataggcatttaagcacaatcacctagatgccacctaattttaaatg

SEQ ID NO: 35331 - DNA, 9118 bp, Oryza sativa
ccctcatgcaaggggtaacctcttcataaacttcaaggaggaaggagaaaagagtgaggttgattggataagagtgaataaaataaatatttatgttgcattgagactagtatgtgagctgcccttaataaattagttgatgatgtggacaatattagatgtgatagtcacctctaacataaaacttgcccttatagtacttgccctaaagccatcaggattattgttcgatgcttcaatagatacatctccattaatatttgtgatgaataattggctttacaaaagatttaatcaataaattggtttgaaaatatgtatgaatgttggtgtgaatgcgtgggactaatgtgggtcaggttgtgatatctgtgcttagaaacagttgttttgtctgattatgtgcaggtgacctgaggtcagccttggtcaatggtgaggaccggaactatactcagggaggagcagattaggtctagtgctgttgagataccatgtgagaaggtgactagagtcagtattcttagagatcaacttcggttaacgctggggaccgggactagactcagggaggagttgagatccagacggtcaaagataccggataacgaagttggatacgagatggcacaccatggatggacatcgtgtgggagagatcttcgcaacaggtttcacaaggtgtgcatataagcgtcggtgttcgtgaaggagattgaaagaaattggagtggagtatatattttttttgaaacacagtacaaacgcaggcgctcacaacgtgcgcacactcacccccatgaacgcacacacgcacaccctacccctatgagcacctcgctgtcgacgggtacgtcgcctaccactgaaagaataattagccgtaaatgcgagcacccgtgtcaaatctaggatttgaactcgggtgggctagttccaccacaaggaacctaaccagttgagctatgctcacttcactggagtggagtatatatgatgctacagtacggcgaggtactgttggagcatgcatatactccctccgttttttaatagatgacgtcgttgactttttctcacatgtttgaccattcgtcttattcaaaaaatttacgtaattataatttattttgttatgagttgttttatcactcagtactttaagtgtgatttatatcttatacatttgcataaaatttttgaataagacgaatggtcaaacatgtgagaaaaagttaatggcgtcatctattataaaacggaggtagtatatgtcaagtacatggttgctacagtacactatgaactgtagcggtacactgtagcatacatgtgtcgtgtgtgctgtggatgtcggcctggatggttgggctggcttggattgctggcggcccacgttggtatgagatgcggtgggctgcagggcagcctaggtggcccacgtcgagaggcagcaaggcatcggcccagctggcctgtgcggctggagaggaagcagccgtgcgcaggtgaccgagcaggagacagagaaggaagtccgactcggtgtgattgtttgtggccggtgcggctgcagttttgttaaattgtaaaaggtttggaaattgaggtattgagtcctagagtttttttttataaataaatgaggggttgagactaaatggatattgactttttggtagagaaaagttagggtttacttcgaggtttcaatcctagttcgtgagttgagagaggagtaccttaggtgcactttgtaaacatatattgatgcaataaagttgatatacttttaagtgtttcgtcgatacgtgtttttctggatcccaacggtttgaccggaggcgattcattggtctaaccggggggcggtcacatcggcggctcaaccaacggcagtggcagggaggcggttcaaccagcgaccaggcggtggttagaccggcggcgtgcgagcggtccgaccagcagcgatagaactacatcaagttctccattgatttgagggtaacttttatttccgctaaaagtttttgggtttttggttttatcaactattcacccttctctagtaggcttggttactcgtgttcgatcctacactccgtactctctcgagtgcgttctggtttcagctgcatcgtctgcgtagacatgccggactccggttttctcgagttcaaactagattatgcggcggccaacaagaactgtgccatcggcgacatcgtccgctctgatgtctttcctgccggaggacacgcatggaggataaggtgctacccgagtggtatagtaaagaagataacggtgagtacctctcgctcttcctcgagctggtccgcgaatccacttccaacaatgtcagggccatttttgacgccttcttggtggaaaaagacgacgagccatcttccacccacgcagacaggggcgtgcatgttcacccaaccaatggctataccgcatggggatggccacagttcgtgaagcgaagcgatctcgagtcgtcgtcgtcgtcgtacgtggtggatggcaaggtcagaatcatgtgtgtggtcatcgtcatacgagacaacaccgtgcccgtgccaccgtctgacattggtgcccatctcggtggcctgctggaccgcggggaagggacggatgtctccttcctcgtcgacggcgagacgttcccggctcaccgtgccgtgctcgccgcccgctcgccggtgttccgtgccgagctccttggttccatggcggagtccaagatgtcctccatcactttacacgacatcgagcctttgacgttcagagctctacttcggttcatctacaccgacaagttgcctgccgacgacggcggtgatcagctcaagatggcagcaatggcgaccgatgagctattccagaaattgcttgcagctgctgataggtatgatttgagcaggttaaagttgatgtgtgcgcagaagctatgggaggcagtgtcagtggacacggttgcgacgacattgatccacgctgagatgcatggttgcccagagctgaagagtagctgtcttgacttcttcgtgcaggacaagaacttcaaggagaccgtgctaactgagggctatgtgcaattggtgcagcgttttccctcgattaaggatgagatcagaggtttgctgagagctaaatcaatgtaatggagtgatattttgtctggccgttcaaatttgcctttttcaggacctgtactgtcaggctctagttttctcattttatttctactcaaattaatagtccattcctcgatatccacattgatggcaatcgacatgtctctttgtgatcaaagtttggagtttgtatgaattaagaatatcattactttttaccagaaatactcaaagttcattacatttaaataatttatcaaacaaagaaaataatatttttatatgaggaattttacagtccttgagaaagtactttgaggtacctaaattttacattaaaatttttggtaccttgagatacttagtacctagaggtaccaaataaaaacaaaatgtggggtccacatgttggtcaaacaaaaggaaaaaaatagtgggacccacatgttaatgggtcccaccctcctctctatctccaccacgtccttctcccttctccctcccggccatcttttaatcctcgagctccctcgccgcctgacaaggtcgcaccgaaaggaagaagggcggaggctgcctgctagcggggagaagggcgaggcgcggcaaccatcgggttgggaagctggcgagcatgcgcggagagagggaggaggcggggaggccgatgaatgggacggggaggccggcgagggggcgaggaggccgacgagtgggatggggaggccggcgagcatgcgaggagagggagaaggcggggaaaagggcggagggtgatagccatcgggtggggaggccgatgaacgggacggggaggtcggcgtgcgcgcgaggagagggagaaggcggggaaaagggtggagggcgacagccatcgttgcacggagggggaggaggcggggaggccctcagcgcgtcgatcctggtggcctcaactccccgcgtcttcacccgcgacgccgccggtagtctccatcctgacaacagcgacgctgccggtgtccatcctactgcttctgccacacccttggtgagcacccatgcacacaacctcttcaaaattgctaattagcgcgtatgcgccatcagactaactcgtgcacgtttctggcccatactcgtacgtggcccttatttttttggaagtttttttagcccttcttttttgttttcgtcttttttagggagtcggactttaatttgttttttgcctttttatttattttattgggaaaactattgacgttggacgacagaaacactacgaattttttaaggaggtaaaagggtaaagataaagatctactaatcaaaatttataaaatttttacataactatgtaaacaacatacatatacctaggtgccgtagaaaatactatcccctgggagactttctactatgcttggcatacattagagccattgattgctcttaatctaacgaactaagggtgtgtttagttccacgccaaaattggaagtttgactaaaattgaaagtttgaagaaaaaaaatagaagtttatgtgagtaggaaagttttgatgtgatggaaaagttggaagtttgaagaaaaagttaggaactaaacccagcctaagataattgtctcttatcatcactttgaatcatcgtatagttaaggaccaatcagtacatattctagggtttgttaactatttcttcgttgttatgatcaccttatagtagcgcatgattttactggggtatttaaaatcatttcattcggagtttgaagaaaattaagaagcgagcttgggttaggactgagtgatttacttccatcctagttaccgatgatggtgaaggaagatggattatatcgatgaagtgattgtgtattgccaatgggctagactatgatgctagtctttgattaacaaaaaaagataatgggtgctagaaagctatgtgtagctttggtctttgggctgctggcagcagacgtgatggtgtgagccttgctttgcttttctacattgcatggctgatctatcctctaatagaacaagcatattgaaggggtcgtttgttttgatgttggtgcccaaaagctttgaatctgaccacgcaagggttcgtggccagcaacaaccgaaaggtgtgtttgctatcaggatcagcaatcatccccgagaaggctaaatggctgtcgaatgatttttaatagctaaatcattcatgttttaatatattcagaactgttgttttattgtagtaaaatgtttcatgaggtgatttgattatgattcatatttttaaaagattaaaatatttttgatttacttggtgaaacaacgcctaattggcttcaaaatctacatgatggaagcctaaaaaaatcatgtgaatcccatatagactctttctcgatgtactcggatttgttttacgtttcaatatattcggaaccgttgtttcatacgttgtagtaaaatatatcatagggtgatttgattttgtacagctttttaaaagattgaaacattttcgatctacttggtgaaacactgcatgatggaagtctaaaaaatcatgcaaatcccacatagacagtcccattacttaattacttaattaggttcgagtgatcaacaagtttggaggttttaacttgcaggcattttgccttaatttacttgcttgagcattatccggtacaagctaagggcttgtttagttggcaaaaattttgcccctgcatgtcacatccaaggccggtcctgacatttgagaggccctaggagaactcgacactatgggcccttaaggcattaaggctaaatattttttacttctaatacatatactctataaagcacatatactatatagtgacacaaataaacatttctaacatggtaaatagtaaatcaaatagtttgcaagttgcaatacaacaatttattatcgataaataatatcgatagtataattgacaactaaaaaacactatagaaacaaagtagtatgaatacattaataggagaccacaaacatcctatatcccttataaaaaagagcttcttcacgtatttcttgaagcgaaatcatttcttttgtgaaccgattaattgatctccccgttttcttttgtttcttttctgagcacctgacaaatgtttttttggtaacattgtaacacctgaaatagtaaatatatatattgtaaagtaaattatacagcaataaccatgaaaattatagcctaactaacctaatttttcgagtggaaaaatcatacaatgatgccaagcaagaaacttcggtttgttgtttgcctaattaacctaagtacctaactaaggtcagtttgccaagggcttatggccggcaacaccgcaacaggagactgccagactggagacggggagaggcgtgtgaggctcagagaggcttgggcgttcaggcgttggcgattagaggatagaggcggccctggcgtgccggtggccagccggccactcggccaggcgcccggcgacctggcgccatcgacgcggagagccggagaggagacacgtcgcggtcgcggagttagggagtcactcgtggaagcggaatcgtgattcgtgaggagaaaaacagaaaacgaagcgatctagcgattagcgaagtggcgtcgcggccttctgcatccctccctcctggcttgcgcgtgggctgatggctgggctgggctgctgggggaggggggttgggggttggtgatgggcccccagccagcctaggcccagggccgaccctcacatcggatatatgaacacatatttgaagtattagacgtagtctataactacattgtcaaatcatgccgcaattaggcttaaaagatttgtctcgcaatttcctggcaaactgtataattgtttttttttctacatttaatactctatgcatgtgtctaaacattctatgtgacaacgtgaaaaattttgtttggtaactaaacaggctctaaaacgagagagcactgttgtaatgttgtactactccgtccaaaaaaaaaaggcaaactctagctacgaatttggacacgcatgtccaggttcgtagctagaattggactttttttttttgacggaggggtacttcccagtatggcagagcccaagctttgccactgacagcatccatcagatggtttcctatcataaatggggttgtcaacacacatgcatgggtcaccattaaatgcaatatagttacatcataaatatatatatatatatagacacacactagaaaagatacccgtgcgttgcaacgggtgaatactattttaatcttattattgttatacggtttggctagggtaaaatttactgtgggaattcgcttagatattttttttctagaaaatcatgtgctgcaattaggagtttgacattcatctcaagttaacatgcaagtatttttaatgagatttcttatacgactccttttgtatttctaaaagtaaacgaacttaaaatccgactcaacatggatatgtatttccaaaagcaaacgaatttaaaaaccggctcaaacatgaatgacataccaaaataccagcaaaaacatcttcaatttttataatagtagagatagagataaaaacttaaggtgaacaaaatatggtaccaccaaatatcttactattactccagtatttcagaatcggatattggatatacgtcatatgatacctgagccagggggattttggttttgaatcacttgggcgtttccaggactctgttgagtctttgtctccaaagagagcatttttagagacaacttccgcaagtaatcagactggtaatgcaaaagaatacaatggtaagatttggctttgtaataaataacttgccaccctaaatcctggtggttagcacaattgaaacatatgcttcgtttttttatactatgatttaaattatacaaattcttatctatacagcaagctactttggcatgaataagcctgatgaagtatgaacaggagaacaattggaatatggagattatgaaaccctatacccagccaaggaagctcctacaaaaatgtttaccaaaatgaagtactaacacaaaaggaaggactggagtaaaccattgtttgatgtttcatctcggataaagggaatattttacaggtgatttatacaagcatgaacagatgaaatgatgggcttacagaactcaaggtacaactcctgtacttttaacatggccaatgagagaaaccagtctcatggtaaaaatattgtttagttctataattcattattactaatttactattgagatatgttattaatgaaaaatgatgtggggacatcaacacctctagcataggactgaatcagtcttagtccccgtattaaggcgcaaaggagattttctaccgataaaatggaaggaaaaagtttcagcagccttggataatctggtggaggtgtgaaatattaccatcggttcaaaaaaaaagtggatacttcatggtgaaactctaacaaacttcaaaatcaacagacatatttgcaaacatttgaagatcgatttcttctactaagatcccaaatgccatgcttgagccccacaactgaaagattggatcaaccggaggaagttagcaagaggctaagtgtacccggctggtggctccagtatagattttctcttcaaatcgcactgctaacttttgaagttcattcagcccctcaggccctgatactggtagatgcttcttcagagtctccagtctgtacatagattgcaacaagcaagtaaatgacaaatatatcccatgcagaaaaaaaaagagagagatatattgcttttgagatgttttgtgcaaaaaaaaaattgtcacctaaggcataatgtgtcggtctaccatttaagatgttggacaaatgagtgggaaaatatgtaatgcaaaccacatatatagtgg

SEQ ID NO: 35332 - DNA, 11943 bp, Oryza sativa
  unsure (1)..(11943): unsure at all n locations
catggtgacgtgggcgaatctcggacgtccatttctcgatccaacggtagttccaagtttccactacatatgtggtttgtactacatattttccccaaatgagtaggcatcgcccccgttacgcgctcaaatatcggaataattaattatttgtcactcttacgaggggtgataaatgatttgccactggatccacatgtcatatacacatgagggctcacatgttatacacagcgagtggcagataattaattgccacatcttaaaagtgaaaaaaaagttaaatgtccctcaaatatcatactactagtggctatgaccaaaagtggacatacatgatccaacataaagaagtaaaataaacgagagaggtaggtggtttctccatcaaacagtttgccttgccatcataatcccctcgaagggaagatccatttgaacataagggaaggggtgcatcttccagtcgaaggtaagcaaacctctatactgtatgtatgtgtttttctatgtaactgtgtccgatgaaatgtaaacagagttcaattggatatctagactaggtgaactagacaagaatgtcaaagctaataagaaaccggaggcatctgaacatagaagggaagggggatgagtagatacatcttgttgacgatcctggtgcgtccctcagactggagctgggagcgccagtcgccgccggcgggggcgggggcgggggcgctgagatcgatgcccccagcggcggcggggtcggccccctgggtgggcctccagttgccgccgccgccatccatcctcctcttcgtcttcctcttcttcttcttcgattgcaatttgcaagccagcgaagaagcagcaaccgtggagctgatctgtagccgatttggtgagatacccatcgccagagtcaaccatgacacagcgaaattacttagctgccctaccaaccactaggtaccccgcggcggaacgacgttagtaccaacaggcaacaggtaccgatcaatcatttccatccgattaaccttaatcaatggctgagatttgatacctcccctctcaagtactaagcaagttttaatagtatagcccactattaactccaaatcatcatagccaatgtactccctccgttttataatgtaaagcattctaccattgctcacatcatttaacatatatataaatgtgggcaatactagaataactctcgttatgaaacagaggaagtaatagccgatttatacaatagctacttgctataatattaatacctagtctcacctgtcatacacacattacgtcttggatttcatgctacgcctgattacaaatctgtagcccattgttcttctctctcttcctttatctctttaaaatatgtttatagctggcttatagcctgctattgtacctgctctaaggctgcgtttggcagctggagaaagcatgctgatctactaaatagggtgttttttgcaaaaaaaaaattctatatgtaatttgctttagaaaatcttattaatccatttttgaagtttgaaataattaatactcaattaatcttgtactaatggcttacctcgttttgcatatcttctcaatcgtctcttttcccctcatctcaaactcaccctaaaactcctcttcctacgctgagttttctccagctcttccgcgcacatgcttttcaaactgctaaacggtttataaaaattttttatatgaaagttgctttaaaaatcatattaatctattttttatatttattttagctaatacttaattagtcatacactaaacgctgctccgttttacgtgcgaagcagagggttcccaacctcactccctaacacagccctagtcacctagtcagtcccatcgatatgggtcagtggtgatgcgcctatgcatctgaactggcctagatatatttccgtataggaaagtgaatcgatctacggatctcaaaaaacagaaaaatgatactcataattactcattagtatatgtatacattgcttttcgatctatctccccatctcgcagactgtccatctgccaccaccatgaacatggcgccggcctccggttttttggagctcaaactagattattcggcgaccaacgcctacgccgtcggcgacatgctcacctccgacgtcttctcggccggtgggttcacctggagtgtagactattacccgcgtggttacgagaaggagggcaacaatggtgattacttatcgctcttcctaaaacggcggggatgggacgacggacgtctccttcgtcgtcgacggcgagaggttcgccgcccaccgtgccgtgctcgccgcccggtcgccggtcttcagggcggagctgttcggcgtcatgtccgaatccacctcgtcgtgcataacgctgaaagatatcgacgctgcaacgttcagagctctactccggttcatctacaccgacgacttgccggccgcagacgccggcaaactcaatcatcagggctcctcgatgggcgcgttcttccagcatctgctcgccatggctgacaggtacgcgctcgacaggcttaagctcatgtgtggccagaggctgttgcacagcatgacgtcggattcagtcgccggaatcttggcttgcgccgagacatacgattgcccggagctgaagaacaagtgcatcgacttctttgccgtcgaggagaatttcaggagagccgtgttcaccgatggttttgcgatgctggtgcagaaattcccgctcatagctgctgagctgaagaagaggattgtgaaaccgtagctgcatatatatcttttagtcctctatcgcgttcactgcacttgtgttatgttttttttttctaagttatgtctggctttgaacttgtttttttttatcatgtttaattatattgggggtgttatatgtactagctgaatgctcttgcttttcatcagaatttgtccaactacttcatcagctgatcttggggtttgttggaagcttcatgcatttctttggttccaaatataccaccaggcgcctggaatcgaccatattatcaattgggtatttttatcattcttaagatacttagagatgctatatattctagggagacgactccgtgtcggacgtccgatattccaccaaatatcggacgcccgactgtttacgcgtcatcacaccacctacgtatgcaatatgcaaaaaaaaaaaaagaatcagtcagtcaaatgttccaattaactaacgagtgaaatatcaagttatatagggttaaaaaaaatcagcaactgaaacatttaaaaagtttatgaaacatggtgaagatacacgttaaaacatatcgctatcacatatgaaacaaccaatgttaatggattgaaatatatgtttttctttcatcaaaatataattatgcgatatcctgttgtaaagatttaattacaaagaatacaacggtgtgatcggatcgtagattggataattaatttaagagaaaaatcgttttgaaactagctaaaatgcatgcatgtggagagagaggagagacgctgaagacacatattgaaacatgtatctatcacgtatgaaacaaaaagtgttaatggattgaaacatatgattattttttatcggaatataatcatgcgacattttgttgtaaagatttaattacaacgaatacaacggtgtgatcagattatagattagatgagtaatttaagagaaaaatcgttttaaatatcgttaaaggtgcatgttatatggttggaggtagagatataggcttggatatgtgtatgtgtgtcagaggctgcctgtccgatttttgtcattgcttcgaacgttcgatgagaagcattttctattttctagtgtaaaatttgatacctctagatactataataagtttcttaaggtaccaaaaattatagtgcaaaatttaggtatctcaagtattttctaaaggactgcaaaattcatcttatcatgttcatgtgccgggcatgtatccgaatccaataagactacgacacaacaaatcgatcgacacatccaaaaatcgatcgacacgacaaatcgattttcttattatggaaataccgaaataggagtttgtactatccaataagaaaatcgatcgacacatccaaaattagagaaagagatcacaatacatatatataactcatcacatcggcattatacggtatacacattggcgttcgttcgatatctatctatccttctcagtctttctgctgaaatcacacgtacgtctcatctcagcacacgatcgatcgagcatggcgccggcctccggtttcgtggagctcagactggattactcggcgacgaacgcctctgccatcggcgatcccatcaactccgacctcttcaccgccggagggctaacctggagggtgaactgctacccgcgcggcgacaaggcagacaacaatggcgactacatctcgctctacctcgagctgatcagcaagtccaagaacatcaaggccatcttcgacgccttcatggtggatgaacacggcaacccgtccgatggatcgaacaggttagtgcaggtctacccacccgcgggctatcccgcgtggggatggccacgattcgtgaagcgaagcaatttgtcatcggtgttcgtggtggatggcaaggtcaggatcatgtgcgtcgtcgtcgtcctgcgtgacgacgacggagacggcgacggcaaccgtgtgccgctgccgtcgccgggggtcaccggcggccatctcgacggcggcttattgccgctgccgccgccgaacatcggggtccatctcggcggcctgctggacagcgaggatggtgcggatgtcaccttcgtcgtcgtcggcggcggcggcgagaggttcgccgctcaccgtgccgtgctcgccgcccggtcgccggtgttcaggacggagctctttggctgcaagtccgaatccacctcgccgtcgtcgtcgtgcattacgctgcagggaatcgagccggcgatattcagagctctgctccgattcatctacacggacgagttgcctgcagacgccggcaaactccatcagggctcctcgtcgacgaacgtgttcttcaagcacctgctcgccatggccgacaggtacgcgctggacaggctaaagatcatgtgcggacagaggttgctggacaacatgacgccggattcggtcgccgcgatcttggtttgcgccgagatgtacaactgcccggagctgaagaacaagtgcatcgatttctttgccgtcgaggagaatttcaggaaggccgtgttcaccgatggttttgcactgctcatgcagaaattcccggtcattgttgctgagctgaagaagagggttgagaaattgtagctgaaatatttatatatcttgtactagctctctagctaccacgttgactgctcttctgttatgttttttttttctaagttttgcgatctcttgatttgaactcgggtgattttcacatacacctgatgcagacggatcaaagacctgcatgtgaaaatattttttagcggtatgaaaaaaaatccttttttatagtgtatcaaagatgctcatataccaaattttatataaaaaatatgatatctcccggtaattcccaagtagtacaaaatcactcatacattagcttataaaattattagcaactaatagttgtgtgtatcgggaaactgttttaatcacctaggtggatgtccacccgtttattgcatgtcatctaaatggttatgaaaaaaaattaaaataattaataagatagatcaatatgtaatataccacttcataaacatgcaagttaaaattcaacttctataaattgtaacaattaattttgttatttttgttataactagcaaatatgcccgtgtgttgcaccgggtgaatatcaaacaaacatggatgcttaagattgctttgtacttataacacatgtgcacaaaaatattgaatttggaagcgtacatatcagaaaaatatgcaattaattaaatacaaatttattgacatatttggtatttttaagtaggtatgtgtataattaaataaatttacaagtaaagcaaatgtgagaaataaaataacatggttaaatttaattttattaaattctccatgattagttacgctctttagaattttattggaatttttagagcttaattgttaattttaataatacaaacatcatttaacaattatttaattggaaaaagaaagaaaatccttcattttaggtttgattcgaaataaacacattcaataactataattgtaaatgcttctgaatctttttcttcggcccgagggacctaaaatagacttcttttcgtcccttgccggtcggcctatggccttttgcgcatgcgcgggcgctctacccctccccaggccgcaacctaggcttgggccggaaaagtggcctcgctctcgatccctcttgggcccatttcggcccggttgacggcggccgtccgatctctagggttttgatcggacggccgagcgtcgagatcggggaaacaaaaaccccctccctctccttagccatcaaaaaccctagcccatttccttctctcccttctctcgcttcgccgccctcccctccgcgcccctgatgctcccgtgacaaagcggcggcggcggcggcgcctctctccccgagcgactgcggcggcgacgccgcctctccccccgagcccaagcggcggcagcggcgccctccccccgaacggcagcgggggcagcgccctcccccgagcccaagatgcggcggcggcgcccccccccccccccccgagcagtggcggtgccgccctccccctgtgagcggcgacggcggctcccccacaaccggcagcggcgggggctgcggcgcccagggaggcatcgacagcccgccagcgtcccagcggcggcggtggcggctcgacggcgacctcccctttgatccttttttgatatatttgtgtgtgtatattgcttccgccgattttattttatttgtgtgattgattgaattctgattgggaagtttttttgggtcggggtgatggaattccgactaagatttaggagaggcgagggggacaaaaaaatcaccgcacatatgaggtgacgaacgaaaaaataagaatatttatattagttatatatttgtagaagttgaatttgaacatgcatgtttgtagaattgtatattacatattaatttattttatcaaatattttttaaaaaatttataaccatttagttaacatgtttttactctatagtgattagaatccggtgtgtatccgcagtttcgtttcatttgttttttgactatcaatcgcactgacacgcaccaggcgtccaggcgtcgtcgtcttcacattctcgacgctttggaagaggcgttgtatggagacatcatggatcttctcctctccgcggttggaactccaaagcgttactaattactccctccgtaaaaaaaaaagaaagacaaaccttgattttcgtgtccaacgtttgaccgtctgtcttatttaaaaaagatataaaataaattaaaaagacaagtcacgcacaaagcattaatcatgctttatcatctaacaacaataaaaatatgaattattaaaaaaaattatataagacggacagtcaaagttggacatggaaacccagggtttatctttttttgggacggagggagtagaccctgtttagatgggactaaaacttttaatttcctatcacatcggatgtttggaaattaattataaatattaaacgtagactattaataaaactcatccataatcttggactaattcacgagacgaatctattgagcctaattaattcatgattagcctatgtgatgctacaataaacattatctaattatgaattaattaggcttaaaaaaattgtctcgtgaattagctttcatttatgtaattagttttataagtagtctatatttaatattataaattagtgtctaaatacagggactaaagttaagtccctggatccaaacaccacctaatactttgcatcgacctaatactttgcatcgatgcgtatgcatgcattgctgtactataaattctctctttagcagtctttatgtcataatttggctcatagttgattttatttgagcaggccaaattatctaaaataacttgtactatatgtgttaagtggtttgctggaaagacattatctaattatgaattaattaggcttaaaaaaattgtctcgtgaattagctttcatttatgtaattagttttataagtagtctatatttaatattataaattagtgtctaaatacagggactaaagttaagtccctggatccaaacaccacctagtactttgcatcgatgcgtatgcatgcattgctgtactataaattctctctttagcagtctttatgtcataatttggctcatagttgattttatttgagcaggccaaattatctaaaataacttgtactatatgtgttaagtggtttgctggaaagacaaatttatgtgtgtcaggattagttgtgatgcactgggattatatacgtaattgatggaaggccataatggctgacttagcttggagacatatgcttggatcattgaatttcacagcagacaactcggctcctgtactgatcgattgcatgccgaagctgtggatgtgcgtggttgccaggagtggaagatagatatttttggtagtttatttgttaggattttctggtaccttgtttccgtagatttctcgtctgcgccgtagcagtgcatatacccttataatcttatacatatcaggggttttagattcgaggacgaccccgaacattaccgatctgctatttttctcgttcctttacttttccgttattttctattttacttttatgcctgagttatagcaatcctaggatttggttgatctttaccgttttgcgctgaaaaacggttgtgcttctctataaaaatgaggaggttatcctttgctagtttactcggaaactagtcgttcgtcgtcacgtaagtacgatattatcttctttactaatttgctcgtaaattagctgtgtgattccatgaaattgaattaatctcgaaatcggttccgctagccgattttgatctatcgattttggcaactctgttaattataccgtaaatcgttaggtgatcttgtgttggccgtgaaaaagtgtcaaccagcagatcaaataataatactactactactcaggcggtcaggtcccatagacgccagtagcaacatggtgtcctccggtttcatcgagtacaagtttgactaccaacaaatccacaagctagccattggcgagagattgccagcaacaacaatctcgacaggggagcacaatgcgaagatcatgtgctacccgcatgggtttgggtacggcaatggtgaatacatctctctcttcttcgtgatgctgaaacagattgaccccaaaatcaaggtgatctttgaggccttcctgattggaaaagatggtacaccatcctcgttccatgcgaagaggactatgcagtgttgggcgtcccaggatggctacgactggtttgggtggcatcgctttgtgatgcgaagcgatctcgaatcactcgacggtatggtcacattcatatgtgggctcgtagttctgcgcaacgacgacgacggcgacgaccatgtcgccgtgccgccgtccaacctgggcagccagctcgccgccatggtgggcagcgccgtcggcggcgagacgttccacgcgcaccgggccgtgctcgccgcgcgctcgccggtgttcagggcggagctcctcgggtccatggcggaggccaccatgccgtgcgtcacgctgcgtgacatcgagccggcgacgttcagagctctgctacacttcgtgtacacggacgttctgcagatcgaaggctcttcgtcgacgagtacaactgatctgcttcagcgtttgctcgcggcggcggacaggttcgcgctggagaggctgaagctgatgtgcgcccagaagctgtgggagagcgtgtcagtggagacggtgatagcgactctgtgctgcgccgagatgcacagctgcccggagctgaagaacaggtgcatagatctcgtggtgacgaaagacaacttcatggaggtagcggtaaccaaggactactttcatcttgggcagagttttccgtcagttatcgaagagataaagccacggcttaagaagtgaacgttgaaacattatactccctccattccaaattgatctatatataacgtttagcccttttattacgtcgatagatatcataattattatttgaatattgcttattagtcttataagttgcaaaactgcatattaatccgtcgcacctcgtgcatttcttttaataattccgcgtttgtactgtctattcacgtctgagaattggttgtgttggtatttggttggtcatatgggcgtgacgacggcgggcaggtagaagacctccttccccacgccactccttcgatctcgaagtggttagcaccaatctgcaaccggtgggcttgcttgttgcacatgattggtggatgcatcgctctttcttttttttccgtttagatgttatggctgttttgggcaaatgaatgagccgaaatgcaatttgagatgctattttttgagatttgttcttgtctgttttttggggaaaattttcaatctgggtatgacaccgagttggccacggcttatggagacagaaacgcatacgcggtctcaccgatacggatgaaaatagcttcgatttttttttgccctttattttatcaccaatcgaccagagtccggagatgatctgtttacaaatcctaattaaaaatttatctgaatcccctgtcgtttattcctcaccagaccgaacaactcatcgctactttcggtagtataaattgtcctctctctcgtatgatcaaattaattctccttttgggatatccgcacgcaacaaaacatacgccgccggcgaccatgctgtcctccggtttcatcgagtacaaatttgactacctagaagcctcttggatgactgtcatcggcgaatgggtaccagaaagaagaatctcggccggggagcacaatgcgacgattgtgttccacttctactcgcatgcagggtgcaagtacatctctgtcttcctgctgctggatgagaatgagatcgaccccaaaatcagcattatctttgaggttttcttgatggacaaagacgggaaaccttcctcgcaccatgcaaagaggaccatggggccaaacatggagacagcatcgggtctccggttcactgggtggcgtcacttcgtcaagcagagtgatctacagccggatcatgtcagcgacaaaggcacggtcacattcgtgtgtgggttcatggttgtgcgcaacgacgtccacggcaatcctatccccgtgccgccccccaatctgggtgcccaactcggagctatggggggcagcgccgacggctcggacgcgtcgttcgccgttggcggcgagacgttccacgcgcaccgggccgtgctcgccgcgcgctcgccggtgttcagggcgcagctcctcggctccatggccgaggccaccatgccgtgcgtcacgctgcacgacatcgagccggcgacgttcaaagctctgctacacttcgtgtacacggacgttttgccaccattgttaggtacatccgacctgcttgagccgcttctcgcagcggcaaacaggtatgcactggataggctnnnnnnnnnnnnnnnnnnnnnnnnnnnnnnnnnnnnnnnnnnnnnnnnnnnnnnnnnnnnnnnnnnnnnnnnnn

SEQ ID NO: 35333 - DNA, 869 bp, Oryza sativa
atgtgttaagtggtttgctggaaagacaaatttatgtgtgtcaggattagttgtgatgcactgggattatatacgtaattgatggaaggccataatggctgacttagcttggagacatatgcttggatcattgaatttcacagcagacaactcggctcctgtactgatcgattgcatgccgaagctgtggatgtgcgtggttgccaggagtggaagatagatatttttggtagtttatttgttaggattttctggtaccttgtttccgtagatttctcgtctgcgccgtagcagtgcatatacccttataatcttatacatatcaggggttttagattcgaggacgaccccgaacattaccgatctgctatttttctcgttcctttacttttccgttattttctattttacttttatgcctgagttatagcaatcctaggatttggttgatctttaccgttttgcgctgaaaaacggttgtgcttctctataaaaatgaggaggttatcctttgctagtttactcggaaactagtcgttcgtcgtcacgtaagtacgatattatcttctttactaatttgctcgtaaattagctgtgtgattccatgaaattgaattaatctcgaaatcggttccgctagccgattttgatctatcgattttggcaactctgttaattataccgtaaatcgttaggtgatcttgtgttggccgtgaaaaagtgtcaaccagcagatcaaataataatactactactactcaggcggtcaggtcccatagacgccagtagcaacatggtgtcctccggtttcatcgagtacaagtttgactaccaacaaatccacaagctagccattggcgagagattgc

SEQ ID NO: 35334 - DNA, 686 bp, Oryza sativa
  unsure (1)..(686): unsure at all n locations
nnnnnnnnnnnnnnnnnnnnnnnnnnnnnnnnnnnnnnnnnnnnnnnnnnnnnnnnnnncaacgttcacttcttaagccgtggctttatctcttcgataactgacggaaaactctgcccaagatgaaagtagtccttggttaccgctacctccatgaagttgtctttcgtcaccacgagatctatgcacctgttcttcagctccgggcagctgtgcatctcggcgcagcacagagtcgctatcaccgtctccactgacacgctctcccacagcttctgggcgcacatcagcttcagcctctccagcgcgaacctgtccgccgtcgcgagcaaacgctgaagcagatcagttgtactcgtcgacgaagagccttcgatctgcagaacgtccgtgtacacgaagtgtagcagagctctgaacgtcgacggctcgatgtcacgcagcgtgacgcacggcatggtggcctacggcatggacccgaggagcttcgccctgaacaccggcgagcgcgcggcgagcacgggccggtgcgcgtggaacgtctcggcggcgacggcgcttgccaccatggcggcgagctggcttgccaggttggacgggggcacggcgacatggtcgtcgccgtcgtcgtcggtgcgcagaactacgagcccacatatgaatgtgaacataccggcgagtgattc

SEQ ID NO: 35335 - DNA, 1189 bp, Oryza sativa
  unsure (1)..(1189): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattagtcaaagtagtatctcgaagaccctatcgaagtcaaaaaaatgcttatattttgggacagaagaagtaatacggatacaagtaactggagtagtactattcatagacattgtaacaagcttaaactcaatagataccacatcaattttcactccattgcattgttttagctcccaacaaacctttaatttcatcaataacggatggaaaatgctgaaccaactgagcataaccctcattcagcacggccaccttgaagttctcctcctgcacaaagaagtcgaggcaactcgtcttcagctccgggcagccgtgcatctcggcgtagatcagcattgtcgcgacattttccaccgatactttctcccacagcttctgcgcacacatcagcttcaacctgcttagatcatacctatccgcgaccgcgaccaaattctggagcaaatcggttgccatggagtccttctcctcgagttcgtcggtgtagatgaaccgaagcatggctctgaacgtcaccggctcgacgtcgtgtatggttatgcgtgacatcttggcttccgccatgggtccgagaagctctgcgcggaacaccggtgagcgagcggcgagcacggcacggtgcgcagggaacgtctctccgccgacgacgaaggagacgccatggagtcgggcgttgggtgggcactgctggatctggatgatagcgtgagctagtggcggaactaaggggggtggcaggggccatggcgcctcccaataaatttttttttaattacccctatatatggtacccaggtccaacaggccaccgtatggcccaattcaatccggctggcccatagcagcgatttcaatacagtgaagactcgtgccgtgaagtttaaatgaacatgtaagtatattgtccacttttgcaaactattcgcttttatgtattgccaatgcatgaaaaaaaaaggagaaattgccaatcttttgaactgtcaaaagccggctggcccccctttgattttacgattttgctagatatttgtcatcaaatttctccccctaatatttgtcagatgtaattacagta

SEQ ID NO: 35336 - DNA, 726 bp, Oryza sativa
  unsure (1)..(726): unsure at all n locations
nnnnnnnnnnnnnnnnnnnnnnnnnnnnnnnnnnnnnnnnnnnnnnnnnnnnnnnnnnnnnnttttcacgttgtcacatagaatgtttagacacatgcatagagtattaaatgtagaaaaaaaaacaattatacagtttgccaggaaattgcgagacaaatcttttaagcctaattgcggcatgatttgacaatgtagttatagactacgtctaatacttcaaatatgtgttcatatatccgatgtgagggtcggccctgggcctaggctggctgggggcccatcaccaacccccaacccccctcccccagcagcccagcccagccatcagcccacgcgcaagccaggagggagggatgcagaaggccgcgacgccacttcgctaatcgctagatcgcttcgttttctgtttttctcctcacgaatcacgattccgcttccacgagtgactccctaactccgcgaccgcgacgtgtctcctctccggctctccgcgtcgatggcgccaggtcgccgggcgcctggccgagtggccggctggccaccggcacgccagggccgcctctatcctctaatcgccaacgcctgaacgcccaagcctctctgagcctcacacgcctcttcccgtcttcagtttggcagtcttctgttgcggtgttggcggccataagcccttggcaaactgagggtaggtaagtacttaggttaaataggcaaacaacaaac

SEQ ID NO: 35337 - DNA, 752 bp, Oryza sativa
  unsure (1)..(752): unsure at all n locations
nnnnnnnnnnnnnnnnnnnnnnnnnnnnnnnnnnnnnnnnnnnnnnnnnnnnnnnnnnnnnnnnntttaaccctatataacttgatatttcactcgttagttaattggaacatttgactgactgattctttttttttttttgcatattgcatacgtaggtggtgtgatgacgcgtaaacagtcgggcgtccgatatttggtggaatatcggacgtccgacacggagtcgtctccctagaatatatagcatctctaagtatcttaagaatgataaaaatacccaattgataatatggtcgattccaggcgcctggtggtatatttggaaccaaagaaatgcatgaagcttccaacaaaccccaagatcagctgatgaagtagttggacaaattctgatgaaaagcaagagcattcagctagtacatataacacccccaatataattaaacatgataaaaaaaaacaagttcaaagccagacataacttagaaaaaaaaaacataacacaagtgcagtgaacgcgatagaggactaaaagatatatatgcagctacggtttcacaatcctctttttcagctcagcagctatgagcgggaatttctgcaccagcatcgcaaaaccatcggtgaacacggctcttctgaaattctcctcgacggcaaagaagtcgatgcacttgttcttcagctccgggcaatcgtatgttttcggcgcaagccaagaatttccgcgactgaatccgacgtcatgc

SEQ ID NO: 35338 - DNA, 669 bp, Oryza sativa
tcgcagctatgtgcattcactcgatagtttgatccagcatttcaatatctcaccagtgcttctaagctactctcatgaatgagtatgctagacgactaggcgcgtgagcatttagaaggttatggtgcacaccgtacctcttgcagagcaagaagtatcagcaagaatgggtattttcaactatgattgactaagaaaatgaccaagagagtacggtattcggtgcgccgaacttgcaccaggtaccatggacactctcaatgattctacccgagcgtcacaaaagtcgtactcaagcatcactagtgcacatttataggtgacttatgatggttgtatggtggttaaacactcacaatacacattgggagcgaaccaggaatccacgcgtggatggccaacttccatggcgaggatgttggcagcggcgctggatccgacaacaggctcggtgcccctccccgcctcacgcagatcagaggagaccgatgtcgccgttggtgaacctgaagacccagccggtggtgattcacgcgtgttcggcgtcgcctccctcagcccagcatcatgtactcattcacccaggaccgtgcctcccctcctagtcccgtgcctcgcccagcccgctgcacacggggatcaccgaacaggcgagtcgtcaaacggggg

SEQ ID NO: 35339 - DNA, 3609 bp, Oryza sativa
  unsure (1)..(3609): unsure at all n locations
catccgattcaactcgggggaatttgggccatccatgtggcctcccggtgccacctcactatgcccgcccaaagtaatagctcaagtaggctcaaatatgtgctaaatgaatagcaaatgctcaaatcagataatgtaaagttgaaaaatcattcaaagtcagtaccatgttggtcctaggctagaaaatactatacgcgcaagcctagatacaaacggtaccacaagatagcacttgtaggagatgacaataacaagcacacgatagcggcgatgacagtgttagtgaccctatcaaatgtaaaattgacagcgatccacttgtaggagattattaggtagttgtgagggcaataaggttaaaaaagagacgacggagacattctcaaagaatataagcatttctaacaatgaatctggacatatctatatcaagattcatagctagaagttgttatattttggaacgaaggtagtaaacacaaccattacttcatttgaaacgaaaataatctatatagcacatacaagggaaacattacggattaacaattgtcaaccttcctaatataggagaacagctgtattttgttaatcatatgtgtcggacatatatcgcatcagttagtatggctgttgtcggcatttagctttcttttgaacccttgacactaatgaactagagatccaagacttgttcatctgagcaatttcaccagagcgccaacaacacagacgaccatcttcgccacctgtccatccaaaaatgcccctgttttgcccagtatgagtgtttgcggctggatatacggttctaacaacgtctgtatggcctccttcaaggatagcttccgcggaactattgccccttcaagaccagctcttacagggaagtaacctattgtccctgcagttgtgccgccaatcacccataacttgtcgtcgggcagagagtagtgacaatcaacaaaatagtccacctacaaaatatagtaaacagaattagacgttgagaataaattgtctaggtaatttgcctccctggactgctatattgcattgccaaccacgctaattaaacaatgaagcatcatgggcagccacatcgtgtagtttcacattgtggcagcaatccctctgtttcgccacatcaaccaatctagagagcaggaaaagctgagttgacgtttagactaagtaggtggacagcaatggaggcgtagtgagcatagttgaaaaaaccggaccggtggatgacccggtgaacacctcggttcaccggtccagcggtcgaaccgacgggttggacggttgaaccgcggtttaataaggtcatctagtttatatgttttgaacttttgatacttgcacataagggcacgtggtgggatggtcagcgcagccggcttacaacctggtgaccaaaggtcgaatctcctccgtgagcgatttggcattttttcaaaaaaaacaaaaaatcgtcttggtaggctgaagaactaaatgggccttcgtgtggcccatttacactctcgcatgtcttagcccggttcaaccgatagcagtttattgtccgtttcacctcaaaaccagccggttcaagcggtccaaaccggttcgattacatggccggtctttctattgaaccgaaccgagctaacctctggtttcggttatttccggttcaaacgctaggccggtccggtttttcactatggtagtgaggtcccgtaaacgggaatgtaacacttgcaacaacagtgacaaggcatctagaggagatagtcagttcagtaagctgtgaaaaataaagatcaagcaaattttgggttcatatgagaaaatgacaagagggtgcaacataaaatgatgcatgaggatattggattggctccatgattggagagaataggtttctgtagccagcaagaatggtgactggaatggagagttccctatagtgtctccacagtggaactgtgcaaggagtaaagaaagacggtcacgcactctatataccctaaacaagtgcattggagattatgtcaatgtcctaagcaacaagtaaaaaagaatagagggagtatatctaaaatttggctagttctggagttagttgatgaagacgattacagatataaggtgctacaatatcattcatttcgtgaagttctgtaatctttttgtaccatgagccaaatgaagaaagcaatgaactaatgaggtgtgattgtttgaatatcataactctctaatattaatataaaaaaaactgtcaattaccaaataccacactacatgccaacaaatgctgagtagctagaatgtataaaggcaaatattagaaactcacatggtcaaggttccacctatcagttgccaaggaacgagcatcatctatattcagttctctactcccatcattccagtcccaggtactgtgagaattcaacagcaaaaatcacaattagacttttgtccttatttatttattagaagcttggaatataagtcagatgacatggcattgtcaaaccagagaaagcaaaccgaataaactaccttaatgtttcaatgtggctcaagcaccaaatcttctggtatgtgttgccaaaaaatcccacttttgcaacacaagtctccacattcataacctatggaagatcatatatcagagaactatcacccaaaattgacatcttcatacaaataacctcatgcanaaccattaaaattaaaaaaaaaatacttcaaaagggaaatattgtaataccacaattaaatactactaacaaccaaaaaaagaatatgcaaaactacaactgcatccataacatacaataattgtaagctctattgtataagaattaacaaacaactatggagattaacagtagcattgttataagaatctgtgaggaataaaattgtaagctctatcatgtacttcacgaacaaataacagcatattacacacatgcccagttattgaagttacaaaaagggaaaaaaacatcatgcgcatttatcatcgtcatatgaaacaacaaaggaacataacttgaagtactaatgggatacttcagtaaacaacaaacatcaaagtatcaaaccataacctgacatagcaagatatgtaagacaaggcatttgggcacaggaaaccaactaaacatacagatagcaaatgattgtcctcgttcatgtcaccatcagtgtcaaaaacacatattaatccatcaactgctgcagaaatgagtttgctatgctgatgtggtgcaaattttacctgtccaaaaaaggtgacaacataaaaatttataatcacccagaatacagaaatagtatgagaggaacagtagcaaatacaagatattttcacaataaaatgcattcaagtgattcagtaagcacattatcaaaatgtttagagtagtgatgaaagtagttgtctcctgtgatataaaaatagttgtctccatgaagagtagaaaacatacaaaaccatccaagcatcactttgtaaaatataatggtgcatatttgatatctagtccatcaatctaaatgctgataatgcatggtacggagacagcagatcattagatc

SEQ ID NO: 35340 - DNA, 594 bp, Oryza sativa
gcagccctccggcggtgattcgcggcaatgaagcggcggccgaggtgcgggcgggctcggtgagcgcgacggcggcgactgcgcggcgcggcggtggctatagtggcggcggcgcgtgggcggagacggcggtaggcgggggcgcaaggggcgagcggcgcggcgacgataggaagcacgggagggcgcggcgagggcgagaaacgagagaggaagacgcggggagcgatttataggtgcgggagggggcggacgtggccggggaggtggccgatttggccggcgacgtggggaggagagagagtgagagaggtggattcgaaatcgaatcccgccctctcgagcgcgcgcgcggccgggagatgcgggggaagaggcggcgacgtggggaggacgcgggagcggcgcggcgtgggcacgggaagagcggaggaggcagcggcgacatgggcggttggagcttcggctctagcggccggaggtgggagacgaccgacaggtggggcccacctgtcggcgtcccgagagagaggagggaggggcggctttggcccgcccaccaggaggggggaccgcgggagagggatgggccga

SEQ ID NO: 35341 - DNA, 1692 bp, Oryza sativa
  unsure (1)..(1692): unsure at all n locations
gcattgtgtttagagacacatcggtttagttaggactgtctcggtaaggtatgatcttctgtcttagccgatataaagacacaactagctcggatataaccatgactaccttatgtattaatcaactaaaggtgcatatgttttatattagatttacttgttatatatttgaacaaacgttgctacacaatgagtttcatgtgtttttgtttgcagaggtactcgcttgggcgaaggaaaagagactgagcgtaacgaattcatggatgatcaaagaagttgattgggaccaaaccaagaccttcttcaagtccacttccatcttaacatgtcacttttggtccatagaagacaagagataaagttctacatgttttgaattcggattcgggcctcctgacagcatcaacttcaaacggatctagccgctaatctagaaggaatttcggggcccatgagtacttgttggaaagcttatggagtctactttcatatggatttggtcccacgtcaaaattcctaccgagctgtcgagaatttgcaaaacaagccacgtatctcatccagtccgaatctgatttgggttttgggccttgtaattatgtcgtgggcttagcccaagcgggtgtgcgccctaggccaaccctaggacgtccctaatcacatttattcagtagccgtcatcgtttagagtcaggttttgcttagattattcagtcaagaacagttttgccgctagatcggtttgtggaaccccaaattcgagcgcttaatcattcatatgcaattgtgttgcaatctatcttggtattgattgtgttcttcgattcgcatgcaaggattagccttctcggcgaggtcaaccgggttttcgcatggttgataactangaggagacgtgtgctgtgattgcagggctcagtagcgtgtttgttcagaagctggatcgagttgtgtcgcactcccgcccaaatcattgttantcagancctttcgaaagatcnggacntgacatcccctcatcaatagatttgttatatccatcacattagcaagatctatcagcttatcgaggattagattatcatatccattctcgtgctgcatcggttagtttcgacctactagattgttgttgataatataaaccttgttaagctgacagattcatgctaatgttttatcggggtgctagccgataaattatctggacgttgcatcggcttacaaggattacatacaagttggcttatccaattgcagcaaaactttcactgtttatctaatcgtttggattttacgacatcggaccttcagccgatgtatgctttaaccttcggatctttacatgttctatcatatcattgttagccgattggtttctactggactatattattgttatattatattatcaacagtcgattgcctttatatgttatttatatcaagcgttagaatctacatcagaattatagccgatagctcaaaaccctatcccaatcggctagtatcggcatcggccggaattaatctatcggcttgttagctgatcggctatttgatccgttgtttacatatcttgtcagttgcagggtcaaactgactggcatgcccgcatctcatcaacctttggacctgtactaaagctaagcagatctctcaggccagtgtgtgtttttcgcatcaaca

SEQ ID NO: 35342 - DNA, 628 bp, Oryza sativa
ctcctcgtgtgtttctccccgtagacttgtgagtatgttatttctgagttcttggcccatcttcctctaagtctgattcacgacagcggcggattgattgatcgtctattttgctatcgattctcctccatttattctcattctatacaaaaggttagaaaacctagtgctagtggaatatttcttattctaacatgaatatgcattgtaagcataactagttctcctttattttagtaatattgacgggtgaaactgatcgctaactgtcacgcccagaaatttagcccaaatttccagactattttatgtattaaatccctatctaggaccagccagggtacacaaaacgacaattaatatatagatccaaacgtaaataaagcgtaaaatacttatagaagaggcacttagtcctcacatcgaaacaaaagcagcagcaatggaaaaaggcgatcctagcagggcttcagctccactccataggcaaaactcaactggggtctgagccttggtcctctaacttcgtcttcagctcagaagcactatagttctgaaaaatggggaaatagcaagctgagtacaaccatcgtactcagcaagccacaccaatgatgcagacgtgcaa

SEQ ID NO: 35343 - DNA, 1477 bp, Oryza sativa
atgggtgcgactagcaaaaccatgcacccacagccaccattcagtcgcattttagttggataattacgaccatgaagcatggccagatgtctcgagcacgcagctcattctgatactaaaaggtctaaaactgtaattaccccatcaactgagctagtggtaattaagcatggctaagcatatagttctagctatgtcatcaaagtaacacaagctaggcgatttattacccaaggttgacaaagaacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttttcctcgcgaccgcggacttccgaaacgacggattctacatgctggcacacaaaacgaggaacaactctaataaaaaccaaggaaacagtacataaaaactaaacaaacatgtagagctcaattttagatgaattttgcaagttgaccggttcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagtggcacaagggagccggtccaccgtggacgggaccaccgagccggtccaccgccggtccacgggaaccgacggcctggattggcctaagccgatcggacggccacggggcgcgcggctggggcacggtcacggctcaaagccggccagccgagtgatggcgcacggcagcgcggccaccggtgatgacggccgacgacgacgcggggagcggcagcgcatcggacggtgccggcgcacgctagggagcgccggcgcggcgcggtaaggtgaggcggcagccgactgcccggcacagccggcagcggcgcggagcgcggcggcggcgacccggtcggacggccaccggcgacggcggcgcgttgtgagcaggcacaggaggtggccgacgaagggcaggaaggggagagggaggggagtgctcaccgaccggcacgacggcaaacgggcggccgacggcaaggaacggtggcagcggggctcctcggaaagacggcggcgacggagctccggcgacgggcgtcgctcaggaaggggcggacgggctcggcctcggtctgaggaaaatcaaggaggggctaggaggtcagaactggtgcgaggtaaatggaaacgactgccgaccaccacaatacgaggaggagctcaccggcgacgagggaggtggagctcgggcggatttccggcgaagagggccagtggccaaggatctccccgtccctgcgga

SEQ ID NO: 35344 - DNA, 785 bp, Oryza sativa
ctgcagccctgatgcaaaatgatgtaacctttcctaagaaaccttcccaaccatgcaaaaatgtcatatgaagggggtagtatgctagtagtggtctactactactagaactctagattctagaagggggagagggactgagggactgaggaagtgaggaattgctcactggagaggcggactggtggagagccgaagaaggagtggccggtagagcactagcgctgggctcttgggcggctgccggctgggcgcgtgctgccaccgacgcacgtcgggcaggaccgcgggagccaggaggccgccggctggtcgcgccgacgcgggacagagagagtgtggccaggcggggcgcgccggcgaggggcggagagggcgcggccgcacgggctccgacgcggcacgaaaaggcagtaggaggagcggcgctgtgagtcgcggcctcgcgggagcgccggccaccggattcacgggctcgcgggagcgccgtggcctgtcgggagtgggaggccaggagagtaagtggagaggggagataagagagttagagttttcttttgttgggccaggctttcttatgggccaagaaaaataaatacctgttcttatctgggccaaattatagggtagtcctgggcctacctagactactctttggtcccgccacttgaaagccggtggtggcggtggcgtagcacggcaacgacaggagccgcggtggctcgtggttggaggacgccggtgggcggcggagctcaagccggcgtgggaagaacgggagagcg

SEQ ID NO: 35345 - DNA, 1731 bp, Oryza sativa
  unsure (1)..(1731): unsure at all n locations
ttaattgattaaatgaactntgtgatgttaaattagatgttgagctccaaaaattcacagaaaaatcaagagagtatattagggcatagagaatattataaaatatttctggccaatgatttttaaaggaaacttttaatttcctcaataattcacttgattaaattgctttaacttttatttaattgtagaaaatgatttattaattgatttttaatcccgaacgaaaatcggagcgttacattagccaccgccgctgccaccacgggcgctgccgcggctgtctcaggccacatccgtagctgtctcagccgccgccgctgtcacccatcaccagccgcgtggtcggccaccattgtctccgcgacggcggcagggtgcagggagttaggaggtgcaatggaggtggaggaggcagaaagccatggatgaacggtgcggcgagctggtgaccctaacgtggagagcggcgcaagtggcagcactgatgatgtaagagcatttcgaagaaagggctaaacaggttcctaaaaattaatttttgggattttggttaaaactaggtctgttaatcacggttctaaattttatcccctcctataaaatcgataccaatctcatcagaatttgggaaatttgggaagcagaacgccgtcctaatcgcaggaatcacgccaattgttttactgtcggcgccaaaagttttttttccgtccgcttccttttcctcgtcgcgccgttttttttcgagaaattttttttccgcccgcttcctttcccttctcgcgcctttctcctctggcngtttctttttcgcgagaacacaagcgccaacgccgccacncngcaaggatagggtttgggggctcctagcgcangctctgtncgagcgcccgtccgtcaagggctctgccggccgtccgtccagggctccgccgnccgcctatccgggggaccgccggcctgccagccgtccgtccaggggcagcgccgccggccgcccgtccagggcaccaccacttcgccatcgaccgtccatccaggtcaccccgacgacgacgtgtgctgctactgctgattcactttgaggtattttcagagaaactcatttctacctgtgctcgtatggtttatacgcactgtacaagtgcttgtgcctgtcaccaatcgttgctgctcgctgccgttgcctggttgcttatgccgccggcgctgacagaggaacagctctgcgtgcgtctgcagcactgtgtccttcgcaaggttgtctggatcgggatattaggtagtaatgttttgctccaagtattatcgtatcgtaatattggaatactatgagattttctttttttaagtttaattaatattcatattaattacatatatattatgcaaatatagacatttatcatgagaaaccacgttggtttgatatatttaactgatttctatatatacttgagcatattcatttacattatttccaaaccatcttattttaaataatattttgtagtaacgtagggatcgtagaatcgggataccacttaagatttcgtaggatcgtgtagtaatgaatagtaggatcgagatactatgaaaattaggatactaggtgggatcggtatcgtttcggcttggtaggatcgtagtatcataagatactagaatacgaatcaggatactgacaaccggacttcgttcgatatcatatcgctgcgccttatatag

SEQ ID NO: 35346 - DNA, 1192 bp, Oryza sativa
tcctccgtgacgtggacaccgtcgcttatcgccgcctcatcacacgagccgtctgcgccattgcggccgacgatctgtccgcgccccccccgccccggtacactccgggcaactccgggcattcgcaggccagggtttgtcctgctgctctcctactctcgatcttgccttacttatgtgctgcttagggtgtgtacatttctcgtcttctattggttatctgaggctgccctttttttttgcctgcatggtgtttgactcacagctcgttcgggagatgatgaagtcgatcgttgcggatcagtctcatggaaccaagaacgtcctctgcaatggtttgcacgaggtaaagttaaaaagtgtataccatgagttgacacttcttattgcatccattatccgtcattctacctgtggtggtggcccttttcatacaaaatgggttactgggattcccgcagactgagatcccgttgaagtgctgccatgccagtatacatggtatggttgttactagtgaaagaataattttcagttaaaacactgtaaaattatcctaacttaatttgttggatatccttgtctccttggtgttggtggtgtgaggcatctctacgagcatgttcaatcttgttggtcaaaaggggtcatttctggcaatgagtgaaaaatgatgagataataaacaaagttcacacttaaactaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataa

SEQ ID NO: 35347 - DNA, 724 bp, Oryza sativa
  unsure (1)..(724): unsure at all n locations
cttttaattaaaccaaactaatggcacatgcacttcataatctcttttaatggttctcattcaaaatttattccagtgttattagtactgtacatctattactgtactaatggctcatttaccagcaaaagttgtacaatactgttttatttaatcttgctgcaataaaataaatttagtatgttgatgttatgactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcagagtcaccttgaacagcaatagtgaagaggtcccctcagtgatgtttgaagctggaggaagaaactacatccatgcatgtcaggaggtggcaaggatcgcatangagagctccgtgatcgctacagtgatcaattggccgacactgagtatcgctaccatcctcgccaacctcagggaagtgaccg

SEQ ID NO: 35348 - DNA, 688 bp, Oryza sativa
tggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacagccggcctc

SEQ ID NO: 35349 - DNA, 610 bp, Oryza sativa
tgcagcccttcctgcaacttcttcttgtcctcctgaggttgaatcttcttgattgcattaatactcctttgagttacctcaatccccctctcatgaacaagaaatcccaaaaactgaccagccgatactccaaaagcacactttgtcggattcatcttcaggccatattttctagtcctctcaaaaaccttcctcaaatcggctatgtggttttctacctccttggacttaacgaccatgtcatcaatataaacttcaactaaccagccgatcagatcatagaatatgtagttcatggccctctgatatgtagctccagcactcttcaagccaaaagtcatcacaacccactcaaacaagccaattgcaccaggacacctgaaagctgtcttatgaatgtcttcttctgccataaagatctgattgtaacccgcattgccatccataaaacttaatatcttaagccctgaagcagcatcaaccaatttatcggcaaccggcattgggtacttgtcctttggggtagccttgtttagatcccgaaaatcagtgcacactctgaccttgccatttttcttgataactggaactatattagaaacccactcag

SEQ ID NO: 35350 - DNA, 750 bp, Oryza sativa
  unsure (1)..(750): unsure at all n locations
tataccgcaactgtgctttttgattccggtgctacacattcctttttgtctaaaagttntgcgagcaaacatggatggaagttgttagtttgggagcctttactagttaatacgcccccccccaaaaaaggggggnnccaanatnccaaaggtattttcgacatagtattgtccttctgttactatagaaatagaagaagttcttttcccatcctcgcttatcttgctagaatccaaagatctagatgttatcttagggatggactggttatctcgtcacagaggagttatagattgtgccaaccgtaaggtgactttaaccagtagcaattgggaaaccgtttctttctttgtgtcctcccctaaatatcatggtgtgaacttaaaccaagttgctctacaagagattcctatagtacaagactacccagacgtgtttcccgaggatttgccaggtatgccacctaagagagacatagagtttcggatagacttggtgtcacaccctgaaaattcaaaatatataaattgttgtttaaatggaatttttagaaataattttaaaagtcttgaaaagaaaatctagttttaattaatacaattccaatataaaatgggcccagataaaatttcactaaatactttgcttaattctataattcctagatttttctgggatttatttgagctaagaaagtatttgtaataaatggaattgcatttaagaaataatttaaataaaaaggtttt

SEQ ID NO: 35351 - DNA, 1340 bp, Oryza sativa
  unsure (1)..(1340): unsure at all n locations
taggtaaacgccccatagtaagaggggtagttatgaaccctgtgcaccacccccatgggggtggtgaagggaaagcccccattggtagaaaaaaacccacaacaccttggggttatcctgcgcttggaagaagagctaggaaaaggaaaaaatatagtgatagttttattcttcgtcgttgtaagtaaatacgtaactaggaatatggaaaattgcatttttggaatttgcaataatgggatgggcgaacgacgggaattaaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaaggagtaatcagctgtgacacgaaaaaaaaagaattcttttgtagctcatcatttattggcaaaaatagaaaaggtcaatatgaaggaggagaaagaaacaatagtaacatggtcccgggcatctagcattctacccgcaatggttggccatacaatcacgattcataatggaaaggaacatatacctatttacataacaaatcttatgataggtcgcaaattgggggaattcgtaccaactcggcatttcacgagttatgaaagtgcaagaaaggatactaaatctcgtcgttaactgaattcagaatagaaagattcaaaataaaaaatacccagcaagatattgggtatttctagctttcctttcttcaaaaattgctatatgttagcagaaaagccttatccattaagagatggaacttcaagagcagctaggtctagagggaagttgtgagtattacgttcgtgtattactcccataccaagattagcacgattgatgatatcagcccaagtattaataacgcgaccttggctatcaactacacgatagttgaaattgaatccgtttagattgaaagccatagtactaatacctaaagcagtgaaccaaatccctactacaggccaagcagccaagaagaagtgtaaagaacgagaggtgttaaaactagcatattggaagattaatcggccaaaataaccatgagcggncacaatattataagtcttttgctgtgaccaaatctgtaaccctcattaacaaattcagtttcagtggtttcccctgatcaaactagaggttaccaagaaaccatgcatagcactgaatagggaggcgccaaatacaccagctacacctaacatgtgaaatggatgcataaggatgttatgctctgcctg

SEQ ID NO: 35352 - DNA, 343 bp, Oryza sativa
acggggtcgctagacctggtggtcccgggctcctcgctgggagatgtggcggctgaataggagggaagaacgatctcgtcgtggcgacgactggtgaaggatcgtgaggcgacgacacctacccacatgaggcaagcggcggcggcggcgacggtgacaccaaaggagacggcaacggaggtgaaatagggagagccggcagaatagagggaggtggtgacaacggtgaagatgacgtggcggctgaataggagggaagaacgatctcgtcgtggcgacgactggtgaaggatcgtgaggcgacgacacctacccacatgaggcaagcggcggcggcggcgac

SEQ ID NO: 35353 - DNA, 586 bp, Oryza sativa
tcggagtcacggtttgcaagatatgaatttccgaaggttatacggattaataatccgaggaaaaggtttcctttcaatgaatattcttcgtgaggccgctctgtcagtgggattaaagaagaattagggagatgtttcaaacttacagagaggaactcgggttgtaaggggatgtagtatgaacttgtagtggataaagaggccgcaagtgggctcggcaggggatgtaatagggagatgaaatagacttttcggcagcgtcaaggtcccgaggagtcacaacacagtaggccccaccggtgggtcccacagctttttcttttcttctttttattttcttctctctcttatccttccttcctcttgtcggtatcttctcttgctctctccccctcgtttctttctctgcttctcgcttcttgtgcgcgacaaattggacattacgccactgtaaagagtgggtttcatcagtatcgttaaaatgccactcccaatgaatgccaaacatttggttttgccatattcaccattttataaagttttcatcattttccacacatggtctgaccaaaatacccttcggtcg

SEQ ID NO: 35354 - DNA, 863 bp, Oryza sativa
taagcatagctaattctccattattttagttatattgatggtcgaaatttgtcggtaacgaccgtcaacaaccccaacacccatgtgatcgttctccccctcttaccaagaacaatggggttttgtttattagagttagcaacttgatacttgcattcagcgcgcgtgttggctaaattgtctgtctgtttgtcttcggaaccccaccatattgtgatttcttcatagtgaaactttcatattcatttagtgtttgttctacttgttcttcgattgcttgcaggaagagtgacctcgttgcctggttgttgtgcaccacaagctcgcgacaacagacgttgtattggttgctaaggcgcagcgtcattagatggttgtagtcgggtcgtgaacgtcttcttcatccaagtgagttatccccgcctcccatagaaagatcgggacacaaaccctcgcgggttcacatcatcactgctagagtgcctcttccaccgccaatccgaaccaccgccactgttgtagcatctggctgctcactgtcagcaattggcatcacgctaggctgcagtgcttccacctttcgctaaaatgcgcctagcagtagcttggccacccatccacaacctcaaatcggggcccaaacctgcttctcacactccctagtgagttccgctgcaaactcaatctccagctagcgtttctcgctgcgccgcgactcctctctctcccttaactccttcaccttcccgaggttgcggccatccccgtccggaggagcaccgacgtcggccaccttcccttctcccctacccgtcgcgtgcgaacggtgagaatactctcctcgtctactcccgcgccacctc

SEQ ID NO: 35355 - DNA, 677 bp, Oryza sativa
actagatagttgatatggttaaataggcatgtggctaatatgggtgaaggttgagcttttgtagaatagtggctagggtttagttgtttaggccgatatcgaggtaggataaatattggctagggttttgggtgttcgctagtcgtcgctagagttggacagcatgacaactaggtttggtatcatttctagccgtgttgatagacaacatatcggctagaagaataggaggtgggtgcagttttagtggggtggaagtgttactccgtcaaccgtgagtagcggcggagcggctaggatcacacagagctcaagagctaactgtgcggcgtgcaatggaggtcaaggggatagtgaagctctgaccgctgtacgcatcaaggcgtggggtgccaggagcagcacttcgaccttaggtttggtttttgccgggctttacaaccaacggtttgacgttgaggtccgtagaccgcgcaaacgtccccatggaaggcgtaaagccggcggctttttagtggctaaagggtattttggaaataaaagaaaatatttggaaagcaaatataagtttaaattgtaaattcaattataagattaaatcaaatatttattcaaatggtatttgaataaattaaggaaattcacataaaatcttaaaatagcaaattgatatcaaa

SEQ ID NO: 35356 - DNA, 1547 bp, Oryza sativa
taggagaatatgaatgcaaaaatggtacgttgatggtatacaatgagaggtgccgggagttgatggatggatttcggctggtaactttaaagcatgtatctcgggagcaaaatgttgaagctaatgatttgggggatgctatacaactcgttcaagagtatattatttaccgatttgggattcctcaaacaattacaaccgatcaagggtctatctttgtgtctaatgagtttgttcagtttgccgatagcatgggtatcaaaatgttgaattctgcgtcgtattatgcacaagccaatggacaagccgaggcgtctaacaagagtttgatcaagttgattaagagaaagatttctgattatcctcggcaatggcatactaggttggctgaagcattgtggtcttatcggatggcttgccacggattgatttgaggcagttttaccatgggaacagatttgcagaatgagttgtcagctaatgaatattataatctcatggccgatgagaaggaagatttggttcaatccagattgagagctcttgcaaaagctaccaaggataaggaaagggttgctcaacattataacaagaaggtggtgcctaagtctttttctgagggagagcttgtttggaagctaattttgccgataggaactcagataacaaattcggcatgtggtgtcacgcccggaatttctatccaaaattccaaacgcttacatgtgcgttaaatcctcatccaggaatcagccgaggcacacaataacaaattgataatagaatactatcaaacagctaattaatattcgcaaaataataaattattatagaggtggatagttcctctcaaaagaataaaattctacgcagcggaaataaacataagactaaacagctatggcgactccactccacaagcaacttgacccgaacaaagcctaaccctcctgatcatcaccttcactaaagtactcctcctctaatgaatgaatattgcaagaatgagcatatgacatactcaataagccacacaacaaatatgcaagtgcacaggataacaaagcatggcataatacagctcaattgcataaacaacatttaataaacatttgagagaacagtaaaacagttgagtaattaagcaatattaaatgaacactatacaacacacccgtgttgcataggcccaacctcacctgaacaaccaaccccggttgtacaaatcaaacctccataccaggaatataccattccaaaccaggagtcaatttagttatcacaaactatcaccaataatgagtagtgtgagactaatgacgaaaaacattgttaaactcacccataaccgcgggcacggctattcgaatagttttactctggccagaggtgtaccactatacccacaagacatagctccacaacatgtcaccatgcgcctcaataccaccatgatatctcggataggaactgtgacagtaccccttacacaacacaatccaccacagcgcaccgttcctggatcataatcaccccctcaataacca

SEQ ID NO: 35357 - DNA, 2214 bp, Oryza sativa
actagaggatcccccccatgtgactggccttgagcttcttcaaacgcttctgaaccttcctcaacgaaaacgctctcctccagaacgtcagaaactaaagcaaatgaacaaaatcaacaaaacagtacaaaaacaagcataaacagaacatgtggatatttttaacatgtagatctcgattttagatgaatttagcaacttgaaccactcgaatccgagttacgatgatttagttatgaatttctgaagtttaatcagattttcatcaaatacagaaaattattacgaattaaataaaagatttatgacgtcattacgacatcatcgccggccatggtgcgggatgacgcgaccaccggtggtagagggctcggccgggctatccaaggacacctacgcgtagaggacgacgacgcgaactcaccggtgcaaagaacaacgacggacgacgacgaacaacggccggcgacgaggaccgaggacggcgcggctcggctcgacggtggcgacggcgctctggcggcttgcgacggcggcgaaggggttgccggggtactcctcctccgcacgcacccgacggcggcaatgggaagcggcggcgacggctacagcggcggcgcggcgcggctggaacggcatcggcggcggcggcgactagttcaacgcggcggcggtgctatgggcaacggcgacggctaggacttcgggcaaacagaagaggatgactaggggatgctatttataggcttggattagagaaatcggactccaaacgagaggaatcgaagccggaaaatcctagggttaggtggaaagataaactcgaaatcgagtttgattcggataaaatacgaagcaattagctccaattcttggggaaaggatagaggacaacaaagggataaaaacccctcaaccaatcggactcagagatggccggttggggcggatttggcggggaacggcggcggcttgggctcggcaggccggctggaggttgaagacaaccccgacatgtgggccccacatgtcggcggctaaaaggaggggggcggtggcggctcggcttgggccggcttgggccgcacggccgcgcgcgaggaaaagaggagttgggccggaaacggcccaacggcctagggaattttaaagactttttcaattaaaataattcgtgaaatgatgtttcatttattaaaaatacttcccttgctcaaataatttccaaaaaaatctagacaatagataaccaagcaaagtatttaataaaattttatctagctcaattttatgttgaaatttttcctagattattagagtttaacttgtaagcttctaaaataatttctaaaaatgatttaaagaatgaattattaaactaggctattttcatggcgtgacaagtggtcaccaaattgggaaggcccgtttcaaatccataaggttgtgtccaaaggagcttgtatgttgcaagggtttgatggagaagtttatggacgagcacttaatgacaagtacttgaagaaatattacccaagtgtctgggtcattgcatgatcggctaagtgttgccgatgcatgttagccgatgtatttagatcgccttcagatggccgatatagttatatcgcccttagttttgttatcataatcggttgtgtcttgccgatgtatgacggccgatatggttatatcgcccttagttgtttttctgtattattataatcgatggtgttttgccgatgtatgatggccgatatttgctatatcgcccttagtacaagttataattttatcaatgccttcgtcattgcaaaattaggggggcagatatatgaaaaaaaaagtggattttcaacgcgaaaattatattaatcggcagatggattaagagttagactacaaatagccgattacaaaaatgagtttcaagctaagtcttattacaaagccaatcatttagagaggtattgcaggatagccgatataggtcattgtctaatttcctctacttcttggatgtcttgggcatcggttcctgggataaccttcacagacttggttaaatcagcaacatttttgatggccgatttaagtcatgattttttctcttcgattgcttttgggagattggctagcttctgtgtttccaaggccaatttagcattgcattcttcaagttgtgccatgagatcaatctttcggagggctgca

SEQ ID NO: 35358 - DNA, 617 bp, Oryza sativa
gcacaggaatggtctacggaatggacggttgagatctaatcctatccaaaacggatggccgagatcaacttgatctaccgcggtctacggctgacgtcgacgatgacatcggcgatgacgtcaccaccgggggcggctcggcacgcacgctcgccgcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgactgacgacggcggtgctccggtgatcttcgacggaaacagaggggtggacgaggacggtgacgacttgtcgaacctgacggtggcctttccgagcgacgacgacgacctaagcgacggtatgatccttttgcttcaatgccctgaactcacgcttcttcaaagcaacaactcctacaggtatgtgtgtcttattgaatgcctcagagaactccgcccaagtgattggttgtccttctgctctgatcacccggaaatgatcccaccattctgatgcaggtccttgcaactgatgtgaagcgaaaacaactttctcctgat

SEQ ID NO: 35359 - DNA, 643 bp, Oryza sativa
cgtggtgggttcaaacgtctacaccaaggatacagtagatgatctcgatgacaagcaaggacagggtttcatgtcagctgatgatttggaagaaattgatataggtccaggtgatagacccaggccgacattcatcagcaataacttatctccagaattcagagccaagctgatagagcttttaaaggaatataaagattgcttcgcttgggagtattatgagatgccaggactcagccgatcgattgttgaacatcggcttcctattaaaccgggggttagaccataccagcagttgccgaggagatgcaaagccgatatgctcgatgctgtcaaggctaaggttacacgtttatatgatgctggttttatccgtccatgccgatatgctgagtgggtttctaatatagttccagttatcaagaaaaatggcaaggtcagagtgtgcactgattttcgggatctaaacaaggctaccccaaaggacaagtacccaatgccggttgccgataaattggttgatgctgcttcagggcttaagatattaagttttatggatggcaatgcgggttacaatcagatctttatggcagaagaagacattcataagacagctttcaggtgtcctggtgcagggctgcag

SEQ ID NO: 35360 - DNA, 1494 bp, Oryza sativa
acactctactcatggtaccactagtatgaatttaggtagatgcttcgccgcttaattaggaaacattaggtggttttacaactctagactttgggaatattcatatcacctggacattatggaatggtttgattattgtggaattggattcacacctccccctctattgaaaacccttaaaatggttttaggctgggctcggggtgcatggttttgatagtatcacctcggccatataaggaccggtcttcgggcctctgttgcaaagcactaccgtacttccacatatctagtgggtaaggcttagtttgtggctcagtctggttataaacaaaagtatacggatggagatggacgaagtcgggggtcgatggacatctctagggcaaatgaaggctactcgagctgtggcccggtagtcgagatgtcatggcacagggctggtgtcctgctgctaggggctcagtcctgcctacctgtcccggaggttccggccgtaggtggggttgggtcggtactcttttctatggctaggatgggttggaaactatgtcacgtctcccgtccgtataccgtgatggtatgtggcacgtggttacacataaggaagatgtgtcttgtgggtaaagatgtgcacctctgatcagagtataacctattcaaatagccgcgccctcggttatgggcaagccaagcaatgtacccaagttagtgttttaattcttaaaacctgcttaactactaaaatgtggaatggctggcctgggttggcttgagacgagctgggacccagggtcgggttgccagttcggtctgaatcatcgtaggccttgggttaaggcaggttcgtgtgggttcatggccttgattaataatattgtatagctctagggtcgtatttacaaaatagctttgagcaaccaagtgtcttttaatgctgtttactgcaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcatgcctgccgtcaagcgcctgtggtcgtcgccctagtcttccgctgttttttgtttgtcttcttgtgtgctgggccttcgccgcccatgtaataaattaactatttacgcttccgcttgataaactctgaaatgtatcaacttttggtgtactttgcctcctgggacaaggaataatacacgcacgtaaggaacgcccgttgggttatttccggtcgtgacagatcatcacttgatggtatcagaacctccttgaccctagaacgagctttagatcccaagccttagcaatattttcgaaataaaaatccttccttatttgtgaaaatcctctagtctctctctgtcctgctgcttcatttatcgtcaaaatctgatctttaaaa

SEQ ID NO: 35361 - DNA, 19108 bp, Oryza sativa
aggattcgagctcgattcggattcgtttttcctcccgaaccctaagctttccttcgccttcgccggccgccgtgggcctccgtcgccgccccctagcccctataaaaggacccccgggacctcctctatccgccgccaccctcgctttagctcgccaccgcttgtagtgccgattccgcgtcaagtcgtgcgccgccgccgccgaagggagaccagccgtgcaccgccgccgctctggtcattgttgtcgctcaggaaggccaccgtcgggatcgccaagtcgtcgtcgtcctcgtccagccctccgtttccgccgaagaccgcaggagcaccgccgtcgtacgccggcgagcgtgagttgccaagccgccgttggtgatgacgtcatcgccgacgtcagcattgcgttacccgtagacccacggtagaccgattagatctcggccatccgttttggattagattagatctcggccgtccgtttcgtaggccgtccgttttttggtgattttgctcttttctgcttagattccgaccttcccggagagtctgattttgcaggagaagactttgaagagttccaatgccagcaaggcaagtcacatagatcccaaacaaccctttgagcatgttgatcctgtttaaagctattgtttctatttaactattgcatatatttttgaatgtcattgggtgggaatgacctattgcctttgttatagcctttttgattattgattatctattctttgtcacttggttaataattggattagctagaacattatatggttttagctaaagtgctagaatgcttagccatgcttagagacactagctcgtataaatggggtatcttatgattcactattatttaatgatggcttaatgatagctcacgatggttgatcgtgattggttaattaatcaatttgccaactaaaacctgacaatggtgggttgtgagcacatggttttgatggtcgtgctcatgacatttaaggaccggttcacgattttcggttgtgaaacattaaccgtgccaaccattagccagcgtgggcaacggctttactttttgtataatatggttcattgtagagcaccagactatgaagtggcggagataagcccacgggggtcgctggggagtccatgccttgtttataagggggtgattatgatctaggaacggtgcactgctttgaattgtgttatgcagagggtattgtcaccatctctattcgggtacttggtaagtatcgcgacgcatggttgacatgttgtggggctgtgtcttgtgggtacagtggtacacctctggccagagtaaaactattcgaatagccgtgcccgcggttatgggcgggtctaacaatgtctttcgtgattagtttcacacttctcatcataataaaagatgctataactggtaataatttgattagctcctggtttggaatagtatattcctggtttggagatagatctgtacagccgggtatggttgttcgggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttattttttttccgctgcttagatctttattgattgagaggaactatctacctctgtaatgacattttattcgcttattaattagagtaataattgtattctattatcaatttcttattgtgtgcctcggctgattcctggacgagggttcacacacatgtaagcgtttggaattttggatagaaattccgggcgtgacatcagtcctgcctacctctcccggaggttccggccgtaggtggggttgggtcggtactcttgtctatggctaggatgggttggaaactatgtcacgtctcccgtctgtataccgtggtggtatgtggcacgtggttacacgtgaggaagatgtgtcttgtgggtaaagatgtacacctctgatcagagtataacctattcaaatagccgcgccctcggttatgggcaagccaagcaatgtacccaagttagtgttttaattcttaaaacctgcttaactactaaaatgtggaatggctggcctgggttggcttgagacgagctgggacccagggtcgggttgccagttcggtctgaatcatcgtaggccttgggttaaggcaggttcgtgtgggttcatggccttgattaataatattgtatagctctagggtcgtatttacaaaatagctttgagcaaccaagtgtcttttaatgctgtttactacaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgttttttgtttgtcttcttgtgtgctgggccttcgccgcccatgtaataaattaactatttacgcttccgcttgataaactctgaaatgtatcaacttttggtgtactttgcctcctgggacaaggaataatacacgcacgtaaggaacgcccgttgggttatttccggtcgtgacagatcatcacttgaccgacgcgctgctccacagcctcgctgctcagacatgttaaacgggaaccaactttcgccaagatgaatacgaaaaagataccccgaggagaaacccgggtcgcgtcatccgacccgaaatagttataggctggatgggcccgagcctggagcggctggatccgcctaccgacgaagtctgcagcgacttcatatcccgacaagccccgttctcggagatcatcgatgatgtcaataaatgactgaagagagggggtcaaagggggtttggctttccaggtcggaatcttgtccggttgatcctcgggaacaacgaagacagggttcgagtccttgatctcaagatagaaccacctgttccgccacttactacgggaagaaggacactggaaggggatataacgcgacttcatgccatcacaaagtcggaacctgacgcaaccagataccctattggattccatccaacgcagttcatagtagaaacggaagagatcgagaaaaggctctaccccaatgtaggcctaacagagatgaacaaagatactaagaaaggtgatggaattaggattcaaatggagaagagaaagaccatagaaattcaacaccaggagaagaaactcggaaggtggaggaagaaaaccgcagagaacgtaatcttcgatcgcaactatgcgacccaagaggggctgaggatcagtacctcctacttctctctccatgtctccacggctgggaagggcgccgtcctcctgaaggttcttcaacgtcgtgccggtggaagacgacttgtcaagatccattgctgttccaagatcgccggaaaacaagcctgagttggcgaactagggtttcttgcggcggcggagaaggcaaggagcgctggcaggcggtgtgtgttcaacaaggttggtagacttcaaaatgagctcccaaaattcctttaaataagcgcactaccgacggtgcaaattccaaggaacgaagagagatccccgccggaaatctctgggcccgttacgcgcggcagttttctagacttcagttcaaaattcactcgtgaccgttgtgcttcaaacggcatgctcgactatgttctatctccgcggtcctcgcaccaggaatgacaacgttctcgacacccgaagtcgtaaatggttgcacgagttcattttaagcagaagtcgggggctactgtcagggttacgggtcaggcataccctctacccttcgatatacgttacatatcgacatggcatacccacgcgcacgcagatgttttctacatatcctaaggaaacctttcacgaaatctacagatgggaagagtcattctcggacagaactgggtcgtcgatgtatcgtattgggtctgatatctccgagtcctacttagagacctccagatctgtgatataagagggacccccccggggagggcatagatcatcgaatctcagagccaacacaatccacacagcctacaaagccgaagtctacaaggagccaagtcatcgagagctagtcgaatccactcgactacgatctcgccggatccgacaagttccatcgttccctttgtaatctgtgttttccaccatataatcccatatctactggattagggctattacctaccaaggggcctgaaccagtataattcttgtcttttgattgttcgatgtcgtactacgtagatccttgtaccaacgtaccccaataccctctatatccggtctacgggtatcacccgtcgacagtctccaaactctcaaaatgcatatacagatcctagaacttgtcaaagtgtatcatctagatcccaaatcgacacatcccctcttggatcctacgtggcgctgatgtgacctgccacatggacgtgacgtgtccttttttttcttcttttttttcttttccgttttcttctcattatttttttcctctctcctactcgggtcacagagaaaagagaagaaaggaaaatacaacagaagaaaaaaaaagaaaaaagaaaatttttaaatgagtcccatttgtcagtcaaaattatgccatgtcatgttcgtgtgacatgccacatcagcggcacgtaggatcctgaaggagctgtggcgatttggtatctagatgacacactatgacaagtgttgggacttgaatatgtattttgagagtttaaggacctagataacacaccgctacaaatttaaggaccgcccatgcactttactcttctagaaataaatttatacttaaaaatataattttagagtactacttttttctgtaaccaccttcattcaaatttctcaaagtcttattcaaaccctcccaccgtagccacagggtaatctatgtcatttttttcctattaaattatcttttgagtgcgacattccttttaatttgtcattttagtgtgacatgtttattcttttaggatggagggagtaggtgatgagtatatcactagcttggatatgaccatggctacttttttattcaccaaccgtaggtgcatgcttattatttaagttttatgtattatatatttgaacaaacgttgctgcactatgagtcctgtatcctctcatttgcagaaatacttgcatgggaaaaggaaagaagagcgggctcacaaagtgtttggatgatcaaagaagttgattgggaccaaaccaagatcttccccaagtctactcctaactcaccccgtcacttttggttcatatatagaaagcaaaagatgaagttctatatgttttagattcggatttaggcttcctaacaacatcaatttcaaatggacctagctaataatatagaacaaatcttgagaccccatgagtacttgttggaaagcttatggagtctaatttcataaggttttagtcttacgtcaaaattcctactaagttattgggaatctgcaaaacaagctacgtagcttatccagtctgagtctattttgaatcttgggctttttaactgtgtcgtgtgctaagcccaaggcggtgtgcgccctagggtaaccctattcagtggtcgtcaagtttagagtgaggttttgcttagattatttctgctattgcagtttcgccactagttcggtttgtagaaccctaactttgagattttaatcattcatctgcaaattgagttgcaatctacctttttcttcctcgtgttcttcgattcgcatgcagagattagccttctcagcgaggtcaactgggcggcacacagttaataaccagaggagacatggtgctgcaattgcagggttcggatcatgttgatcagaagctagatcgtgcgtgttaagtttttgtcaaatcaagagttatcaatacatatcagaagatcgggatctacttcctcatcggtaagttttaagagcggataacgaattttctagatacataaatttagatagaataagtttgcattatgttttaataagtgcgaagaaaaatgtctaatgacgataaatctgcatcccatccgatggaggggcccactttcacatagcacatcacttatacttttgtttttgctttgtgtaaacggattagctggggagtgctatggttggagggataacatgttaattgattcttactcttagctctactagcaaggtggcagtaatcaagtacacaaaacactcatgaacatgccacactctaattgggctaagatgtcataatttttcaaatgataatatttattattttcgcttatattagcggtcaaagtttaaaaggctgcgcagtccttttaggaagtagcagcgcacaataaaatatggaaaaggctgaagtgtggaaatgtccctgtcttctaaagggtattgcattagaaaagcaaatgtatgtaactttgtcttacattttatttatccagtatgttccccacaaagaaaaggcttgttaaaaacaacctataaaactacagtagatatgatactctcttgttcactactgctttttttttccctttttgactggtttaatacagctttctttgaatgactataaataaagtgtccttatcagagaaagcatgtatacatgcattgtaactggttcacggaaaaaaattaccattcatgcatggataacaagaggcgacaataagttgttgtctcctagcaccctggcactttattcctttcaaaaagaatattttatgaaccatcatgtgcattgtactccactaacccattttcacttcacgagcctagtaaaaaaaccggaccggcccagctgttgaaccggaaaaaaccggaaccagctcaaccggacggtctttggtgaaaaccggcgaatcggacgcctctgaaccggcggttctggcgagcacgtggaccaggctacaaaggcccactaggcccaagtcatgcatgcgtcgtttttagtgaataaatgaaaaaaggatgggcagttgaggatcgaacccgggttgccgtaataaagctcaacaaataagccagctagaccacttgtaaatgctgttgaatggagaatatacacgtaatatgactgctccggttctgcagttgaaccggtcgacccagcggtcagaccggtgagccggtgaaccagatgcttgaccggttcgatggccggtccagctttttgcactatgttcacgaggctgtgttccggatggaaggatgggaatttctctaccatacatatataaaatgggctgactagttagcacattattaattacgtattagctatacaaacttaaaaatacattaatatgatttttaaaatgattttttatatatttttttttaaatagacacacctgttaacgacgaaatttgctaagcccaaaatcatcctcggtttagagtcagtttctgctttagagttatggaatcagccgatgggaatcgtcaaatcaccagcaaccgtgttttcgatggagtcggatcaactaaagggaatttatccagaagagtccgagttcaagaaggatgcagcatggcagtttatctattaattaagaatagtttgttagtttacttttatccttaggaaagtgtgtttagtgtccgataaggactttatgttttccttttatttttaggaaagtttctttcttattcgacaaggacttgcatcaacccatggatataaatatgtacacccggggtcattgtaatggatcaatctcacgatcaatataattcggtgcatcgccaccttttaccttttctactttattttatcgtccggcaggacttggcacctgacgcggagctgcatcggtgttcgatctctggctaaggggtaagtccaatgttccgccggctcaggcagttgtatcgtttacgtcggcgtcgttcaaggctgcatcagtacattcgacctcttggattactctggtttggatggtatatttgccaacctatttatcatatgtctctgttaatctagtcttagcatatcaatttagctctatcggctgcttctcgttttagggtttctgccggtatcggctacatcgcgttgctagattagattagcttagacatctaccaccctgaaaactcagtcaacggcttgattgtctagatattatgtttcttttcatacttagtgttgcatcagttaagtttgatctactaagtcgtgcttagaaccataatctctagcctgcttcttgattgccaataagggtttcatcggggtttaagcagatgagttatctggacgttgcatcggcttacaaggattgcatacgtattggatttagccgattgcgataaaggtttcattgattaatctaatcgttttgattttatgacatcgaacctccacccgatgtatgctttaaccttcggatcagtgcttattctatcatattgttagccgattggtttatactggattatattgctatattgtattatcatcagccgattgccttcatatcattatatacattggacatatagccgatagctcaaaatcctattgctatcggctggcattggcatcggctggaactactacatcggcttgtcagccgatcggctatttgatctagtgtttacatatctcgtcagttgcaggatcaaactgactggcacgcccgcatctcaccaacctttggacctgcactggagctaagtagatctcctaggccagtgtgtgtttttcgcatcaacaataccgtttagcagtttgaaaacatacatatagtaaacgatatagtaaacgagagagtaaaagttagaaaagtgtagtttagaacatagcgtgtgtgttttcttccttttttccaaattctacccactcattttttttttgcacgtttcccaaactattaaaggtgtgttttctaaaacataaatctatagaaaaattgattttttctaaaagatcatattaatctatttttaaagtttttttaagctaatattcttggatcaaagcttcgtttcacgcgagtgggggattagctctcaacatagtacaccatttttatcaagcccagcccattaccctgccactgtcttcttagttaggccttgtgtcgaggcccaaatctctatcccgtcgctagggttaattttagctctgatttctggctcatccacaaagatggcccagggtttcaggctttttaaacctggccgaaaggtgtgattaattttcttggcctaaggtctgacaaagtccatttgatgtgcaatttggaataagtttacttttgtgtcccttaaataatgtcctcaaaccggatatctcgaactacaaactattgaaaccggtgcaatttgattcccttgatggttttggatggcggttttgctgacgtggcatcccagtcattaaataaattaaaaaataaagcgggcccacctatcatctctctctactaacatatctcacccagtcaaccatctctctctccccttcttctcgacgtgacagtcgtagggtgctagggtgatgatgggcggcggcggggctctcctcccacctcggccctttccgcctcagcgctggtggcagactggtcggccgagcagggatgagaggcgttggaggagattcggatatgcagcttcctcgccagaagtcttcaatgggccgcggcggcgagagggggttgaggcaggtggacagcttgccaaggtcgcccatggcactggcatcgagggtgtcgctagccaagaccgagtcggcagtcgacacgtaggagctcggcgtcgtggaccgggcgtcgattattcatcttcaatgcgaggacgtcaggaggagggggtagcgtaggcagtatgccccgcccacagaggcggtcctcaaggggtgggcaatgaggaggggtctcgggcgcggtgcggaggcgagcggccacggccggggcgacgctccgtgtggtgggtcgtggcatggtcggctcgcgcgtcccaatccgtagtggcggtggtgctcaataggggcccgaccatctgctgccgcacctgcgccgcttggttttaaggtggctgggcagccgaccatgcatgcctacgcccatcgacacggccttccctaaccttcaggagctcggcatctatagcatcggcatggaaaaggagggccgtgagatcgagttgctcgtggcgacatcaacatccaaggagggtcacccaccgccaccgctccggccatctctctcactcaccaccgccgtcgccggggggggcttgtagtaggcagagatggggaagaggcggagctggcggagacatgaggtggagcggcaacagcacaacctcaaagtggagtgcggccgccatcacgggagccgccactgctatctcgggcgtcgcaggctgcttcgcccttggctacttcctcaccctcagccggtctactcccgctagctctgaatctattgttccatggggagagaaaggggagtgagtaagagaaagagagagaacaaggagagaggggtgaggaagaagggaagggaaaaggaggactgacatgtgggtcccacaatattctttttgtgaatgagaaatgggtcccacacattttttctaattccaataccacataagcaccacgttaacgccacataggatgaagaccaggtcaacgccgtcacgtagtcaccatgtcagcgaaaccgccctccaaaacagctgacggagtcaatcgcactggttttaatagttgaggggtcgagatatccggtattgtggttcagggatacgaatcagatttggcccagtagttaagggagtcaaagtgaacttattccgtgcagttttcgcacgcttgtggtttgccttacccaccatggctagttatttagtgggctatatatacaaagacatgagtttggatggtttggttattgctcctactagtcgaaatctcacgctttgctgcaaagcacatagatgattattacctatatgttacataaataatgtatatatgttgaaataatgtgaaaataatgagagaatgatgatttgacatgcttggagtaataaattatagataataagttatgtttgcacgagtcttaaaataccccaaataataattgctagtgattgatgatgtatcatatttatatttgtatgttgagattaagaggtaatggataccaagtatgcagaaggtatagattggaggtataaacatgagaggacagctcggactacggttacacattgcaccaaactcatatgcatcaaactcatatgcatgacacgtatatatattgcaccagccaccaggcatgggtccagtccattactccctccatcccaaaatataagatattttagatggatgtgaccatatcctaatactatgaatctggacagaagcctgtccagattcacagtattagaatatgttccatcctcccaaaatctcttatatattttgggacggagagaatatatcgtaatgcaatgcagctgtaagatgtacctactccgtttcattgctatatagaggttgtgttagatgtacctactccgtttgattgcaatatagaggccgtgtttagatttagagatgtaaagttttgatgtgtcacatcggatatacgaatatatatttaaagtattaaatgtagtctaataacaaaacaaattatagaatccacctgtaaaccgcgagacaaatttattaagcttaattaatctgttattagcaaatatttactgtagcatcacattgtcaaattatggcacaattagacttaaaagattcgtcttgtaatttacacataatctatgtaattaattttttttatttatatttaatactttatgtatatattcaaacattcgatgtgacagagtaaagtttgtctggagttctaaagagacccagagtacaagttggcttgcatccatgcctcctagagtcccagtacacccgcatgccacacccatatcctgagttcctgacaccaatgtcatgtcgtcatcactagaagctaaatctcattcataaaatatttttttcagtttccgtgtctattgtgtatatgatttgggctatatcacttgccatgaattgaaataaaaaaacacgcggctaatatttttacagatatatgtcattctaaaatatgatttagttacaatctacatagaaaatatatcaaaacgaatatccaccaaaatatgatatttgtggaagaaatgacattgtgcaaagtgatgtaaaaatgatattgcaaaatgatatatcacttgacatttattaaaaactaaaaaagtacataactgatatttctacatatatatgccagtacatcataaaatctactttttccaattgtaatttttttgcgaggaattttccaattgtaattattatagtaatgtaatatatgcgaacacatcagaaaatctaagtttaggagaaaatctaagtttaggagagtatatagactttttccaattgtaattaacacagtaatgtaatcagaccaagttatatgcccagggcaaagagccaatttcaagatttgataatagcacttgaacatacaaatagatttgaaactaactagcaatattcactcacttaaatatataaatagatttgtaaaataatttttcgagagtgaatgtcaggtccttcggcggagcagtctttcggaaggctttcaacagtgtcttcacatttctgtgcatctgaggtgaatattgctataatcaaagtaaagaaaaaaaacaaattaaattactagtacacgaactaaaccccgatcacatccacatccttatttatggaggaatcagtgtaattccctgtttctagttggtcaaaaatatcagtgacacttgtccaggctttagtaggatgaaagtgtgagaaaagaaaattgacacctctatactaccctaacaagtggctagaacaattaaggaataaaactgtcaaacagtagcacttatggggtgttttttttaggggtcctagaatccacaatctccctgggctaaattctataacaatctgtagaagctagctgagaaaataaagttgggtgggaattacccaccaatgccaccggtatacccccaaagcccgaagcctctagcattcatctctccacccatggaacaagcaagcacgggagacgggaagaggcaacgggggaaacgggggtcgcgccccctctagcacggcaaccatcgccagatctggccatccctcgccggaaaccgggatcccttgccagatccggtccttccccgtaggaggcgaccgattttagcacgcgagggagcttgggcaggaggcgctaggtggctagggttttggggctgttctaggaagagggagctcgcactggcctacttcctcatcaactctggcgctctgctgcttcatcgtcaccaactcttgcggtgtcctgctccatccccatcaactccggctagtaggatttgtgcaaggaaacaaatcctttgaaaaaattgcacaaatcaaacacaaatgagacatgattttttttcccgaagtttggattacaagaatcctactctcaattgaggaactccgaagagctgggtctcaattaaccccttgcctcaccgtgaaaagccctaggaggaagtcctcggtcttgaatccaacatttctaagtccatcactagaattcaagtgacaccaagatccataacttgaactcctagagaatacaagtgaggattactctaccaagacaacctctgatagctcagtatggatctttactcaattacctcatttccttgtgtaggtgaggaagaccttaacaaacttcctgggtcaatccacaaatcgatggaagctcgtggacgacacctatccatctaagaggtcaccctccaagagtaatgtcagggttgcggataaggcataccttctatcctacgaattatggaatatgccgataaggtataccttcacgtacacagattgtttccatgcacaccgtttgggatttgtctcaaattatggaaaatatctctacaagtcaagcgatttccatagtcctactcggaagggatagaacttctgttataccgtatcgaatcaaatatcctcggatctttcttgggggtcaagatgatctacggtataaaagggacccccaggaaggggttcaaggcatccaattctatcgccgacacacccaccatagtttactgaagccggagtaccgaagccaaatcgccgggagatctcgtcgaactcatcgactacgatctcatcggtatcgtctatttcgactactctctttgtaatcttttctcaccatcatcaattccatataaactggactagggctattacctgataaggggcctgaaccagtataatccttgtcttttgtttgcttgatgtcatgctacgtagaccctcgttccaacgtaccacaatactcaactcatctggtccacgactatcactcgtcgacaagtaataagcaccaaatagcggcccaacgagaatcacgacgtgctcaagtcatcctagccctcacaccatcaccaatcctcactgccaccctcaatactcacttatctcacttgggagactcaagaacagggtggaggaagcaagaacaccatgagagaggctagaggaagttaggagaaaaaaaacggaagtggaattgccaaaaattgagctggggccagtgacgaagccaccgtgggggctggggaggcctggcaccccccatgccgccatgcgacaaccccccaaggtgattatttactaatgggactaactatatagctgcctaggttttagcttaaattgttacgtgggttaactaactgaaagttatatgtggttgcaaacctcaaattaaaatgatgaaaagacgtgatgttgaatcatccatatactaaatatattatattattgtatttaaaatagatgctatttaatgatctaatttaaaattagtgatcatccatatattagtagacatatacttgtaaaaccacatcaacaatcataatttccataactataaaggagcgattaaacatatcatacgtaattgcacatattaatataaacaagagacgattgggtatatctttctcttctggctaattgctatcatatgcatgataccgaccacacattacactctacagcattgtccatcgagccgcaagtgagctctctcatctcatagagggcacccccaatctctaaatcttggcttcgcccttggctagggcgagctggagaatatataacggctatatgacatcatgcagccgttactcacatttttgaattggaaaggtgttatgaacttctaggccggggtgctaggaacttccggccaacgcttaggaaaattctataggagtgactggctaggaagttccgggcaatgtgccaagaacttccggccagcccttgctgtcccgaaaagcacttttcccaaaatttgcttttaaaaattttcttctatggatatttactaggggtggcaatttccccattgggccggggacccgcccctacgaggctagggatgggggataattctcacccatggatgagcgggggtggggacgaggatgggagttgacccgcggggccccagaggtatgagttacaaatcaaaaaatagcacattctaagatccatttggtccattaggtgaaggactacataagcaaaaccctatattttccaaaatattaccaaacttgcgcgccattctctcctctctgactcacgtatctccctcctagcgcgctacccctagccaacctacctcttcgtcgcgcaccgtccctagctatcactgccccgagccggagctacctcttcgtcgtcgtccccggccggtgttgcctcttagcgctgcatctggacggtgccgcctcatcgcagcacgccacccccaaccgttgttgccttctcactgttcaccaccctcggctggtgttgcctcctcgcaacacgctacccatagtcgacaccacctcttcatcgcagctcctagccggtgccaccacgtcgccatcatcctcggttgtagacaccttgtcgctgccctcaatcatcaccttgttgtggtgcaccgcctctagccgccgcagtaggtgccctagagttgctacccatgtgggtggtacggggccccgcttacccgtcgggtcccctactggggcgagggtaagggcgggggcgggggcaggtgaggttttccacccggtggacaatgcggggagcgggggcaggggcattcctgtccaacctaatcctgccccgctgccacccctaatattcattttaagcacttagatcatctcaggcaactagagataacaatgaggacccataacccgagacccgacaggtttttactctattaagagctaattgtgttctaactcttatacccatgggtctactggcgggcgaaaactcttacccattgggtacgtggatatgggtctattctagctttatccacccgtatccaccaacccgtgggtgaaaaaaaaactcgttgattagcaaaaaactatgagcaagtctcaacgactactatatcatagcataaaactcctttcacatcttaacattgttctagtctagttatatgaaattatttttcgatttcttgattatgtaatgtgtttgtataattttttttactcgcctttgaacgctaatgttaatagcattgttgctaaagaaaatactgatgatttacaactctaatatggctaattacagtaaaaaactataaatgctacaaggcaattatataggtatgggtacccgttggatacccgttacccgcacaggtgtgggtatggggacgattttgtacccacgacgggtgtgggtatttaagtgggaatatttagacatcacgggtgtgggtatggggcaagggaacccaatgggtatgcacccattgccatctcaacaggaaaccatttgaacccctcttgatattacggtttttcctaaaactcaagatcaaaatgcaaacagttttaaatagctctccgagtctttgtgcatcttgcagttgttgttgggggggtgtcctcctttgcacattatcgcacacctcagcaccaggggactaattgcctgcacttatctcaataaacacattagtcccttaaccgttttattattaatcaccgaaacccacttatgggactagatgcactttcaatggtccctcccacactcacagggagtggtatccagtggcggtcagggccatgcagatcgattgtcgatgccaccattggctggttgcttcccaaaaaagaaggcatacccggctccacctaatcatggtcgatgctagcacttgccgtgccccgcggtaacgaaatccacggcctcaacatcctcgaccctggatcgcaccgagtgttgtgtggatccaggatgtaggacgaggtccaagtagtcatcttcccaacgccgccgctcatcgccaaaaacgacttcctgtgtcttccagtcaaatacatgaaaagtggatgcaaagggtgcatgcaaattaatcgagtgccaggagaaccacctgctactggtgggggagtgtttatacctccaaccaccaaaactagccattggggccaaaaccccaacttaagaagcctgcaggtcacattgcaaaggggtggccagtcagatcggcctccaaggcaatagttagaaaactagtcgttgtcgtgcatttaatgcatcaccaaaggcgttggctggtcaaaccgctgggcaccggtggctctggtcagaccaccgtcggctctagatcacaagccatggccatccaccctgctccccaagcgctcggttggcctggcttgggcagattgaccaagacatgttgatcagatcggctttattccacggtcagaccgggtgtagatagtgaatatagataaaaatgaattgaacaaagtgaccttatgcaaatgtgctaatgtggaaattttgatcatatctttaccatagctattacccttgttgatagtacggcaaagctagaaaaaaaacctagcaaaatcgatcacccaacacctcgatcgatgaagacgaaaacctagattaatcaccttcacctcattgttttgcgccattaattttaaatccatggtaatcatccttggcatacacatcatgtggttctaactcatattacatcactcaaacaaaatagtctgtccacaattagcgcttgtcattaaataccaaaatcaacgccaggaatctaaatgcttcagaaaccgagtccacctagtttgaaggcgagtgtgcgagtggggaggccaaatttcacagtggagtggggtgataatagttagccggtctcccgaccggagaaggaaaaaggcttgacagatggacccacccccacctgtcggctgcacaatggggaggagatgccaagcgggctagcatgagcgagctaggctgtgcagagagttgggccgcggaggaacaagatggcgactagctggaggaaggagggagagaaaacgggttggactagctaggccgacgcggaaaaagaaaatgaagagaggccggaccaaaggagggagtaggaagcaggccttgcacgtcaaaggagaaggctgacgggagagaagacgatggaacttgggttggattccgcacggattgaggagaaggattt

SEQ ID NO: 35362 - DNA, 47825 bp, Oryza sativa
  unsure (1)..(47825): unsure at all n locations
cagagcgtgcagcaggaggagaaagaaacctagttttcaaggccgcaatgaagagcaagtaccatctagaaaaattcaaagagtaagtaaatgactgttaggttgtactcctaccatgcatcagttaacgttgtcattgcaagcacatttctactccatacaacatacagggttgaagggtgttacactgtcaaaagtgtccattcgcaaattctgtcaaaagtttatcaatgaaaagattaagatatagattttacctcaatttctgttagaatgtttttcaaactgctaaacaatatattttttgtgaaaactttctatatataagttgttttaaaatatcaagtaagttagtttttcaagtttatataattaaaatttaatcaatcattttgcatgtcctaacttcatctttatcttcattagggaaaaaaaaacctccacctaatgctgatgggagagaagactatgggacttgggttggattccgcccggacatacgagaaggattttaatttgtttttccgttgaaataataactgaaataaaatttatattaataaaattagattcttagctctcaaaattccaaagagtattttaggacatgttgagaaaaacttcagccatgatttattaaacaaaattttatttcccatctttaattaactttttaattgatataaatttcaaatcagagtgtgacagcaggagaaagaaacctggttttcaaggccacaatgaagagcaagtaccatctagaaaaattcaaagagtaagtaaatgattgttaggttgtactcctaccatgcatcagttaacgttgtcattgcaagcacatgcatttcttctccatacaataggacagggttgaaaggtgttacactgtcaaaagtgtccttcgtaaattttatcaaaagtttatcaatgaaaagatgaagatatagattttacctcaatttctgttagaatgtttttcaggctgctaaacgatacattttctgtgaaaactttctatatataaattgttttaaaatatcaagttaattaatttttcaagtttataataattaaaatttaatcaatcattttacatgtcctaacttcatcttcatctttattagggaaaaaaatccccacctaatgcagtttaagaattagttatgtattatttatgtgttttacaatcttggtagccatcttggattgatttggatcattactggtgtctcgctatcaacgaatattttggattgatactagtaatgatttcgtacatcagctcaattttttgaaaatgctcactgagctaggtcgacgtgtatatgtttaaatggatgagtgacaactagggatgcaggtgggccgggttaacccactgacccagtgacctagcccaagaatcatgggacaaaaatcagatgggtcgacccatgatttttcgccggtcaacataggtcgtggtccccttgacccaatcaacataagtgggccgacccattgagtaggcatttgactaatcgccggtcatctccgcccccgccgccgatcctgcattcttgctgtgctccgcccccgccgccatcgccctcacgagctcggcgctctgcgatcgctgtcccgtctccgagacgagccctactggcaggcatcctgcccattcatcttctcctcgctcggcgccagctactgcacgacaggcagcggcgacgcggcagacacacgcaaggccgagagacctgcagacccgccgccgacggagcttaccggcggtgccacagccggcggacgcgcggaggtagcggcgccatggatgattaataattctgtgcgtgttcctttcttctgtccatgctaaaactagaaaagaatcaaagatattggattctcggtggattggatgcagatgtagctcatggatttcacttttcaggcatagcatgatgtctaaattcaaaagcagttgcttcctcgtctttgcttacataatagttacatatggtttaagcgatttggttaatctctcgttcctcgggcctcagttctgcagttttctcgtatttgtttgatttcagctgatgtcaaatgattaatataatcatctatgaattttaggtttgatgctgtctgctatctgttcgatttctgctgatgtcaaatgcttaatcttccagtatgattttttttggtttgatgatccgtgctgctgttgatctgtttagacgatctggctgttgtgcgtactagtcgttgctttgtgaattgccactccacggcgtgattggccaatctgaatccggtcgccccatggacagctcgtgggtcagtggtccatgcatgttttgtgggtcggaaatcaccgccttgggtatcgtgggtcagactttgggtcgacccagcccgacccccccagcacattacgagtgtagaggaaataaataaataaggaaccacctatatatttatcgataaattttcttctaaaattgacagtgtaatttttgtaggagaaaatttatcgacaaatatatagcaaatatatagcaaaattgataaataaaatataggagtatctatcaaagaaaataaaatttgtgttagaaaatcgagcggtttgataagaaaaaaaaggtgagatatagcaaaatcaataaaatattgcgccacctgtccgtcgtctcgtctccagtagacgggcccctgtggtggctgtgtgcgagcaaaatactagcagcaagaagcaatcatcctctcctcgccccgcaccatctctccagtctccatccttgatggtctccttgctcccccgcgcgccctgcctcgcctcctccatccccaagcccaccgcccttcggccgccgtgcatggcgtccacatccgccgcggcccctgccgctgcagcggcgacggcaggaggcgtccgcgtcccggccgccgaggaagctgccggtgctgctgttcgacgtcatggacaccgtcgtccgcgaccccttctaccaccacataccggccttcttccagttcagtgcatctcccgtcccttgtgatcggtgttggtgtgggtttgcagttgaggtgttcgacggaatgcctgcttgggggttcttgggggcttactgttgctcgtattagaggggctatgaatgttaatgatcttgcgtttttgtctggatccggcttaggctatgtggtggttttgtagtaatggcttggatttccctgtgggattgcaatggtttcattggtactggaatgctcagactcccaataaatcatatataagtgcacaattgtgaattcaatattcgtttatgaactagcaccacacaagtacctaaaactgtttcagaaatcctgtgttgaatattttattacttattacctcaatgattcggttaatttaagcgtgaagtctattttatttttcttgctttaactcttctcagattccattttgtcattataaatacttgggtttatatcagtgaaaccatcccaatcaaaaccatgatggaatagagttttgggcgttgtttacctgtaatatgggggtgaagccaaccgttttttgagtttggtgtgaaattttgattccaataagagtttgagggccaaactagactttacccttaaattaatatcttctcctatatgttttactatgatttgtatatctattttgtgttactttctggattataaatatccaatatttgcctgcagaatgtcaatgaaggaactcctcgaaaacaagcatccaacagcatggtctgaatttgagatgggtctaattgatgaggtgtgagttattacttttcatatattggtgagatattggccacggtagtaggatcctagttttgacttttgaattgtttttgcgaaatatttttctcgaaaacgcaagagaattgcgtttcatttcattaaggggaagaaaataaaggaaaaatacaaagtaggagagaccaaagccctcctacacacccacgccccggccaaccccggccaactagctgcctatgtttctgtgaaatataccactaattattgacagttacttactttgctaatggacattaaaggttgccaagttgtgcttgccacgcttgaaatgacttcagttcatcaataacatatgtggttccttcattatcttagtcattgttcttacttcctgtaatcctatttcttgtatcgagaaattcattactccactaggtcattgatcactgctttctggacttggtggacacttactagctcaacattttaggtgtttaaacaaggaaagtaagttttatatgtttgtcctatagataacaagcacaaaaggttatgtgcatttgaggatagacaagtgacgaaaatgctgaaattaatctgtatcaggaaaattgtttccgagagtgattcgtgatggcactggcaccggggtaggattaatgaatgccattgtatgatccacttggtcttacagtgtatgacttcttcactacggtccacatgttaggaggaagaaaaaataatgggtttgggaattatagaaatttgtatgcatcttaaaatacatctacctagtttgagtgtttgactattggcgattgctaagcaccctgatgattcacatgctactgaactctataacctacatatggtcaaagttctaatgctatgtaattaatatatcgttccgttacagataactaagattcttctttttatcttattattttgcatggtgtgtgttgtctttaggaaaaaggtctatttttggccctcaaactctgctagaagcccatttcacctgaacttaaaaatcaattttcacccaaaacatccaaaccggacaaacaacacccctaatgctattccaaagtggttttgtttacttggatgtagttttcagtgacaaaaacctgctacttgtaaagtatcgctttatgtggataccacttagatgaatccaagtcagtgaaatttgcctaataggatccatgctagtgaaatcaccttcatatcgaccaaaaccatggcggaatagtgtctagtgtgttatttgtctgcatatggaagtaggggtgaaatttttagtcagggtcagtgaacttcaggctgatttcgggagtcaaaaatagatgccttctctttatgatttttttcagctgaaattggaatattctgttctactctgatcagagatcaagtcaccattttgtgattttttttcttctacttccagaatgaactggccaaaaagttcttcaatgatggcaggtcttttgatttggaaggtgagaagatcagatcaggtgttttaccggggatacagattgttccattttataaactggcatcaaataatcattgtttgaagatacttgattttgttcattgcttcatttactcagaattgttaattaacttaatatcctacttcaatggattttcaatagtaaaatatagactcaaagctttgtacttgtctaattattaatagctattgtcttttgtgacgtaggtttttctcaaacctaatctgttagctttttttatatcttagaagatgtttattattattgtgttttttcctataggtttgaaagcatgcatggtgagggcatatgagtacatcgatggtgttgaagacattctttacagtttgaagcaaaataactatgaagtgcatgcatttacaaattatccagtgtggtgggtttcaacttatcttgacacatttgtacacatgtgcttgttcggttgttcctgaaatatgttctgtaggtaccagttagttgaggagaagttaaagctctcaaagtatttgtcctggacattctgttcatgcacagttggtaatactatttctcagattttatttttctttttaaatggagtaatatattaatatatatgttaacagatcgatgtctatggatcaaatggacttctttatgtcataaaatggttagatatagtatgttggttctttagtgcataaaaccaatatgagctgaacacattgtcaccaactttaatatctttgtaggataacgttttcctactcctcaaacttacatcatgctcaattctatacacacaattttataatcgaatataatatttacacatagttgaccaacgttgagcatgcattgctgtgctgacacagcataaaatcgcctttccagagcaggggtgcactctatctgttaccggaagttgagggggaggtttttatccaattgacagttggggtgaaaattaaactttagaaatagttgagggatgaaaaatagacttttttcctttttgtggtacccttttttaggcaatttagtgttaatatgttctgtaatgtacatgagcccgactagtttgtactaggtgtggcattagcttctatcttgagttggaacagactgatgtagtagcttagtagttttgttattatgtgttaaatgatgaagcataagggaacttgttaagttgtggtgtcttcatgatgggtcattatgatgttgtgtggtcatcaatgatcaaaatgaccaaacttgaatgcaaatactatctctaatttgttgttacaatttcattcttcaggtaagcgcaaaccttcgcctgatttttatctacatgctgtggaccacctaaacgttgatccagcaagctgcatattcattgatgacaggttcattatgatcaattcatgtctggcatggctatgtagttacattgatatcttaactgttttatttcttctctttccactgtcaggatgacaaacattgaagcagcccttagtgtaggaatggttggtttgcaatttaaaaatgctgaggtgctcaagaaggatttatgctcgcttggagttgaatttgcacctgtgcatgaaggtgaaatacaagtccaataaggttgcactttgttaactcttctgctcatgtgtataaaattcatatatctgacccttctgtcttctgaaccttgtcaataacatgaagacccctgattgttgcagatataaactactaatatattttgtttattcaagtgtgcgtattctcaaagcattcattagcttccatgtttccaacaagtaaaggtgaacaaaataccaatggcttggaatacatgccagtgcttaatcaatagaactttaccacaatctctgttcaggataaaaataaatcatcttgaactaactttaggttaaattatttatctatctaatactagactaatccagacaaacttgtgcttggatcaggtgtagctcatgcacacgttgttagcgcttaaaaaatggaaacatagttagctcttaaaaaatccagagttaattaaatgagcaccagattcaagcatagtaatttgcttaaagctaggtaaagaacagcctgagctagctggcttgagccaaaaaaggatagttttgaggaacaagaacaaacaggctcaatcatgtgttaactgttaactcaaagcttgatcaataatccgtcaactcaaagctgtgactgcattttattggttcaataatcaagatcctaagtaactatgttttgtcagagtgatcgccaattaatattcaaggtcttgcattaaattataatggatgatcatatgtatctgttatgctttcataattaagagtatctctgaaactccatgttcctctcaaaaaaaaaaaaagaaagtccacattccattgagtcagagttaattcatggccggtgttcgttgttaattggctatgtatatgctccttgtggttttgtgctttttactgtgtggtgcagatggtaagtggtagtttgaagtaaaccattttctgtttatttgtcacatagctatgagggatcttgtgaaattgattgctattgcaaccattaaattgtctagctctattttggctgtgtagtttccaataaatatttgtgattgatgccaattaatgatcgagagaagagtggattttacaaaaagacaagtaacggatgcctgggactattaagttagcattctctccatttgtgctcctggcttcaggatgtcacaatagttacataaccagttcacttttactcaaactgtaactaaagttgaagtttcttgtgatttgtcatgaccactgcaatagatattataccagctggaaacctgtagctcatgatggaaacctgtggctagagccaaggctgactagttttgtatggatggggacctggggaaaacagcagtcaggaggtgtctgtcaagggttcaaggcctggccaggtacaaagagtttgttgatgttatgactaattgttagtagttaccctcccctttgttggtgctttttttttcctttggcctgttctttgttggtgtttccatttgttcatgttgatcagtcttcctaaatgggtgcctcccatcatatccaaatatgggtccagtgcttattgtagcaatttgagtaatcgtttagtgctgccgttttgatgttaaatagattttatggctccctatggctgatcctttatttgcttgatgttgctgaatttgaacacattttactaggttaacctgctcatgttttgcatatatgtcaccaagtaggttaaaagatcgtaaatacattatttatgaaaatatggcaagtgctgaaaatttcaaatctattaaaacctatatgtacaagttttaagaactcacaaaagtctcagctgaatctgtgttttgagtccaggtaaatttttactaaaaaaaatcaatcctatttaacaagataaaaaaaggacaaattgaagctcttcactatgcactcatttgacatttgtcaagaaatattgactatacctggacctgttatacctatattatgtgtaaattacaaagaaaaactaatatatggctgtaattaccaaagaacaggaacacccacatatggcgagttctgtaaccgtctgacttaaatctcggattactgccaatctactgccacgaaagcttaagctttttttttgtaacaatagccgtaaaaacatttgcttttgttaacaattacccacactttgcatttcaacattttatttgtatggaatggccacaatttatttcttggtcctatgattttcatttaattcaggaatcgagattgcttccagtttatagcttgagtgtgtacttagcttgatttgcatcctattgttgttcaactactgccaatcaatacatcgaattcaagctcattagttggcaaattatggtatatcatacctcaccatgcgtgaatatttttgtcttcttctaaagatgttcttctcaagttgcatgctggcggcaaaataattgtccacttatttatgcccgatctcatatacttcatatactgtttattcctcttcaacatctcgtggtatggtacaaatgatgagcaagatggctgatatcccaatctgtttacctctatcctttttgccaacttgtgctttctacaacttgacatatgagttggattgctgtcaatttactctttataatggtgccaatgatgtcattatcttaggactcatggactctctgtaccaccctatcatttgaatccatgaacttatctccctttaaaagttggtattatatatttggagtcctagttgtgaggacggctaaaggggtagcaatggatgcttagcttccactttaaccaacttacttaggctgcaatattgtcagaaactgagtattaacagaatgttgtcatagcgatgcagatgtgactaacagtgatttagttgtaaaaattgcccacagcgtgtatctctcacctattttctcaaggtaacatggctggctgtgtcgcatttttatcaaaacatatagcgtgatgtctacgggcatcctaagcctattttgtagattttagacttcatttaggagatttttatttcattatttcacttcgagaagagtagaagcgtacaagtcctgctcatataattttttgtgtcattaacttatgtgctgcaatgaaaaagaagaatagtatttatggcaccatatttttttaagaaaataaactggttttatgttgtaaattaccgacacttacatttacattatatttacattacattgtaaattttaaaacttatattgtaattacattttagctttcaattattacattgtagtttctctaactaatacttcatccgtttcacaatgtaagattttctagcgttgtccatattcatatagatgtgtctagattcattgacatctatatgaatataggcaatgctagaaagtcttacattgtgaatgagatgtctagattcattaatatttatataaatataggcaatgctagaaagtcttacattgtgaaacgaagggagtacatgcatgtccattgtaatgggctatgcctatataattagggataagttagtatggtgattgagaataaaacaataaatctggtgggaccgtacgctcccatatagacgcgcagtgtgctagtaggaggggatagaaggagaacgactctgctttttcatattataggtacatactatatatgagaattaagaattaaggttaagtaatcgattatctacttagaataggagagatgaaaatatacttacatataacagatatcaatcacgtaggaaagtgactgaaatcaagtaaatatatgtcatcatatttttagcaaaactgaaaaaaaaaaagaagtcttctataagtaggtccaacatagatactgataattcttatcaggtgtaccaatcaatcacatgctaattctcttaacaagcagacgtgctctgtttttgtaatgtcaatatatcatcgacttaacaattaatatctgtacgtagttaatcaacacggagagctggaccgaagccgtctgcgcaattgcattcatataagcaaaacatgtgatccttggattataaatgggcaaaatttgctacaggacacttaaagattgtggtctttgctgtgagacacccgaagattgtgtatttgctcttggacaccgaaaaaatgtggtaatctgctggcggacactcctcccattattttataatttccagctgaaacggtgaaagaaactttcacaaaagacaattttgcccatgggccatttgtataagccgaccaagtccggctgcaaccagatgtgagaggaggaggaggcagagcagccatggctccctggacgtgctctgccatggcggcggcgcggcggcgtttgtcggtgacggcgcatggctgccgcgacgagcgtcagcgtcggcaagaggagatggaggcgaacccggtggcgcggcatggggctctgggatggcgtggaggtggcgctgcggcaacggacggcattggccggaattggggaagagagagagaggcagtggcgcgagggaaagaaggcttcggccttggagctcaccggcgacggcggcacaggaaggagacggcgatgtccatggcgcagcacccggccgtgatggcctccacgacgcggtagctcgccgcggccacgccctcatcatcgccggtcgggcacaggcagaaccgcgctctgcccatgagctcgccatggtccacccctgccaagaggagaccgtacaccagcacctcccgcacggcgccgccatgcgcgacgcctcctgcagcgaagaacgcgaccagtgtcaggggcaggaaagagagaagaaagaaaatactacaaagaagcacagtgtcaggggtattttggtactttaacactctttctctctctgttttcaccgaaaataataaaataatacatcgagtgtccagcagctaattaccatatttttccagtgtccacaagcaaatacatgatttttgggtgtctcatagcaaatgccacaatctttaagtgtcctatagcaaatgggcaaaatttgatacacatcccccatttggttacatatagtggtaagtactgtacatatcaatcatacgtgcagctgtgcgaccttgcaacaaggacaatgtcaacaagcatgcataacggttttctggtgaagtgaaatcttgtgcccattcctcgcggtctaaccagaatgccatcctgaatgttcattgtttatccttgctcatgaaaaagagaggaaaaaattgattggtgttgatcaggacctagattggtcatatggcaccatgcttgctctccactcttcaatcagtgattgtcaagagatgtaattacattttgaccggtagacacaagtatttttttttcggggaccagtacgagtcattgagggtttataaatgtcggtttcaactaaatgaactaaatcttaatccgcaaagtaacacatgccaatccctatgcagattgtgaagaaatagccaatatttgcgagatcttttcgagaactaactccttttgagatcacgctccggccgaaaatgggttctcacttgtatatagtgtaacatgccaactcctcgcacaaaactccactcgattgcgcacgaattagtctactactccttaggttctccgcaacaccccccctcaagtcatgagccatcatcaacaattcatcatcatcattccctttccacttcgctctcactccaaaaaacacaactcgctcacacttccaaaaaacacgcacctcatcagctttcctttgcttcccttctactcccatccaccactccccctgcctgccctgctcatgtttgcaacaaccaggcccatggccccccaccacaactaactcctcactactgaaacaaaaagaaaaagaaaattacatctcatattctcactcccctctagcatctcagtctatatgcacactgttctctgccacgcggcggcggtgtgggacccacatgtcattcacccataaagacagtttgtgatgttgcttaatcacaagttccaaacgaatgcttgtgtagatcacccccttaaatactctctccaccactccaaccctcaccactcttccagtgtgacacaataattatcttaatttttttttccaatctgtatcgaatttgtagatgaggaacctactgctgctgccgctgctcgtggcggtggcggcgacggtgcccttggcggcggcgctgtcggccgacggggtggcgctgctggcgttcaagacggcggtgaccgacgacccgtcgggggcgctgtcgtcgtggtcggacgccgacgacgacccgtgccggtgggccggcgtgacgtgcgccaacacgtcgtcgtcggggccacgcgtcgtcggcgtcgccgtcgccgggaagaacctgtccgggtacgtgccgtccgtgctcggctcgctcgcgctcctccgccgcctcaacctgcacggcaaccgcctctccggcaccgtcccaccggcgctggcgaacgccacctcgctccactcgctcttcctctacggcaacagcctcaccggcggcctcccgccggagctctgcgacctgccgcgcctgcagaaccttgacctgtcggataactcgctcaccggcagcctcccgccggagctccggcggtgcaagcagctgcagcggctgatgctctccgggaacggattctccggcgagataccggccggcgtctggccggagatggtgagtttgcagctgctcgacctgtgcggataacatcggtcacgcggcggccatcccgccggagactcgggaaagctggctcgcgctcgccggcacgctgaatctctcgcggaaccacctctccggcggggtgccaccggagctcgggcatctcccggcgaccgtcaccctcgacctccgcttcaacaacctctccggcgagatcccgcagtccgggtcgctcgccagccagggccccaccgccttcctcaacaacccgggcctctgcggcttcccgctccaggtcccctgccgcgcggcgccgccgtcgtcgttcaccccgccgccgccgtacgccgccggctccatcagcggcgccggcgggccgcgccagccggtcaagaccagcctcatcgtgctcatctcggtcgccgacgccgccggagtagcgctcatcggcgtcatcgtggtctacatctactggaagctccgcgaccgccgcggcgacggctgcggcggcgacggcgacgacgacgaggaaaggaagcgaggcctcttccccttcccgtgcatgcgcgccgacgactcgtcggacgacgggtcggacgccggcgacgacgtcaagcgcaacaacaccaccaccaccaccaccgccagcggcggcggcggcggcggcgaggaggggcagctggtggcgatcgacaaggggttcaagatggagctggacgagctgctgcgttcgtcggcgtacgtgctggggaagggcgggaaggggatcgtgtacaaggtggtggtcggcaacggcacgacgccggtggccgtgcggcggctgggcggcggcgcggcggcggcggagaggtacaaggagttcgcggcggaggcgggggccatcggccgcgtccgccaccccaacgtggtgcgcctgcgcgcctactactggtccgccgacgagaagctcgtcgtcaccgacttcgtcaacaacggcaacctcgccacggcgctgcggggtgagcacacaccttccccttccccttccccttcacaattcgtgaatttgtttggaaagcgggaaacgtattttctcaaaaaatggagcaaactttggctggattataacaaactttggtaaaacaaaaaactggaattgttttggcccaaagaatatccttcttgcgtggggttcgaaatacattcaattcgaaacatagaaccctggctgtcgcaaacttgcaatcgacacgtccttctcaatcggcaacacctgctctgtttttggtttgcactgtacatgccatggatgcatcatgcaaactatatatttttggtacaatagtttgtaacccccgtaggacccatatgtcaatgatataggtatgcttgtcttatatatcacaatatagaataaggtgagaaagtacccatacctagttaacttggaaattggataatatgaattctaaatttacttaggacaacctaattttatcccctccggtcaataatgttttactttggatagagtatttcttattagaatctgaaaaaggaaattatttgcgggtattgaccatccaatcagaaatatgaggaccatccaatcaaagtatgagtatcatataacagcaccttaccctaccacaagaggaatccaaccagaattttcaccataaacatgaggaaaactccaaccaacccctgcaccaagtgacctagagaaacatgaatacacaagatacccagtgaacaggagactagatgacaaagacatacctagtggctcttccggtactgcaaaactgccactgctgctgttgtttacagtgcatcagtgataaaagcttccaagaaggccaggtaggagtgtgcatggactgttctgcatgcatgcctatttttccatggaccacataaatcagtcacagcatcacagatcagtcctctgccagtgtttgggcactgatgtactgtagtgctgtaccacagtggatgatggtccagttttttctttgtttgccctgcttcatcagtcagagacactgggctcgctgccatcatgaaccatcggcatgcatgcatggttggggttgggtgagctaattttggacaggctttttggtggacaagattaggacgagaggaacatgtgaactttgatgggtagctgtctggatggttaagtatggtgcttagattcataaattcgtatattgacagaaaaattggtccaattttaggcgtctaacgtaggtgatctttatcttcaaacataagcgaagcagactaattcttgaaatgatttgtttgcaaaatcgactatattttcttcatattgtacataataattgaaccgtcttgtatgacatcctaatgttcaaaaacttgtgccgtaataagttagggcttaaaatcgacgagatgataagactgcactaatataagttcacaagtcaatgataattcacatataatttgcatcaataaaaagtcactacattatctttcctagtggcaggaacagggtagggcagctagggctgctgtcctactcctaagcttaaatatctattaaaagttacatttaaaacttcaaaacatggacaataaaggtaagttatgtatattatactagttgagccctaggcttgaaaaaattctggctacgccactgatctttcccaataatacattaaatttgaattatctttccactaagtgagagtctaggccgcatgattggtgttagtaatcaactatagcagctcatgccaaatgctcatcagcttggcacataaccgacagagacaaaagagagaaaaaaatggggctcaacacaaaaggctcaaccaaccgagggggaaaaggtgccttgcgacctctgtctggctgacctttagacaggggaagccaaaaggccctttttaagcctgaaacgctacgcagctacgctgctctgctgtggtcactgcaggcaacactcgcgcagtgcagctctagaacctaaaaaaagttgctctttgggtgcagaaagttgcagagaaaaaggcactacggcaagttattcgtcacacccaagagagaagaaaagtactacgagtagtgcatttcttttgcttccaattcttttgcattttactagtactagactactggcttggtgttgttgcctggctgctctacggcgattgcaacacttttggaggttttaggctcaaggaatggaaattgcagtacaaaatatattttggtgaatcctcatgcattctcattatagtcgtacctagggttgttttgctttagagccaaattttacacaatcgaattgatggcattttaaacagtgattttgcaacgtttcgtttgttaccaaaatttgctatatatgcatattcatggttaaaatattagtagtgccaaaatttaggtaggttttcatttctaagtgaaatgaaatgggcattattgtattgttactgtagcgattgatttgaacgatttgtcctatcatgagttagctaactcataatactgtacacactcactgtagcagcagaggatccatcactgcataacacatcacatcacattaccttaattaccggctatagtaccattattgtactccccaatcagggtgtccattgtcctataggatatataccattgtcctataggatatataccatttaaattcatgaacaggagcttaatatacttcctctgtttcataaatgtaagttattctagcatttctcatattcatattaatgttaatgaatctagatagatatatatgtctaaatttattaacttcaatatgaatgtgtgaaatgctagaacgacttataatatgaaacggaggaagtaccattcagtgaagaaagactattttgttttgaagactatgaagaaaacatcgggcattgatctagaccaacaacttgaaagtcttgaaactaagataggagaagtttttactccctccagtcgaaaaaatatatgaagattggtacttcttatggtcagctgcgttcagctttgaacataactagaaataaaggcgcactacactgtgcctggcagacgatgaatttgaatctgtaggaacaacattgttaatagctataggcatgtttactttgacgttcaataatagcttaagcagaataaaaaatcatgtatataatatatttatgcacatagatgtattaaatcaaagtcgatttccaattacattggtgttagaataggcagaatgaacatgtgtgtccaactcccttatttagccatgaccagggcaccgtaagaaccaaaaggtttagctctattatccttttcattgtgccagcatcatttatcaaatcatgatctgccataccattcagtacacaaatatatcatcgacaaccccaattagatcaaggatattgtcaataggaagaagggatagataagtgcggtgcagggtttactgtgtaagcaaagaaaatatagacctactaaaaaaggcaccagatagcaatatagtcaacaaaagagagggaactcaacagagcaaccagtccgtcagtgaataaatataattcttcttttgtgcgagttaacatccaacaaaaaacccattggatatgctcatcaagctatttatacaaagattaaatcaaatgtaggaactgcaccaatagttgttttagttgatccacgtaccaggaagatgcatagcatggaggcataacatggcataatggtgtaaccaccttatgagaacgtgaacaggaaagaatagaacccgattacaccggttgtttgggaacttcgcccaagaactaattattaccaaatgataaattcatcctttgtaagttgaaatcaactaaatctaacattaatcgataatatggatgggtaattatgtaaatggttggctcagctattttaggtgtagttgaattgtgaaatgcaataaaaagaattgactttttgtagagtgaccatactagttgcctttactaatttcggttggtaaagagttaaattggttttttcctcttcaaacactaacattaggattctgtgccttaggaaatatccacataagctacttcaattggttgtgatcaaatggaagcattgttgaatcaaatagctgttgcacataataaaggaattaagacctcattttatatttaggatacattttatatttaggataaccgacatatctaaatggtatggtacaggtgagttgtgggtcctgctatactaaaattaagctatagtatctgtggttgatgtgctccttataagccttagtttggtcaattaattgattcaatcaaataaccacaactttttggctaagcttatgtgattgtaactaattaagcttgattttctattatccatgtccaactggatcactgtctaccttatctttatttaggccaaatgaaacattgctacatcatacgcatagataggaaaaaataaaactggaggcttattaaacttactttgagtactccagtttaatagcacgctcattggcaacgatctactcaatatgaaattaagatggaatttatgagaagtcaattcttataaatcggcaatacttcttctgacagcagcagaacacacctcttggaataagaccccgtgttaaatcttctcaacaacggctatttttctgcaacatattagtgcaggataatgattaatgtaatgaaatttaaaaccttaaaacaacaaaaaatgcagcgtacaaaatgaactttcaatacattatttccatcatggatcaatggtagatatggtttatttaaatgtgcctattcggtagagaaaagggagatgcaaacatttttgtaatgaataagcataactgaaattcaaggaaaaaaataagtcaatgaacatatacagataaatatagtattttgtttcacaatactgttggcaagcaaacttgagttggtattcccagagtcgataacctgcagagatcatgtacagacctatttgcctcttcagatataacatggtggagaagatctgctcagtttgtctgcatcctatttcctctaaccgcaggaagaaatatatgagaagctatatccaaatgtaggggaaacaatagatctcacttggctaattgggagggggaaaagcaagaaacacaaacacacatacaaccattagtttgaagcccataccatccacatcgaataaaccagaaaaagacagttagcagccattaaaaccaagatcgaggtagccatgcactattttgagcggtggtatctgtaattaaaattatatgtgcaacatacaaattagaatatcaaacatagcacaacaccataattatcaagagatggaatttgataccgacaaaagcagaatgtgtgagtaaaggaagatacggccaaacaatgggtccaatcgcatcaatatgcatgcacaataggaggggtagaaagccccaacctcaccttcggtcctctcacagaagcagtggtcgctgccgactcccgtgaaacctcttatcatgtgtgactcccatgccggcgagctgaggaagatggagagggatcctctaacatgcgaagatgaaagaggagaaaagggtggtaacggctgtcatcctcattcgggtttctggatccgcctgtgaggaggacggggtcgctagacctggtggtcccgggctcctcgctgggagatgtggcggctgaataggagggaagaacgatctcgtcgtggcgacgactggtgaaggatcgtgaggcgacgacacctacccacatgaggcaagcggcggcggcggcgacggtgacaccaaaggagacggcaacggaggtgaaatagggagagccggcagaatagagggaggtggtgacaacggtgaagatgacgtggcggcgacgctggcggagagagcgagagggcagcgaagagagcgagatagctcaagcagttgacgccgtcacggtcgtcggggtcgcggaagaacacctccgacaccagcagcgcgcacacgatgtgcgcccaccgcgcgttcgtcgtgcgcttcacagtgccgcccctcgccgggcagaggcagcagcgtggccacggagagagcgagagggcggcggagagagcgagaggcgacgccgtcgcggccgttggggtcgcggaagaatgcctccggcaccagcagcgcgtacacgatgtgcgcccaccgcgcgtccatcgtgcgcttcatcgcgccgcccctcgccgggcagaggcagcagagagggcggcgaagagagctacagggcggcggaatgggctggagctagggttttgtttggtggctagggttcttggcaaatccaggccatccgttcctgatccaacgatctcatgatggtggaagagcagccacgctgggacacgtggacggccagatcgtccctcgcacgtgatcgaacggacgatagcggcgggagccgacgcacgattaacaggaagtggggggttttcttagcaaaaaaaaacaatggagtggcgcacctagttctccagaacgtgattagccagaggtgaggggtgtttccgaaaaatttgatgacgtggcgagctaattctcagccattaccacggcatttaagtaaacctatattaattgtttactaaaaataggtttaagtttataaactgcaataggtttatacaattctaaagaaaactttttaaaaacaattatatacatacttaatactactatgttttgaaaccaagtgtttagaacttatcaataaagtttcgtaatttttccttctacgtatatcgtgggcatattttctaaacctctaaatgttattttttttacaaaaccctattatatgaattgcttacaatatttttctggaacaacttttaaagctggatattaatacattcatttgtataaagtattataaaaaattgaataacacattatccatttgtccattcaaccctttagaattacgtttagtggtatgttgcctttgagactgaagcggtggcaagcctagggtagctagtttgggcttgagacctaggcttgccttcataatcatacttaaattctcttaatttatcatgtaatttttaagaaaattaatattatattagttaagccctactcagtccttaattttaatttctggtttcgccgctatgtgagaccaattctgctaaccactggtggtaactgatgactgatgagcatccaactacaatagaagtgaatatgcatggtacggctagccacagtgaaaagcgtcccaaacatgtctgtgattagcacgatacccagggcaatgatcagaggccagttccctgtccttgtggtagctatggttgaatgggcagctttctgcctgtgctacaacaactacaagagggtctcctctcacctttctgatgtagctgcactgtacaactattacggtaaattggccgccacattttaattggtaggaacccacaggtttgacttctgattgtaggattacctactgctacccacttttattgttcaggttaggcctccgagagatattaggtgaatattggtgaattagaccatgcatgagaatgttcttccgctatcaattggcttactgccgattataaatcgtacagcttatcagaaaaaaatatatttgtaggtaaaaactttttttatatatacattgttagtgatttaaagtcaaatgctgaaaaataaattataacaaaataacttcggaatcaacttcaaaaattaagtttttaaaatttaaattttgacaatgacttgtaagctagcttatgaagaaaacgatgggagttttatgtgctgaatttgtagtattacggtatagttccatgtagtactagtattgtttaagcactttatatgtttaaatagagagagagatagagagagagagagttatggtgactgatacatgtagttgtgtgtttcacgatctgattttatataggtattaatccggtttaatatgtacatgtagttgtgtttagcgagaagaactaaaaaaagacacgaatattagagaaacatctaatatcaaataattataaggggtgaggcttcgaatccaggtcgtctagcccaccaccctgtggagacccctgagtgtttctcaagcaagaagaacttaatttgttaggttttcagattacccaactttgttatgctcccttcaattttttctgttggaattgtggtaaggatgcacatttgtaattaattgtctgtgtatgatgttgggtgccgtctccagttcgaattaaagaatatcgaacgaaattttaattcaaacagaatgttagtagcctacaacaaaatcagtcattatgtatgcatcgaactgctccattttttattataattagctttgattttttttttctacaagtcgatttctatatgtttggtcaaatatttcaaaataaaaaaatatatattagcaaaatatattcaacactaggtttaataaattaatttggtataacagatgttgcaatgtatttctatacatttagttaaactttaaataaatcaaaatgatttataatataaaattaaggatgtaattaagaagaaggtaattcgagaagctacaaaatgttggttaaatctgatgttttttcgaagtagtttaatgatcctaagaatttttcttcttctttgggacggtgggatgatgtggttgtgcactgcagggcggtcggggcaggcggcgacgctgtcgtggtcggtgcggctgcggatcgccaagggcgcggcgcgcgggctggcgcacctccacgagtgcagcccgcggcggttcgtccacggcgaggtcaagccatccaacgtcctcctcgacgccgactacaacgccgtcctcgccgacttcggcctcgcccgcctcctcaccatcgccggctgcgccgacccttcctccgcctcgggcggcggcctcatgggctgcgcgctcccaccctacgccgtcaagcccgcctccgccgccgcggaccaccaccaccgccccagcgcgtaccgcgccccggaggcccgcgccgtgggcgcgcgccccagccagaagtccgacgtctactccttcggcgtcgtgctgctggagctgctcaccgggcgcccgccggagcaccacgcctcgccgtccgcgtcgacctcctcgtccgcgtcgttctcggggaccaccaccacggtctgcggcggcggcggcggcggcgaccaggcgcaggcggtgccggaggtggtgaggtgggtgcggcaggggttcgaggacgcgcggccgctgtcggagctggccgacgcgggggtgctgcgcgacggcggcgcgcggaaggaggtggtggcggcgttccacgtggctctcgggtgcgtggaggcggacccggagcggcggccgcggatgaaggccgtcgccgagagcctcgacaagattgggtcgtgaggaaagtcgctcagagctgggggggatgatgtgcatggttggtttctctgtttttcttttttttttcttttaattttaattttttatgttttatttttttgccctattattttttttgtcttccttttgcaccattgtaattcctgataaaaatgcaattgttgtagtataatataatatagaatgagaacaagtttatcttctttgtgaaataggaatctgcttgtgaaatctaccaccacactgttgtcctaaattcaatgctacttgtcgggctccttgttcaaaatattactccatccatccataaaagtaaaagtagacatatttcatatttgagatttttcaaataagttattcttattcgtagtttctatgtatccaagacttaaataaaaaggtaaattaaatgtttaatcagagccagatgagctattttaatacttattggttgcatgcgtacatacactccttgatatttgttccatgcaagatgagttttttttttgttggtgacaaaagttatatttgtaatttttatggaacgagggagtactacaacatttagatggtcactgaacaatgcttccttggataatgtaatctcgaccattccaatttgttccccattaaaccaacatcattggctttcaatcttcctcgatcaaattttattgtagccatgtaaaccaagctggccttgcttggacttactgtttattatctgacaatggccaatacttgacaacccatgaatgctgacggaagaccacagtatgaaagctatatatatagccttagagctcatctgtgccacaaatcacagagtactatctatattcgcgaccacattttaggcacattaattgccacaacattttttgccattcaaatcccaattttgcaggtgaaaaataattttagatattttgctagagttgcttccaaaaatttgctaactacttgaagctgaagaagctgcaatatatatgttcagattcacattaccggatgtgacactgaagaagctaaagaagctgaggccgcttcacctgagatctttgggaagtagttgaaaatcttgctgacgccttcggtatgtgattgaaattcttgccggtagaaaatttgaccgagtagcctaaagaaaaaaaatatggccttgccaacaaatactttcttccccttctgttaaacgagagacgaagagagtgcagatgttgaccaatgaaaggatcctctgcacacaattgaagagaaaatgagtggtttttcccttcgatttgtcctcaatgctggtcacctcgtcgatgagcatgttgtagttgtttgaggactattgactgcgtacgcgtttcaccagcgagagatcgtgcgatagtggcggacggcggtgatggtggccgaagatcctgactgctgagcgccgcgaatccgtgatgcaagtgggctggacatcgagtcacaaagaattatgggcatgcgactaaggacggagtggaagagttactgcccatcggatgcacaaaaggatggtgtttcaggactagacgtttctatgacgtagaattcactattgttttctactatagcaacaaactcatttcactgtgcatctccacctttttcctgaaaggcagagggtccggatccatggcaatgcgagatttggggcacggccaagcatcgggaaagggaaaagatttagaaaatcacggagttgcactactctctcgtcttatataaaagaaacctacaacgaatctagataaaaataaagaaacctacaacgaatctagataaaaatatgtccagattcacagttatcaggatgtgtcgcacatggccctaaaacggtattggatccatctcatggagttggatcacaaacactacaactcactatgtttttcgtcctcactttaatgcaaaatttccgaaaattccaaaatggagttaacagtctgcgggctgtcctcctatttatgttgggttgaatggagctggctaagcgaggtggtattattcggtaaacactaactggcgatgctacagtgccacgctggcactgtgggctgctgctactgctctgctgctgttgggccggcttgctgctgctttgctgggctgcacagctagctagctttgcttttcttttttttttctcaattatttgctgggggtgttacacaggatgtatcaaatcccgtactacttggttttctatgggacggagagagtactgtataaacgtttcctatgttcgagggatgattgcacgtggaccgtaattggtcgcgcctccaaaaatcgacttcaattttcacatatggctcattagggcatgcaaaaatctatttttataggcgaatctcttaacgagccatatgccaaaataagcctatttttctaggtagatctattaaacagacgcatgggaaaatgtattttcgtaggttgccctcttaaaaatctacctaaaagtctgacttacctctatttttagtctcagcactgcaattttttcaagttatcatccttatttctcatcctgtctctcacctcctctcctcctcatattatttcaaactcccctctctctcatttctcacctcctctcctctcgctcggcctctcctctctctcccgagcgatggcggcgagctcggcgacggcgactgcaacgcgcaatggccggatccaccgccgccggccctgcgactaccaaccctgcgacggcaacagagatgacggatccggatgggagctagctagggtttcgattttttatttatttttggggattttatttttgcgtgcggacagcataggcacttgcaagcaaaaatgcgattaccgcgtacaagcatgccacccatataaaaaaatagtgattttttcgcacatactttcgggcagacggacggtttaacaacatataaaaataggttttggccgtataaaaaaacagtgcattgcggatcggcgacaatcacgcccaatcatggggaggccgcgctcacctcctcgcagggtgtgtccttaccatggtgagttcgacgttagatcacaatataaccgtttagagcattggatcagccgatcaaatggttgagaaaaagatgtaagctttgggtgattgctagtacaaacttccttttatattaacatatagatagatagataaaaactaatcttatttctgaactctttccttggcgacggctgctatttgtgttgcacgacggtgatggtggtaaacccggcctcacacgacaaaagaccacagcatgaaagctaatatctatggcacatcccctgtggatcttttaaatactgtaagtttatccttttgttcaaccatagttccacagtcgaactatggcacatcctcagcatgaaaaaatagtgaaattgatcgacagacaatggatcttttaaatatctgaaatacacctacaagttctatatatatgtttccaaactaaggatttagttattatgaactgcaaaatcaggatgtacagtctttagttttatttcatttttgaaacgagactttcatgaaaaaaaatgtttggaaaaatattatgctaaatactacatacggactatttgtattaaacagtaccaaatcatcaatttctggttccatcaagaaaaggcatacttttgttgtgtatttgataaaaggttccagataaattaactatgtttaccagattattttactacgaaagcaaatcagccgagtgtatatatatatatatatatccaaatagtcgaaaatacattcaatccattatttcattcaaattgcaaaacacatcatagaaggataaaataacattgatcttgatcatctctaggagttcacaatgaaacatcaatactgaagttccaacaacgcatcaaagttatcaagacggaagatttccgttctatgttttgattattattgctagggagagttcagactaaggataaaccaacattcacccttgtttaattacaatcttttgagcctcgggaagatgttggaccattgtcacctgctggcatatccttcctggaccggacatttcgcttatagaccaaggtgggtttttcctcgctgaaaagttacagtaggcatcaattaagcaatatgaaatgctgcatggattttagcaattacagcaggcatcggtttgggaatatgttgttaccatgcaaattgtgatgtaagaatagcatatatattaatttaatgcaaggattgaaaagtcatgatttgcacttacagaacagtggtttccctctccggtggtatcttcgcacaggcatagcagaatagacagccgcaccttgatattagggaaaaaaaaggtgatgcaagagtttaattagcagcaacaactggacgacacatacaaatataaagtagaccttgtaaatcagacagcgcatattgtttgaagtaaatatgtcacatatgcaatattgataagaggtagactcttatgttgtaattttgtattttttatttgaataaaatttatgccaacagcaggggcctccccaactgtgttctgctaaaaaaacagatacaaatattgcattgatgtagttactgagaatgtattttagcaaaatggataaaaagattcttaaaatagtttacatgagtcaccaaggcaatcgatgtaataccaatcctgaacatgagttttgctcttttgcaattaatctagtgggttgacaacatgtcaacatccctttaccaacaagaggactaactaatagaagcagtgatcagatatagtgtgacactaagagaaatatattctaaccatgtttcaatcttctagcattaatttgagatggcccatggttgggcttttaggacaaaattagtcaacatgacagatgaatctattctaagactgaaggacatataacaaaaacaaaataatttgaaattataaaagtcacaataaactttatgatattatttcatcttataataaactaaaattatattccatctgttataggaaaaatgtctaaatagctaattagtatacctaatgggcacatagaaatctgttaaaaaaacatatatccacagtaatatcgatacaaaaattattgcacaggacaaagtttgtccatccaggaatatgttttctaatcatgatctttctatatggagctttaactagctaaaacaacaaattgctggtaataatcaaatatgcatcatatgaggaatacaaatggcattaatcttcacaccttacaatttctcacatagcaactgttgtttgaaacaaaacaaattaatgcaatgatccactaactacaatatatactgcgaaagaagtgacctctactagtcatgtaagtaaatcaatggatcaaactgtactgatccaaaaagaaaacagtaattctgttccaacaatattggatcaaatcatttaatttcatgtgtcttgtataagtagaaggttgtaggccctatggtctacctctacgatttgcaaacatgcatggtaagaatttgagctcattgcaaactacatgagtttttagtgcaaaatattacatcacgttaatataaaatgtctttgtgttctacaagactgcaattgtgatgacatgtgaagccaaatgaacagcctatttgacaagggaactgaacccatttcattgaccttcgaacctctcttgccctcccctttcacagggtgaaaaaatacagctcaagaggatagaagcaagaggaaaccagccaatatttgcatagagaagacctattagcaaaaaaacatgttatcaaatagatcatttcataagatacatctctcgaatcaaattcacttactgcgcatccttcggatctaaagtttccatcaatagttgaggagggccaaatggactcatttacatagcagaaaacattctagatactatttgtaatgattactaaggtataaaatcactgtacaagttcagaacatgcaaagtaatatgaactacatccagaaaatcagcaataagtaacctaagatggaatctacttctttaattgagaggcaaattcatccagaacaagaacaacaagtgatgtaaacatgaaaactaaataaaaaagaatacgatgtttaccggcaagtgacaatgctgcatcccccagtcaactcaatgaatatgccacatcgagggcatggccgccaaccttttgcaattgccagggtatgcagcggatcaaggcaatcatccctaccaccctccatcccgtccaaagtgaccccttccaaaaattttccacaacttccacacctttttagcatagcagaatcccttaggtttgcagattcccaagctttgcgcacatcacccctgacatgcttgtaccacttctcgtaggtaagctcaccaatagtacatcctggctcagggcagcaaacatgggcatcaccacccaatacacggtaactaatatgatctaaaacacatttgaagcagaaatagtgggggcaaccttcgcaatggaagcgactattcataggcttgtattccatgcatatggcacagtggaatgtcactgtataagattcatcggtttcaatattaaccctcttttccttggtatccatgtttctctcgtggtctgctgtttcggtggacatgctagcccacttaatttatttatataggtgtaaacatgaatgttttccgtgtgatgtatctccttttgcatatctggaagatacgaacaaatcacgggacagctcaacattgatgacatgggttgtcgtacatggctatagtaattaatataaagatttacattggttatttcttcagatacagtctggtacatgtgtgacacagcgaaacaacgtaacataatgtgacgatacgctccgatacacaaatacagatactataactgggctgccaactggaatactattgaaactaccattttgtatcatgttgctaattcgctagttaatttctttagggacccagccagttaacaccttccattgcagtccttcgatatcagttatagaaaattgaaggttctcacatgcacaaccttccatatcagttatgtagccttccctcgaaatgtgaagccagtttttgcctcttgggatagttgggctagcacctgctcttgtcgtttgtttgtgcactgctgactgttcaaaatccttgcaaagaattgcgggtgactaggaaaatttcttcttatcgtgtgcacgatggcatcgctagctctaccactgcttgtaatatactaggattcttattattctactttcagtaagttggtttccaggagctttgatacaagatccttatatcagtgttgcttctattattggtagttgcccacttaggatgcacttttttggcaagcattttgctccatttcaggttttgtttttctttgtagatcaacatcatggcccaagcacgatgaggtagatacgagcaacatcatacccatcaccatggaggatttgaccgaggagcagtgacaagttcttgagaagcaaaagaagaggttggaggtggcggtcctcgcgagctacttgaaaacccatcaacggatttcatagaaaagcggtcctctacccgaatcattttcgatgaggtaaatctcgatgatgtatccgttcgttttcaaaaactcataaaaagcaccatagttgaaactatgaatgctatattcagtaataaacatgaggcaactatgagattttattttaataggaggatagaaaacattatgagttccaaattcggttctctcatgaccatactctaattgagttgttgaatgccatgttagacattgcgaggctttccaagaaatggtggggtgaggccatattgattgtgttatatcttaaatagaatttctattaagaacaaagaagtaacaccattcgaggaatgggaagagaaaaggttgattctcttatatatattggcgtgcctggggatgtttggctaaggtcgatgtgcctatagtcaaaaagctcaaacttggaccaagaaccgtagtttgtgtgtttcctagttatgctatctatagtatgggaaattgtaaattctggggtaacagacatgcatgttggtataattttttagtccagagatgttacatcttttgagaatgaatctccggtgaaagatgaaagatgcatctacatttctagtcaagaacttattatattccctgagtcttttctgctgattgaacacaatgaacaaacgtatgtggaaaatcctcccaccgtcaacaacgccccctcccccgtgcactccctgtgggccttttcatcaacatttccccattaaggtctcttcctcctccaaacttgctttaacggtctcttccttgacagcgggctatcccatggtgggtactgatcaaataaataattacactgataacctcgttcaactttcaacctttcaacatctcttggcttcctcttaaagtgctgaattttcatgttaagatcatcaccatcacctagtctgtcccacaccctagtttgtcccactgaactgattacttcttcaactccttttccacctcctctctcagcactattatcaggtttattcttctaagtaaaaagatgtcttcttggtagatcacgatcaactgcattgcatctctgtgcataatcaggagaactcgctttgctcccatagctgctcccctccgaacctgatcttgctcactgactgctagccgcctagccctctttgttttcacctgttctgcacgcaaccactcaactcacttctgatttttttttaaaaatatcctctttctcggtcttgcatccctcctttgtatgaaataatcttccacagacaaagcaaaagtgagggatttttttcatactgaacctcataccattacccctccgtatcatctgcatccactcggagcttaacagttaataccccttggcagaggttgatttacattcaaattaactctagtttgaaggaacttatcccaagcaataccatcttcatcaacaactacgttaatcaccttcccaaaccatcgggggcagatcatgcacctggacccaaattggtagttcatcaaaggtgatatcagatggtctttgcaaattgataaaccattttgcaaagagcttcgaggttgggaggagacattgttaagttttcagaaaacatatccttggggttttgaccaattgaattaacctatagtcaagttagctctaatactactttgtcacgccacaaactctgataccgctttgtcacgcctaaaaatttagccattttccagatcctattgatcagtaagaaaatttctgggtgtgagttggctcttctcttactttcctagcgtacttgcgtagaggtttcctacaagctaaatcagatcatttttttgcagggtaatgtacgtcaccaggtcatatctatccaaattcgataatgcatttttcttcattgtttcattgcaatctgcatagtaaaccacagaaggataaaattatcagcgttgatctctatcatctccattgtacttacgagttatagaataatacggaaactccaccaacataattgggtattaagattgaagattgtcccttgtttttatatgaattctagagagagttcagactagttgcgagacaacccaataagcacatctgtttctagctttagagtctctagaaggtgttggactacctgctggtgtatccttcctgaacctgacgtttcgcttatcgtctgttggctttcaccacattttgttgttcctattgatggtctctcaaagattcttgtatcagtttgccatcttcctccatctgttgattttcctccctaacaaaaataatacaacagcattaattaataatttgctataaggatggatgtattaaactacgttttccatgcaaattgtgacataaaaatagcataaatttgacataagaatataaaagtcatgatttgtacttacagagcagtgttttccttctctggtgacatttcaacacaagcataacagaatacacagccacaccttgctatcaaaataaaacgtaacatgattcaagagttaattagcaagaacaatgggacaacacatatacacatatgaactagtctttgcagttgagccatagacactgcatgccgtttagtgcaaatatgtacaacagaatgaacagctgtaattactatcaatactttttagcagaatggataaataattattacttttgcaaataaattgaccttgacaacactcacttttccacttgttttggactatcatcagttttaaaggaatcatctagacattgacgaaattcagcaaaatccagagacaaccaatttcagactagaccagctagccagcagagccaagccggccagcctaggaaggaggattggccagctaggtaagagttttttttttttttgacaattcggctaggtaagagttggcctgcctacgacctgcttggccgttgtccgttgaaccaagctgactagccaacaagggtcactattatttggaaacatgatctgatatagccagtgttattttagaaaagatctactgcaatgatccactaactacaagatatactgtcaaagaagtgctctcttctgatcatgtaatgcaagaaatactgatgtaggtaaattctccttcctgtgctttttttaggttcggacaagggtcgctagactgggtattatctgtagccattgcagttctcttcagttctaaggtaagtacataagttagtttgtgctattttcagtgagagcagaactaagtggtgctactgttggtatttcttaacgacattactagatatataattcctagcaatggcgcagaaatactcctggtatattatggttacaaagtttatccgcaagcgcacggatataccattgtagcatttcacccaagagtattttaagggtatcgtatttattttatcccgtgggaagatcatgtagagagaactcgactaataatttatatattacttgtgataatcatattctaagcggggttaagataatccaagcgtagagtgacacacaagcatcggtcactcattctcataatatattatctaagctaagtggaaagaaaagagagaaaatatattcctatacttctagtatacatagtatacatacattctagttatctgatatactagctaataccctctatctgatgccctcatggtacttcgagaagccactctgactgccgagttccttacgacagcccatcatgaccatacaactggggctaaataaggaggaataccctccccagggaattaacttaggattatatacacgcgcggatccaggaatacccgtactgagctgtcaccatcagcggcccacctctcatccgcagcatataaccccaaataatgatatcccgtaatctagacacaacgtctaaactactagatactactctaatatcattgtcatgatatagagtaattgcataagcaaacattatatctgcaccaaagcatctcccagataagctagccgtatattcagtataacatgaacataatgtaaagtaggcattcatatactcggaaagtatttcaataccataaatgtatatagaaatgtattctaataaaagtacaaagcttacaaaagaggaaagggaagctactagagccataccagaactcttccgaagacttccggactcctgatttctactctattcctattccaccagctagatactactaaactaaacttgagagaatatgagagagctttgcttaaggtgtgtgagtgaagtgagaaggtgatgggtttatatagtctcccaatgacggttgtgacggttggaatggtcggaaataccctccaaccgtcattgggagctaatccacaccgtccaaaagaaaccctgcatccaacggcgcctgggagggtttggccgaacctcttggttcgactgaaccaggggcccgcccaaccagcccaggttttggctggcggccttctctgttgatcctctccttaaacttgtgaattttggcccaattcatcgtgtcaattctgagttcttggcctattcatgcataagtctgattgtcgacatcgtccgattgatttatggtttgggttgatgtcgattctcctctactttatggttattctctgcaaaaggttagaaaacctaatactagtggaatattattattctaacatgtttatgcattgcaagcatcactagttctcctctattttggtaatattgacggtcgaaactgatcgataacgaccgtcaacagctaccttaattatccttaggatcagaaggtacatctgtaccaggtgatggagcatcgatatgatgtttgttgctcaggctgcaccatgccttttgccttgctaaatggagtatcaaattagattgcgtgtatcatagcaggacagagcatcccatacgaggaagatagtgtagagatgcattgtgaatggattttaacattgccgattatcacaaatatcatccagaaatgaacatggaaaaactatgatttaactggaaatcaaaagcaatggcatgagctcacattcatggatagttgttgtacttcctactgttctgaccaagaagattatattaacaatggaactaaactttttgcttgcaaatttcagtaatggaaatacaaaattttgagaaatggaaaatcaaagtaaatttaatacttgaatcacatcaagaaaaaaaaagagaaaaagatacccacctctgcaagaccaccacaacaccttctataactttgcaagaccaatctgtggacaaatgaatcacattattcacagtgacatgtaagtaagataaagggataaatcaaattactaaaagatcactaactatggggctgcatggaatcaatctattatcattgggctggccagaagaatctataaaacaaaagtgcacatcttatttttatatactccttttatttccacagaagctatcagttacaactatctttctccaatagccaccatgttaatttaacagagtataaaatggcatcattaactaaaggtcaaaacataaaagcattagaagatggacatgcagaaattttacattgacagaataaacatgatttagtgcagcatcaaaaagtgttgcaacaaaaaggagaaacaggattgttggtaccttagtgaagcaaagccaccatcaactttgagaggatttgtggcagtgaattgcaatgccactaattaatcaatatactaattaagcagtggtctatcacaatgtatattcggtattttccatctacctaaagtgatgattgaaaaggataataaactgatttcaattgtacacctacctccctgggtaggcaaacataaacacggttcaataaggaatacacattaaatgcacatatgtgaaccatcgaaccaagccataccagttttatcctggtcttgttttaccctacaacagaagttatgaccttatgaaagcattataagttttcgccagtgaaaaatagtgcatgccatcacatgaaattttttgaagtaatcatcagtgacatgtggggatgagaatctgataggttgaccaattctatggtagaaaaataatcatcaaaagctgattttcgtaaagaacaatacaaactacctgtgcattgaactacccaaatatcacaaacctagatcatgcattataaatgaatatgcaattcttcatataagatcaattagatataaccctttttcttttttgatgaaaactaagtgatagattatctggtaactttaacaccgtgctagaagagcacatatatggttaaaaccatcaaataagtaaatacctgtgaaaatcggacctaaaagttttctaaatttatgagaaaattactagagaaagatgtaggaatgtaatacatcctcatcaaatcttaagttataactcaactttacttgggagtaaaaaaacaaattttgggtaaatagtaacatgacactaatcaactgaattttgtctttttccattgctctcaaatgaagttgagtttggactatagatttggtatgaatatatgttatgcctatacctatctctagattttttttatgaatttagagaacttttaggtatggttttcacttattcgaaggttttcactgaatatttccccgtgcaagaatcagagaagtgaaattaaataacaatgatttcttcatcaaccaattagtggacaacaatacatgtctttgatcttgcacaaattcatcatgttttctttgaaccttctgatatattaatcacaaaccaataatgaaatccattgtaaggtggcagctaattggtgttgggaagtttaggcaacttaaaatagaatcaaagcaatagatggattgtggaacaaacactgagataaattgattttatacagtgcaaaaagagcagatatatagtgagctttagccatcgcatccaaaaaaataccgagagaagtgttggattattctcttaaataggaattagtcaaattgcataatactactagttggttaatttggttgcttattgctgcttaagtttctggcacaaattagcttagcttagttgtaaatgagtgataatgggctctagaatacacaagtgagttgtatgcttttgtatggtggcatggtaggatgcaaagaaaattttactagttagcaaggttgtacagtgtactagtagttttgttggtagcttgtgcttggtagcaagctatagttttgagctataaaaagccactgtaggtcgattactgtaacaaccgcctaaaagtcctgtaactggacatgtagccctctatgaaaacaagtatgggagtctatgcttgtgaaatatatgaaaatgcagctcctttggtgtattctgttatgggagtctatgcttgtgaaatatatgaaaatgcaactcctttggtctattctattatgttgctgtctattactatttgtcatgaaagaaattcatcttgatcttagaaaaccaacaaaaagcactacaatgcatatcattattttttttggtaccaaactaaaggtttttacaaacatatagagttatgatccagatagtttagttgttccaggttaggcctaagccttcagagacatgataatatgaaatgctactgttggtaaagaatgaactaaaaatgcaaagctatagtctcttttgattaagatgcatgactacatttggatgaagcatcatcaaatcatccacaaaagtactgtaaattgttatatgttgccggaaactcaaatcagcatactcatactttaactacaaagatatatcaatttctcatagctaaaaataggtttcgcgcaatgctaaactagagaaaataagtgtgcagaaaagaagaaaaatggcaggccctaatcaaccctttcaaaagatccatatcttcaatcaaattcaactactacccatcgtctagatgtaaagtctccatcaatagaagaaggccaaatggactaaattacatacaaaaactatcgagacacatctctacatgtaagtattactatgctacaaacatgtgagattactcttagttgagataaactactactagcaaactaacaatcagatattcaacccaaacaggcacaccagagtcatgtcgacaagaaaacttaaaagaaagacaactagaatgtttaccaacaagttaagatgatatatcctccagcagataaatgaatatgtcacggatagggaacggccgccaaccttttgaaacaaccaatctatgcatcgcatcaaggtagtcatccttgacaaccaccattccttccggtgatccattccaaaaatttcccacaactaccataccttaacactgaatattcccttagaagtgcaactttcgaagcatttcgcacatcatccaagatatgcttgtaccacatctcataggtaagtcaccaatattggatccaggcacagagcaatgaacagggatatcacccctaattacatggtaactaatatgatctacaatacagttgaaccagaaatagtggagacaacctttgcagcggaagtggctatgcttaggcctatattccatgcatatgatgcagcggaatgtcaggctatgagagtcatcggtcacaactggaaccttctcttccttggtctctccatgttgctctggtggtatgttgctttggtggctttatttgcccacacatttatttatatataggtgtaaacatgaacgcttttcatgtgatgtatctgtttagtgaatctagagatactaacaaatgattggacagctcaaaattgttagtattggttgtcgtgcatggctctagtgattaacataaaagatttttcattggttatttcttcggatataatcagatacgcttgcgacaatggaagagcaaatcatctgggaaataaatacaatcagatatggtggctggactaccatttggaatatttatttacttaatgctaatcttcaattttacttggggacctccatttaacaccttcaatgataggccttccatagtggagaaatccaggtttttcacatgcacaacattctatatctgttgcacaatcttcacttctaaaccaattctaggactagtttggtgtccacctgggcttgccccctgtgtgtgacaccaccgacttctggaaacttgtgatgccatcgccagcccataaatgaccataactatgttacacaacaatgaacaaaagagcatgttttatagttagattcgatttttatatatttgagaaaatggtattgcgccatgagtattgtgtgttttgttttttgcaagcgcttgtgcaaattcacgaaaaggaagcacatatgcattcaatttacagaggaccaatgaagatgattggggaacatagtggaaaaagcccgaccggttggtgacccggtcaacctttttgctggtctaatgatatgaccgatggatcggcgatcgaaccgcggttcactagcatacatgttgtgtacatgtttcaacactaacacattcacctaaatggtaggatggctacatgagtttgctttcaacctatcgatctaagttcgactccccattcacatgccttttcatgggattttttgccaaaaacaaaaaaaaggtgttgtgaggcccaaaactaattggaccatctggtggccccttcactcgttgacctgccttagtccaatccgaccagatgtggcatattgcccggttcacctcaaaaccgaatggttcgagcggtccaaagcggttcaattacatgtccagtctttctattcaactaaaccgttccaacctctggcttcgttgttttccggttgaaccctaatccagtcccttcttttccactatgtgagggaactggtcaaatcctaccttcaaagtttcttagtgtcaccacatcatccatcgactaagaaataacaagttcctgttgaatatgtccttgaatccaatttgtcctcctgagattgtgcaacttcaaacaaccacaagatttgcatacgatacctcaaattcaatctgggtcaactgcgatcgatagaacaatgacagactattatcggcccattgagccttcaagactagttgttgattttcgatttgaactatgtatcgagtcaactcctcttcatttttaagtgaggtagcatagttttaaggctacataagacctaacgtataaatcaatttagtttcttcatgctctccatagtcaacacaaagaaagcccaataactcctttcatgtgataaactaacaattcctccattcttccctttgcttatccaaaactcctttatatacatgaacctcatagtgtattcaatcaccgagaatctagccatttaatacttagcaaatatgattactcccaatgatcatgccatattttctaatattgtaagatataatataactcttggtttctaagactaagacccacaaattaaacctaatgcaataaacaatagtctatagataaaacaaattaacattagagtttttcaagaggtaccggagattgaacaatctccagtaatcatgcacaagagtgttcctccatttcttgcccagaaagtccattggtgctcttttgttggtagttgttctccactccaaataggcgagctccaatccttcacacaaaccagtgtacctcataatcttcttccaagagagatctagtaagcttagtggatgcatcatcggaaaggataaaactgccaccgggaatagtgttgcacttaatccgttatttcattgcaaactataaaactgttgtcgaaacgacaaccgcatacgtcgaaagatgtggttactcaacagtggttggaaaaacgaagtgtattaaattttgaatttcactcggggatccccccgttacatggccctaggggactatttatagccccattacaggttcttactactagggcttaggttatacaagggaatttacatgattacccttacaaaagggacatttacaggggtacataatgttataggggctcatgggcccctgatgggctgtctggcgatcgccggccctatagcccctaggcttgatgggccggaaaggcttcctcagcccttgcggaggcgaacttgccatggcgaagtcgtcttcctttggcagatagtcttcgccttgcacccttcgcctgagacgcctctggcctggcaagtcactcgtacgactcttcgcctcacgccgttcttgctccatagccttcgccacgggtttcgacagattcggttgaagggcctcatgccatccgccaacaagcccctcatgggcaagggtgagattggagcttcggccgagaccgtgcaaaccatgtggtatggtatgcggcgccccctttcgaccgatgctcctgccgaaacctacattattcctgtgaatgaagtttgttacttgtgcggctggcattattttgccgcgcttcacctcctgcgattggtggttatatattcccgggccgaacggaacagtattgggctttcccttcgtgggctttttactgtgccgctcggacggtgggaatttaccgtttcgcctacccttgcgacacgtggcgctttattactggtgggtaggcgaacggtcgcccgggtgagctatatattcccaccgctctttccttttcaccgccacacttgccattttaccgcgtgcgttctcttcctccatttctttcttccatagcatctcttgacccctcaagcgtttcggccattttctttcttcgccatcgcaaacgcactgttcgccatggcccctcgcaagccaaaccctgcttcggcgaaagggccggatcccggccgagtcgatgacgacagcaccgcctttttgggggtttctcttatggacgacgtcgagctggtgaagctggtcagctctggggcgttggttgaggggcaggctttcgccccagggaaagccgtggtgccgaaaccaatcgacaatcggacggtggtgttcaccgtcttttttaaggcagggctacggtttccctgcaacgtgttgttgccggagatccttcgcctcttccaggtggaacttacacagctgagcctgtcggcgcttgttcggatcgctattttcgactgggcatgccggacttctgggtttgagcctaacgctgagtttttcggcgccatattcttcgccaccgtgaattcgaagacggtgattaccccagctgggacgaagaagaccgtgttcgggagtgtgaacttcaacgttcgtcccgagcggtccgatctctggccggtgaacgctgccatgtcgaagtgggaccgccattggatggctaggtggttctatcactccatccccttcgaggctggttctgactcgacaaaagccctccggtgccggcgcagggcgatcgcgccgaaccggaaacccaagatcgccgtggacggcgctttggaggcgcggttcgttctgctgcgcaaagtttgctcccgccttagctgccatgacttggtagaggaattctgtatgcttcgcatctttcccctctcccaggcatggcaagtcacggttgatcaaggcgaagaggttgacggtttgccgaacctgattcttcctgagaggacgaacagtaagacggttcttttgctatatactgctgtgctttgttattttgccttgtctgacttttaacatggctacacacttttacttttgcagtgttaaccctcgactaggctgaaaccgaagcccgcaggatgatcggcgacgtatcggtcgtcgagtatagccagctgctaacacgacaagcgtctgggcaggcgaaccgggtttgtaacggcgagttgcctcctcgggcaaacccccacaaagcggacgacgatgcagggccttcgcaaaagcgaatgcgcaggcaagtgaagcttgcccctaggaagcgaagggtccttgcttcgtcggactccgacgccgacgacgaggacgatgccgaagaacgcgacggtgagaatgaaggagaggaggaagaggaggaggccgtggccgataaggccgcgaaagaggcgatcgaagatcgcgtcgatacccccggctacactcctaccccaagtccaggtcacaacgagaccggggtggagtcgaacagctccccccttcgacggaaggatctggaaggggcgaaggctctagttgcgttctccttgggaacggtggcgaagggaggtccggtgaagaaggtctccaaaaagaaaggactcgtcgacatcgcccgcgttttcagcgacgacgagtcttctgacgagactccgacatcgcctgctggccgcagtttggacctttcgactgctccccttgcttcgctcagcgttgctggggcaggcggtagccccgccgccggggcttccgcctccgccgaacagatcgtgtcggctgcggcgagggttttcgggagccctgtgcgtgagccagctatttcgccgctcctatctttcatctagattcttgcggctcactgttcgacggagcgaaccgtgcgggcccgttttgacggttttaagagccgtcttcgggccaaggatgatgaaataagccgcaagaacttggaggtggaggccctggcccacaccctcaaggaggcgaaagctgaagtcaaacgccttcagtccgaattggataaggggaaagaggccaggggcgaggttgatcgcctcaaggccgaactggagaaggagaaggcccattcggcggtgctcatcgattactacaaccttattgagccgaagatggaggctcttcgccagaaggctagcagggccgaagcgagcgccgcggaggagtcgcagcggttttcgcgggagatggcgaagaccacctaatctgcaagaacggcttgccaaacgctccgccttgcccttaccgacatgggcgcgaaggtgcgtggggtccctgccgaggatgcctcagcctttgacttctccgagtggacccagcaggctggtagatcggtttcagactgcgccaccgcgtacggcgattgctgtgcgcgtgtatcggcggccttcaccttaggccttttgcagcagttcggctgcgagcacgtcgccgagttccctaccaacgtgaagggggactgggagattagtgcgtagaatatttcgcccgctcttcgcgcgtggcgaaaacagttctggcagaaagacggccggtccgctgccaagacgcgccttctggagcaactggcgaaggcggaggcggcagatcggtgcgaagaagagggtgcggtgggcgaagaggttggaggcgatgcccaggatcaccctgaggtgtgaggccctccgccctttctttagagttttgtagtttttctccctcttttgcgtttgcctagagaggcaaatgatgtatattcggcaagttgccaccaaaccttaaaaaaggcttttttgtatatttggaatgtatggcacaatgttaaattcttttttgatgattgaagcctttagcatattattacttcgctcatttcgcattatgccatacctcccccttcttttgcctattcttactatataagctgtgttttgctttttctgcgctgtctatcagggggttcgccgaaagttgtgcattcggcccccttccgggagctagcgaagtcaaaacgagaaatttgtggcattgaagggtctgccgaagctgcgatgtccatttcggcctgtttatcgcgaaatggagataaatggtcgcagctataaggtttttaaggttgccgactggctgcgggcgcaccccgggcgaaccttagaagattacgatcttgttcaatcaagacgtttggaggatatggatcgcttttggcgaaaccatcagaagactaaacgtcaggaaacgatctttcaacgtcgttacagtttagtctgtgtttcgccccctactcctcttaaggttgtgtacgatattagtagtgatgacgaacctagttcgcctgaccattccttagggagggatagtgattacgggggcgaaaatgtaatttacttgtaaagtaaattgtatcgtgttgtgaaccttctattcttcgattatttttttttgaagttaataaagaacgtgctttatttccttttcgctatttttcgcatcgtcacattttgtgcttttgttaggttggaacatgccggcccctttgcgtatattagtgaaataggtgtactgacttttcagcttttcgttattcgttttcgatctgtagcattttgtgtcgaaagagacgcttttgcttttatgttgatcgaatagtaacgtcgttcagctagttattttccgagacaagctgttgcggtttcaacgttcggcgagcgatgcttcggccgattcgtttcgcccccctggcctttttcgctgatcaggcgtttgccttggggtttttccacaaattatcaatcacacgaaaaataaaaagaaggcggaggacacagagattttatactggttcgggcctccatggtggataatagccctacatccagtttttttttctctttttttttctcttttttttccttgccgaaaagcttacatagtgccgaagggcttacatgacggtatgtatatttttacaagttggcgatttgggtgccacccattctagacatagaagcgcttgagagaggcggcgttccaggaatggtcgaactcctcgccttcgagtgtcgctaggcgaaaagatcccatcctggacttgtgtttgatgaggtacggtccttcccactgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35363 - DNA, 487 bp, Oryza sativa
ccttcctttcctctcccccgtgagcgccgccgccctccgcgcgtgcgccgtcgtcttgggctgccgccgccgccttcgggccggccgccgccgtctccgcgcgccgccggtcaccgccggcggggtgcgccgtcgtcggcttgcatggccggccggcgtgagccgtgccgagcatgccgccgcccactccttccccctagagccgctgccagtggggcccgcttgccagccgccccctctccctcccttagtgccgctgaccagtggggcccgcctgtcggcgccaccccctcccttccgctgacgtcagccctgggctttattgcgcaataaattgattaaggacttttctttattagtaaaaacgcagtttatcttctaaaattcataagtaattcatccgagctccgtttaagtccattcaagtctcagtaaatcaagaaaaatgcaaagaatccattaaaaatagttttgtttcctgtttcag

SEQ ID NO: 35364 - DNA, 680 bp, Oryza sativa
aataaatacaatacccttggaatactctcgagtgaaatgctacaatggtatatccgtgcgcttgtggatgaactctgtaaccataatataccagaagtatttctgtgccattgctgggaattatatttctagtaatgtcgttaagaaataccaacaaacatttctggcgccattgccgaggaagattcgtaatagagattacctgaactaatagcaggataaccttggttgttttcgcttttattgtgaaaacagggtagtgcatgactggtttcaacttgtcggaaaacttcaaagaaaatccaaaagctttcgtccgaagcgtcagaccgcgagtcgttgctctgcagaaaactctacgacatagaaaccagtcgtaccagcaccaccaactttcaggactatggctgacaagacccttcacgagttcgctgctccctctactgacaatgtggccattgggccgcagatcaacatgggagacgtggatttcgacttgaagtccaatctcatcacgatggcgcaggctagcccattctatggcaagcctaacgaggatgcctgttggtatttcttacgaccacagataaatccgcaagcgcacggaatactgctgtagcacttcactttcgggtgaccccaaaaggatatcgaactcagggaatgtgtgtaatctacct

SEQ ID NO: 35365 - DNA, 466 bp, Oryza sativa
aagaagagttggattcatcagctttccagtatcatcctcacaagcctgatggtcaagactatggaacctatatctgtcctgatggtgaagagagtgccactctgatgcatgtggtgcatatgcttagtgctatggatgcagtaagtgtggagcgagacaaagcacctcatgacagggaaaactggaatcgaggcaagatttgcaagttggagagcaaggtgtaccgtctacagaaggaattagctgaactcaaaggagaaacgccgccgccaacacccaagcttcgcctcgtcgcaagaaagagaacctgtccgccacctcgtctccagttagcttcgaagattcgcgtgatgggtgaagctgtgcccgatcgtgctgaacctgtcatcgacatcataagtgatgaggaagaagaggaagaccctgaagaaagagagccagctactccagaggaagaagatccatc

SEQ ID NO: 35366 - DNA, 602 bp, Oryza sativa
ccaggaaactatgaatctcggagactgtcttcggttgtttctagttggttactcattccacattactcggatcaacggcaactcctccggctgagatgacgtgtccaaggaactttacttcagacaaccaaaattcacatttgctaaacttggcatacagttgatgttctcgtagcttctctagtgcaaggcgaaggtgttcttcatgctcttctttggttcgggagtagataagaatgtcatcaataaaaaccaccacgaacttgtccaggtattccataaacaccttattcatcaagttcatgaagaaagcgggggcattggtaagtcaaaagacataacagtacattcaaacaacccatcttgagtggtaaaatccgtcttaggtatatcttcctctttaatcctcaactgccctgatcgaagatcgatcttggagaaaacggtggctcctttaagctgaacaaacaaatcatcaattctaggcagtgggtatttattcttgatagtcacatcatttagtgcacgataatccatacacatcctctcagtatgatctttcttttcacaaaaatgactggagctccccatggagacgaact

SEQ ID NO: 35367 - DNA, 1408 bp, Oryza sativa
  unsure (1)..(1408): unsure at all n locations
ccagaagctatcaaattattatcagtttagcatctttttcaatgatgagaggtgtgagactaatcacgaaagacattgttagacccgcccataaccgcgggcacggctattcgaatagttttactctgatcagaaggtgtaccactgtaccacaaagacacaaccccacatcatgtcaccatgtgcctcaataccaccacggtatctcgaaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgacccggtccttaattgccatgagcacgaccatcaaaaccatgtgcccacaacccaccattaccaggttttagttggcacattaattaattaactaatcacgattgaccatcgtgaactatcaataagccatcatgaaataatagtgagtcataagatacnccatttatacgagctagtgtctctaagcatggctaagcattctagcactttagctaaaaccatataatgttctagctaatccaattattaaccaagtgacaaagaataggtaatcaataatcaaaaggatataacaaaggcaataggttaattccacccaatgacattcgaaaataaatgcaatagttgaaaagaaacaatagctttaaataggatcaacatgctcaaagggttgtttgggatctgtgtgacttgccttgctggccttgaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcactaatgaattatttttgaaaaggaaaaggggatttattgcgtcagcgggctagggtttggtggaccgggcgcacgggcgggcggttcacgcgaacggacggccgagatttaaccgatccaagatggacggccgagatcgatcggtccacggcggctcacggcggacgaccccgatgacgtcagcggtgacgtcaccgacagcggcggcaggctcggcggagaagacggctcgaacggcgcacgctcgccggcgaacggcggcactaggacgcaaacgga

SEQ ID NO: 35368 - DNA, 20833 bp, Oryza sativa
  unsure (1)..(20833): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccagatccagaaacgaagatagggttaaggtagaacgagatggagggagagagaaagaggaagcaagtcagcacaggagctccccaaaggtggaagcagcaggacaccgtcggccaccgtaggcgagggaaggcggacggagagaccaccggatccgaagctcgccgacgtcactgctgcctttcctcccgccgggtctggcggaggagagggcgccaccgttgccgccgtcaccctaaggatccaccaccgctgggctgccaccgggccaccaccgcctcctctcccaccatcgggccgccacctgcaccgttcgctgcctccacgccgtttgccgccaccgcgcctcccctcccgccggatctggcagaggggagggcgccgccgctgctacacacagagagagagagaggagaagtggagaagtcaggatcgagagaagtggagaagtcgagaccgatcgagagaagctggccttatctcctccgggtgtgggccccgccgggagaagaaatatctcctccggctcggctcgatttttaaaaggtgtcagttcggctcttttaaccaataataaattaaaggtgtcggttttttctgaaaaacagacacctacagtataggtgtcggtttttatatagaaccgacacctataatcaattaaaggtgctggttttttgtgtttttgaaccgcggaggtgggaaaagttctttatgtgtctgttttagcacttccggcacctatagtgccgacacctatttgatgtttcatagtagtgaacgtggccaaggttggtgaagaatgacttgcgctattttattgattcatgatagttggagttacaagttatacgtaaaatcttctgaggtgctcgatgttccaagagttgtcgattaattcacctttcatagttgtgagccggtaggcaccgggtcgagtgacggtgatgactttataaggcccttcctaagttggagatagcttgtgcctatcttttgtggtttacactcgacgtaggactaggttgctgacagaaagagagcaatctcatacattgcggctttggtatttgcgtggtagttgctgataccgggctgactcaatcgtggcctcttcgccgtctccttcagggtggaccatgtctatatgcaacgagtgctcgacttcaccctcgttataagccccataccatggggcctccgagtgcgagcttagttggtaggactgccttggttccatagcgtaagaataatggagtttggcacgctgcccgacaaagtacgatcaaaatacctgaagttacaaggtttctttcagcatccctccattggcttggtggaattcaacctttccaccaaggttcaatgcctagacttggaaatagattctcacattttcaatagttagatctgagatatctgacatgcatgttcgtacaattatgtagtctcgggatgttacttcttttagagttttttttccaatgaaggatacacatagtatttctagccaagcttttgaatgcaatgacaaatttatctaagaaaaacttaactctaataggataatgactactgaataaataggctctagggtcgaccaagtaccattggatgagtccctaatagaatccaacacgatacagggcctgatgggcctaaatacagtccctaatgaactccaacttgataaatgacccagcaggcctaaaatatggcgacgtagcactcgtacatattctggaagtcagttttttctactattcctgttgacttatgaagaatttaaaaagaattttgatgtgagactaggtccattggaaaggagattgatgaggatacaactagctcggatataaccatgactaccttatgtattaatcaacaaaggtgcatatgttctatattagatttacttgttatatgtttgaacaaacgctgctacacaatgagttttgtgtgtttttgtttgcagcggtgcttgcttgggcgaaagaaaagagaccaagcgtaaagaatgcatggatgattaaagaagttgattgggaccaaaccaagaccttctccaagtattctttcatctcaccatgtcacttttggtccatagaagacaagagataaagttctacatgttttggattcggattcgggcctcctgacagcatcaacttcaaacggacccagtcacaaatctagaaggaatttcggggcccatgagtacttgttggaaagcttatggagtctaccttcagatggttttggttccacgtcaaactttctaccgagctactaggaatcagcaaaacaaaccgcgcacctcatccagtccgaatccaatttgtgttttgagccttgtaattgtgtcgtgggcttagcccaagggggtgtgcgccctagggcaaccctaggacgtccctaatcatacttaatcagtagccatcgtttagagtcaggttttgcttagattattctgttaagagcagtttcgccgctagatcggtttgtggaaccccaaattcgagtgcttaatcattcatatgcaatttggatgcaatctatcttgttcttgcttgtgttcttcgattcacatgcagggattagctttctcggcgaggtcaaccgggtttcggcgctattgataaccagaggatacgtggtgctgcgattgcgtggctcagtagcgtgttcgtttagaagccggatcgagttgtgtcatgactccgtccaaatcgactgtttatcaatacctatcagaagatcgggacctaacatcccttatcagtgatctctttaggttttcatacatacatatgtagcacattgggagtctgaatgaattctgggcaacgattttagtgtgtgctgttcctgggtttcaaggcaggttcaaacttgatatgaattagcccttcatctcctagcatctctccaattgcttattaaaaaaacagagggaacatatgtaagtaacaagacactacctaagcgtgaacaacatttagtttagccaagatgcttacctgtaattttcttttcttttgcaatccttgatacaatcaaagacgtatgcgtgcacgtacacgtgcatatatatgaatgcatatatttccatcacattatacaatcatagaaaggatgttattccgcactaattaagctgatgcttctcgcgatagagttcagtcccactaaatacacgtgtttgcgtgttggtgtgtgcattgttatggtagatcattgttacgactaattattatttcagtgatagacgatgtattcgtcaatagtgagatatctatagtaacatggtgaatctcaagctatgctggtcctcgaacagggtcggccctggccctatgcagctaaggcaaccgccgagggcccatgatggtggggggtggcaactctgaaaatttaaaatcctttgatgaagtgatctttggtcgcactgcaagatttttgcggaaatatttactcatgagaactcatccgatgttgagatcaatgatttttatttagaattaaaggtgttgcaaatgagtttgccagattccgcctgagattgtgaagtttgttatggatgcagattgctatccaaatatttcaattgtctatcgaattctcttaactgtacctgtgacagtagcttcaactgaaagaagtttctcaaaattgaagttgttgaagaactatttgagatcaactatatcacaagaaaggttaaatggcttggctatgtgctctattgagaaggatatcttagacactattaattttagtaccgttcttgatgattttgcatcaagaaatacccgaagaagtatcttttcatgagaagtaatagatatgatgtgatcctattcttcattaaggtaatgatattagtttcaatgtacaaatgtattgttattttggtcaactttatttctcgataattatcatacatgttaaatttaatgtatggatgtatttattttcgttttgtaagtaaaattagcgtatatatgtatatcataagattttatatatagcttagaggacccatcatgataagttcgccaatggccttcaaaatcataggaccggccctgtcctcgaagatatgcacatagtttgtagggtgtacatgcatatatagagagtgtgtatgcatttatacgagcgtatacatctattgtgttccaaaaaaaaagtgggtggaactttatataatcacccatgtgttgctttgcctaattaattagggtcaaactcgatgccaatcagaagcggatgtaggattggttgaaaggaggactgatcttctttctcttccttcagttcccctacgctcattccctttcctcttcttcccctgcattggatccgtctttgtgctagtggctttacaacacaacgcgactattgtggtaaatttctctctctcaatttgttatcatatttgattgattcacacctaaattaatgtactagtataggttaattatagtcattatttgcttctgtacatttgcgtatgcagtaaaccaaatattttaagacatgatattgtttgtttcagaaaataaatgaataaacatgtgacttgttagactctggacgtgtttagaatcaatttttttttcaaattttcaacttttccgtcacatcaaatatttggatacatgcattgagcattaaatatggatgaaaaaaaccaattacacagtttgcatgtatatcacaagacgaatcttttgagactaattacgccatgatttaataatatggtgctacagtaaacatttgctaatgatgaattaattaggctaatgatggaatctgtaatttattttgttattagtctacgtttaatactttaaataagtgcccatatacttaaaaaaaatttggcacacgaactaaacccaacctctatctagtgattgaaaattggattggcaaaatttgccctaggacatccaaaaattgtgtaattggctgagagacactgtaaaatctcgttgctgctgatagacaccacaaaatttgtgtaatttgctataggacacccgagacaatattttatcatttcttatcaaaaagaggagagagaaatttcaaaaagacaaaattgcccttagctctatctaatccccattgctggcagccgcttcccagcgtcgctcgccaaccgtcaccatcgaagccaccgccgccggctcgctgatcatcatcgaaactatcaccaccgcccgcttcctagcgctgctcgccgctgcctccatcaccacagtcgtcgggctcatcaaccatcatcgaagcagccgccgccgcccgctgctgcatcctctgtcacctccgccgccgcctccacaactagcgacaacgccgcctccaccgccggtgctgccgcctccacaacctgcgacgacgccgcctccacaaccagcctgatggcatgcgacattgttgttgggcgtcaccgtcaggctgagtgctagatgcgtgtaggcgctgaagatcccgcatgagaagaacgcccgcagcgacggcttgagcctcgccgcgccggcgccggcgccatccgatccaacctcctgaagtcggcctggagcagccgcgctcctggtgtggtcgcgctgctgagcccggccgtccttgcgtgcgcagcgccgccccagcgccgccccggcctctagctctggcaccacctctcgcatgaccgcgcagcgccgccccaaccaaggcgctgcaccagcccacgccatcgccagcgctttccctctccctcgggctcacttgaagattaaggaagaataaagaaaaataattcgaagggtagaaccgtacttacacagccgtttctctctcctattcctccaaaaataataaaataatgtcgcgggtgtccaggagctaataaccggttttttgtgatgttctacagcaaatacgtgtttttgcgatgtcccatagctaattacacgttttttggatgtcctgtagcaaattttgccaattggatttggagataagaagaaacagtcaccaagtaactaaatgttattgcattaattgtcacgctccgtatcagaagtacgaaataatatctctattttgaccaaattaataaatcgtgtagaatgtggaaaccacagtttaatgatgtcttgtctctaagaaaatcttcatctggccggcaggtttacaaccgaaagattattcaaacgactttaatttgtacttgaaaagtagagcttcgtcctctctattggttagttcaatttaatttcttcctaagagtggaaaacatagcgaacacatttacagatggagtaaacaaagactaatgaatcatagcagtctccatccgtcatattaaaatattaacacaacttaatttgcatctcgttttcatttttgatggatttgcctaatgcatgcgcaacaatgttcatactatcttttgtaaagtacttcaatgatagtccctccatttctaaatatttgacatcgctaacttttttaaatatatttaacctctcgtctaataaaaaaataaataattattaatttattttctatcatttgattcattgttaaatatacttatatgtatacatatagttttacatattttataaaagtttttaataagacgaacggtcaaatatttactaaaaagtcaacagtgttaaatatttagaaacggagggattataaagcaaatgcctgtctctttgcctgaaatttaattattcacgatgttccatatcaaagaaaagctacgactaaaataaattgcaaagctacatcacagacatgatgattacttgtttagtgatcctcttcaactcttaatttgaccgatcgataagcacagtttgccctaaaaaaatagaaaagaaaagccgtattggagaagacaaatgtgcatcataattaaccaattactggattgcttcaacggaaaagaaactaatgttggctgtttgcattttcagatgagctaagcctgctacaagaatcgcagatatatgcttcatataacacgtgagagagcgtgaagccatatctaatgttgtatttgagatagataatccttctacaggttttttttttaaaaaaaaagacagagatgtccttataaacatgattgaactatcacatttcttctagattgctccaacagtctatcattagttagctgcaaatttgctcatgacacgttgtcgcatttgttgagaagaaagataacagaaaaacataagagcagtgtctcttggtgtctcggtttacctttgcgtttttagttaaaatcgctttctcacagtgtcattgagaaaaccggcagaaaacacacaaagactgacttttttggtcaacaacgtactgagacaagctaaaaccaatcgagttttacaaaccgacaacaacagccagctgttttcaggaaatctgatcttgttgactgctttgtgaaccctctactctcagaacaagaagaagtctacacgtggtccgagtcaaatccgatccttgatgcggaagacaaaagaatgtatctgcactctgcatcacgaaatggctattatttcctacgattctaggcaaactggcctaatctttttcttactaaaaagctaatacccactagacatctaaagcctaagtatagtttttattagcactcttaaaaacctaacatataagtatgtcacatcaactcactaaatacataaagctcaacatacaaacatataataattatatctacaatttattccatttcaaaaactaagcatacgcatgctaaatcatgattctcaaattattttataatatttcaatccaaatcatttaatcatttctataatatctaacatatatcccgcagtcaaacgtgggacatcatatagtataaaaaacagttaatgtctagtccacatgtctacaaataaaaaatagaaaatcccttttttttaagaaaagacatacaattctgtctaagcaaaaattgggccaatatgggccgagaataaaggcatgggcctggctaggatggagaggtccaatggccttggcagcgcatctccaagttggcatgtaaagaatgtgcctgttccaaatattatacctacattacaaaggtcgcgctcgccatcccgcgcgcgactgaagacgtgttgcgcacagagaggaggcgacagacggcgcgtatggtttccttttttttttcctgtttttttcttccgtaccttttccagttttccttttttcttttttttcttctcgtatatttttccgttttttaatacgtatgtatgcaaactttgtatacgtataaatacaaactttatatacacgtatataaattttgtatacacgtatgtaaactttttatacgtgtatacaaagtttgtatacgtgtatttttgggttttatacatatgtataccaactttgtatacacgtattttttaggttttttatacgtacgcacacaaactttatatagatgtgtatatcttttatacattaaaagtgcatacatataaaaaattatttatatatacacacgtatatatatatagtatatacatacgtatatacatatatacatatagtacgtatagtagcgcgcggccgcgcgactgatcccccatattacaaatatataataaacaaatagcttataacaaagggtcaaaacaacttagaaatatttttttcaatgaaattatattttttaagcgtggagaaaataatccagggcaaattcatcatgtattaagttgaaaagaaggtattccctccgtttttgtttgacttttttctttgaccaagtttatagtaaaatatagtaacattttcaatacaaaataaacactgtatcaaaatatatttaatgttaaatttaatgaaactatgtatacaatgctaatttttttataaatttggtcaactctaaataactttgacacaataagacagtcaaaccacttgtaacatgtaacggaggggagggaataaaaaaagttttgttactttatacattatttaatagtgaactgtgaaagagaagtgaaagagggggcatatttgaacaacaaaacgatgacaaagagaggaggggtcacggggtgaaagaaagggaaaaggacgaattgtttaggagcatgtaagaaatatgaccgctccggcactccattcaaaagaatgtaattctagaaagagtcaagtgcacgggcggttcttaaacttgtagcgctgtgtcatctaggtctctgtcagggttacgggtcaggcataccctctacccttcgatatacgttacatatcgacatggcatacccacgcgcacgcggatgttttctacatattctaaggaaacctttcacgaaatctacagatgggaagagtccttctcggacagaactgggtcgtcgatatatcgtattgggtctaatatctctgagtcctacttggagacctctagatctgtgatataaaagggacccccccggggagggcatagatcattgaatcttagagccaacacaacccacacagcctacaaagccgaagtctgcaaggagccaagtcatcgagagctagtcgaatccactcaactacgatctcgccggatccgacaagttccatcattccctttgtaatatgtattttccaccatataatcccatatcaactcgattaggactattacctaccaagaggcctgaaccagtataattcttgtcttttgattgttcgatgtcgtactacatagatccttgtaccaacgtaccccaataccctctatatccggtctacgggtatcacccgtcgacagtggcgcgccaggtagggggacttgatactcaaggttctactactatgtcatccagcttcgtcgacaacaacgtcaacaccagcctcagccaagcgctccctgcttcaacaatgctggtatggactcaagtcggtgaaattgtcttcctggtttacaccacgacgccgatctcaactggtcctccaatgaccggaaacgagaacacagtggctacaaaccaaggcgactccatgtcgaaaaatccacccgtcaaaacggagaacggatcatcgacgacatccaagctcgggaaggattctgatacggccaaaccttgtccttccgacatgaaccacgagccggcaaaaatgacttccgaaaccacaaatccacaaaaccaagaaacacaccctgcaagattgctgggttttcctcaacgtccgtgctgaaattcgcgcctgcaaagaacgtggaattcagcgtacttctccaactcgggatgtctattgtcctattcacaagacaaataatcacgacctctcgagctgcaaagtcttcctcggcgccatgaaagatccgtctcctaagtcatacgtccccgtcagggataacggcaaggaacaaggagcgactctggcctcagatcgattcgttggggtaatcgatatcgatcctcacgaaccatcggtcttacatcttctcgaagactatgggtcatcgacaacgagcgtgccgcgggaggtattggctatcgatgacgtcggcacgtcagcgcaagccaacgcagaagcggcgaatcaatcgactactccagcccaacacatcagggccattcaagctatactgagggaaactccttacgatcccgttctgaacgatgacctcgagcgttggacagaacgactacgggaatcagtgaccaacctcagcaacgcgtttgaagaagccgctaccgcagcgcaccaagatcagccgccaactggcgacgccaatggtgaagatccggaacggagggaatcacctcaacgagccactcctccacctcacggcgctggcgatctccgagatcaaatcaacggccgccgagaagcacgacgcacacgagacaatgtaaatcgctctcggcgtcatgtctcttcacggcgccatgataacggaaatcgaggagaccgctcaaacgaggaccgggatcatgacaaccaccacgatcgcaacgatcgcgaacgacgggggccagacaatactggtcatggccgccgccgtaacgacgacgataatggagatcggcgccgagacaacagcgagagacaacgacaggattcccgagatccaggctgtcatcctcgtaatcgtacgctggaaccaagcgacccatcgtcatcatcatcatctgcgtcctcctcatcgtcagacagacatccacaaaggacacacgaccaccgacaacccaccgcccccaacgctgggtgcagggctttcggtcgttccctacgtgatgtccgatgcgagcaccgacccagaagaattccttcaagtctactccacagtactttatgttgccggagcagacgacaacgcgctagcaaactatttaccaaccacgttgaagggttctgcacgttcatggctgatgcatcttcctccctactcaatctcttcgtgggcaggcctgtggcaacaattcgtcgccaatttccaaggaacgtacaagcgccacgcgatcgaagacgacctacacgcgttgacacagaactcaggtgaatcattgagggaatatgttcgacgcttcaacgaatgcagaaacacaattcctgaaatcaccgacgcttctgtaatccgcgccttcaaatctggtgttagagatcgctacactacccaggaattggcgacaagacgcatcacaaccactcggaggctattcgagatcgttgagcgatgcgcccatgtggacgttgcggtaagacgcaagaacgacaagccgaagaccgggggagaaaagaaatcagccacagacgcatctgagtcaagcaagaagaaaaatcgcaaaaatgggaaaaggaaagctcaagccgaagtcctcgcagcagaatacgcgaaccctcccaagcgcccagacccacaaggcaacgacacaaagaaatcttggtgccccatacacaagacggacagacattctctggaagattgccttgttttcaaaaagtcgctcgagaagcacatggcgtttgaaaaaggcaagcgagtacgcgttgtcgagaagaacgaagagacggctcctcacgaatcggattctgcgtatccagactccgacctccacgtctcacacattttcggcggctccacaacgtactcctccaagcgagaatacaagaaagtggaacgtgaagtctgttcgacatggcggggggctgcacccaagatgaagtggtctgagcagaaaacagagttctcgaaagaagaccaccccaagaccgccgttatcccaggacgatatccgatcgtggtcgaacccactatttggaacatcaaggtagcgcgagttctcatcgacggtggcagctcgatcaatcttcttttcgccagtactctaggcgcaatgggacatccgcaaagtgagttgacaccaactgatcaacccttccatggaattactccctaatcatcatccagacctttgggcaagattacgttgcctgtgactttcggccgagccaacaacttccgaacagaacagatcaccttcgatgtcgctgaattcgatacagcttacaatgccatcatcgggagaactgcacttgcgaagttcatggccgcacctcactacgcgtatcaagtgctcaagatgccgagactgaagggaacaatcactattcagggaaacgcaaagctagcagtgcagtacgacaagcggagcctcgacatagtcgagcaaacgcccagcccacccgccacgactgagccacccaagaaagtgagcaagacaaataagacgccgaagccggacggtgccatcaagatcgttccactctccagtgccaatctcgacaagactgtcaagatcgaggcgacactaaacgagaaataggaactcgcgctcgtcaccttcctccgcgataatgccgacgtgttcgcttggcagccgtctgacatgccgggggtccccagggaggtgattgagtacaaactaatggtgcgacccgatgccaagccagtaaagcaaagactgcggagatttgcaccagaccagaaacaagccatacgagaagagctcgacaaacttctcaaagctggcttcatcagagaagtacttcatccagagtggctagccaatccagtcatggtgcggaaggccaacggaaactggagaatgtgtgtctacttcaccgacctcaacaaggcgtgtcccaaggatcattttcctctccctcgaatagatcaattggtggattcaacagccggttgcgagctattgagcttcctcgacgcttactctggctaccaccaaatcagcatgccaaaagaggacgaagagaagacatcattcatcacgcggttcggggtattttgctatgttaagatgccgttcggactgataaccgccaggaatactttctagtgcacggtccagggcgcacttagcaaccagcttggcaacaatgacgaggcttacgttgacgacatcattgtcaaaaccaagacaagtgactcattgattgacgatttgcgggaaacgttcgacaacctccgacgatatcgcctcatgctcaatcctgagaagtgcacgttcggagtaccgtcgggtaagctactcggattccttgtctatggtagaggaatagaggtaaatcccgagaagatcaaagcaattgagaacatgaattagcccacgagactcaaggaggtacaaaagctaaccggatgcatgacatcactaagcagattagtcgctaggatgggagaacgagcacaacctttctacgctctattgaagaaacaagacaaatttatatggacacaggaagccgaagaggcatttattgcactcaagcgctacctatcaaacccccctgtacttgttgctccccaacctactgaagaattattcctctatattgccgccacgccatattccgttagcactgtcattattgtcgagagagagaaagtacagcgatcagtttattacgtcagcgaagctctccatgacgcaaagacaagatacccacagatccaaaaactgctttacgcagtcatcatgacatcaaggaagctgcgccactacttttaagctcacagagtcaaagttgtatcctccttcccccttggagaagttgtgagaaacaaagacgttgtcggccgcattgcgaaatgggtagtcgagctaagccaatttgatgtccactttctgccgcgaacagccatcaaatcctaagtactcgctgacttcgttgccgattggactatgccagacaacaaatcagacaaccaaggcgacaacgaaacatggacaatggcgttcgatggcgcactcaacagccaaggaccaggggcaggatttatcttgacgtctccttccggagatcaattcaagcacgcaatccacctcaacttcagggcgaccaataacactgcagaatacgaaggactactcgcagggatacgagctgcagccgcacttggggccaagcgactaatcgtcaaaggggactctgagctagtcgcgaaccaggtgcacaaagactataaatgctctaaccccgagttatccaagtatctcgcagaagtcaggaagctagagaagaggttcgatgggatcgaggtccgacacgtctatcgcaaggacaacgtcgagccagacgacctagcacgacgtgcgtccagacgagaaccgctcgaacccggcacctttcttgatatcctaacgaagccatcggtgaaagaagttagcggcgaagttagcccgaacacccccgacatcagctcggaggtcaccgaggcagaacgcgccattgctgacatcgaaaccacagacgactggcacatccaattaatcaaattcatcagcagcaaggagttgcccgaggacgatacagaggccgagaaaataacccgtaaagcaaagatctactgtatggtcggtaacgatttatataaaaaagcgctaaacggggtacttctcaaatgcgtctctcctgacgacggcagacacctcctcctcgacatacatgaaggcatatgtgggtcacacgccgccggtcggacattggtcggcaaagcttttcgacaaggctttttctggccaaccgcccttaaagatgcatgcgacatggtccaacgatgtgaagcctgttaattccacagtaaacacacaaagctacccgcgcaagcgctccagactatccctctgacttggtcgttctcgtgctgggggctagatatacttgggccattcccacgaggacagggcggctacagattcctattcgtggcgatcgacaaattcaccaaatggatagaagcagtgcccacgagggaaatcaaggccgacaacgccatcaaattcatcagagggatattctgcagatacggagtaccgcaccgcatcataaccgacaacggctcccaattcatcagcgccgacttccaagattactgcatcgggttgggagtcaaaatatgtttcgcctcggtctctcaccctcaaagcaacggacaagtcgaaagggcaaacggcatagtactacaagggatgaaaacccgcgtctacgataggctcatgtcacaagacaaaaagtgggttcaagaactcccatcagtactatgggccgtacgcaccacaccgacaacgtccaataaggaaacaccattcttcctcgtgtacggctccgaggccatgctccccggcgagctacgacatcagagtacacgagtacagaagtattccgacgagaaccaggaggaacagtgagacatcgatgcaaatcttctcgaggagcatcgtgagcgagttgccgtccgagcagccagctatcaacagtccctccgccgttatcacgagaagcacatccgagcacgcatactttcgatcggcaactatgtcctccgacgagttcaagcccaagcagggtgaaacaaactctcaccaaaatggaaaggaccttacacgatcacacaagtcttgcggccaggcgcattcaaaatcgcagacggcgacggtcgcgaattagcaaatttttggaacattgaccaactacgtaaattctatgtatgagtcaataccactatacctgtaagtacccttacagtatcaataaagcctatttctaggccccatatcacaatcaaagtgttttcactcgatgatcccttactctgatgacacctagcgttgaaacctgtccttatatccctttatgccgtctcgacaaggcctccgaggaacctaagggatcttcggctggggacgcccagagccgataaggccttgttagatcctatagagacaaaagaccatgtaagatctggtcgtgtaagagttctcgccgtgcatattaaccaagccgtgaaatcggaaatcaactttccaacctcacggctgggggctaggatcaaagcttattcaaccaaggcaggtcaagggtccaagagccttatcctccgagaaaactcctccgacgacaaggttagggtctagggagagtgtacgactcaaacggcttaccaaagtcgttaactgagaacacactcttacacacgacgtccaaagtaagatacatttgtttaaggaatatttctttattcacaaaataattcttacagtttttacataaattttccactacattacatctttccctaagatatctgtgacagggcacgagtactaccaagaaggccaacgccagtccatagactggaagatcttctcggccagcggcgacatcgacctcgctagatggtctatctccgccggtgttctccgagaacgagcaaaaccatggcggagaaactcgaggtccaggcgcgggcggtgatctcgtaggcaagccagcacatgccctccggcgtatcggctcgctcgacaacactcttgcttcaaggcctcgtcgatatgcttgctgatgccatcgagttgggcacaggccccgtttagccaagagatgtacccggccgccgactcctcgggatcacagtggactactcgaagttccctgcatactctgaccatggaggcatagcaactcctcaagtaagagttgaaccacacctcgcgacctcggagcgtctccacaacctgctctttcttcacggccagcatggttctctcaagttccgccacttcaaatttcatcttccagtattggatacgacgatcttgatttgcaagggcaccctcgagatctgctaaacgtgacgaccactaagacaagctggatacctcctttacaacataaataacctaatcaggaggtcactaagaggtgaaaaggctactcacttgaggtggccgttgccatcccggcctccgcatcaagagtttgatccacattgtcagacgaaacatgtggttcaaaatcgagtaccggaatcatcgccagtgactcaggctgcccgcgctgctggacatcctcgtcatcaacatctctacaatggacaaaaactcccgagatcaacatacaaaattggacaagggtggtaatcgcacgaacgaaggcggccagagttcaagatttacacaatatataacaaatacaagaagtcctactcttcaaaaagggggagaacagactcccccagatcaccgacttcttccatcacctccttacgcgtgtcgcttgccgccccctgatccaagatctcgcgcagatctagttcaggatgcgacaatcttacacacgcgaggacgtgacacgccccggtgtagatgccgttcgacgtctcctccgcgatcctggccgcatgtttggaggggattttccccatcgccatcactagttccacaagagaggaagtcagcgaaaactcgtcgggattcgccgggatcgtggacttgacgccgcactcctcggcgagctgatggtggccagtataggtgacccacaacgagccacggatctcggagagattgttcccgagttccgacattcggtcctcgagccccttccgttgacgatcgttgccggccaccaactccctcatcttcgtgaggtcctcacgggcttcagctagctcgcgcaccaatctctcagcacgcacgttcgccgtcgccgcttccgacctcgcctccgagatctcgtggccgatgccgcgagtaccagctccgagaaggcgcccatctcgacttggagctcatcccaggtgagaacggccgctggcagaccacgacctgcagcgggatcgctgacggggccgctaggtgtcacctcccggctcccggtcatgggcacgacgcgctggaagctcccccggacatggcccgtgcggccttcgcccgcgcctccctacggacgactatgaatcaaacaccatttgaacgaaaagcacgagaatccaagaatctatttacttacttctcgccgatcgtcacaatgcgctgttgtcgtggaggtggaggggacgtgtctgaagcctgaaagacaatcaatacagagtaagaagaaaccctccttgctgcacgatctggcgacaagatgaaattaccgatggggtcgctgccttgcgacgatgtccgagtacagacgagaatttcctcgccttggtcgggactttgccaccgctagtggtggccgtatcatatgcctccttgacaaccttctcctttagagatgtcaccacctgatggtccgcgagcggcctgatgatgtcagtcaaaggaagggcctacgcttaatcaggtcataacgtgatttcgaaaggagaatacgagatgcttatcaaatacacttacgttgatggcttcatcgcgttccgccgcccccttttcacaaaggggcacggggatgtagctagccgtggtcggaccgctgatcatgtcacgtcccaaaacgaccctaaaatatatcctttaaagttatgcctagaataattaaaatccatgtgaaagcctccaaaaattaaaatgtgcaaagttaaaagtcaaataaggcttggaggatttttgtatatttcctaaaagcctaaaatgtgtaaataaattttagtggaattttcagagcacaaataataattattaagaaaaataaacaaagttgaaaaagttttataaaaagaaaaaccctaaaaagtcccccttccctcccttgggccggcctggcccatctttccccccgctctctctgtcctctcccccgcggcccattcggcctccctccccgcgcgcacgccgctgacaagcgggcccgcccgccaccatcgctgacgggtggggcccacccgtcatccccaacctcccgccgctcacgccgcctcgtccgtgcctagcgccgccgccgccgcgaatcccgccgcctcccgtcctccccgcgtgcaataaagtggggggaatcattccccgtgatcccctctccctttcccccatttttccctctctctcttgcgttcaaacgggcggatttgcccccgcaaatctcgccggcgccattgatggcggccggacctcccgcgccggtttccttcctcctcggccgccctctcccccttccaaccctatttaaaccctccccgcacttcctccgaccgtttccgcctctcgccgcccttcctcctcgctggattcgagctcgcgacgtcgctctctctctccgccgtcgccgccgagctccggtccgccgccgtcgtcgccccggaccgcctcccacctcggcgccgcctccttcggcttcgccgcatcctcgccgacctcgtccacccctccgtttcggtcgccgaccgccggagcgccgccgaccccgtcgacccgagccgcgccaccgcgtccctccgcttctgccgcctcctccgtcgccgccgtcgcctcggggtgagccgtggaccgccgcctcgtttccccctttccctcccctctctcggccgccactccgccgtgcctatggccgccgccggcgaccatagggacgcgggcgcgccgcctcccgccgaccgcgccggcatggccgccctcgggcgcgccgagtggctgccgcgtggggcccggccgtcagccgcccgcgccctcgggtgcggctgacgtgtggggcccacggcgccggccggtgtgagcccgggtgcacccggtccaccgtggaccgtgaggctgccgcgtgggccccactcccgtggacccggtccgcgcgcccctccccctcggctgacgcaataaaccctttttaaattaaattttaaatgaagaaaatcgcaaatattcatttaaagagcatataaacttcaaatggccataacttggccatttgaactcggaattggaccattcaagtctctattttttccttaagaagtgaagaacccatttttgtgctttgttcctgcttgttatatgaagtttattagagtaaaagcgttttctttt

SEQ ID NO: 35369 - DNA, 6612 bp, Oryza sativa
  unsure (1)..(6612): unsure at all n locations
aatgtggaatggttggctgggttgggcttnggacgagctaggacccaaggtcgggtgcccagttcggtctgaatcatcgtagccctggggttaagccaggttcgtgtgggttcacgcccttgattaataatattgtatacctctagggtcgtatttataaaatagctttgagcaaccaagtgtcttttaatgctgtttactgcaaaccctaacccctatattatggctcccttgtactcccttgcatttattctgcacttatggatgtgtcttgttgagtacggtggttgtactcagtcttgctcaatttttcccaaacccagaagaggagttcctggaagatgaaggctttggtgtctagctcatgcctgccgtcaagcgcctgtggtcgtcgccctagtcttccgctgtttttcgtttgtcttcttgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttatttccggtcgtgacaagttggtatcagaacctccttgaccctagaacgagctttagatcccaagccttagcaatattttcgaaataaaaatccttccttatttgtgaaaatcctctagtctctctctgtcctgctgcttcatttatcgtcaaaatctgatctttaaaatgttgcttttctcttttgtttttgtttgtagatggccggcagcatcaaccgtcgtggcctggacctgactggcttcgttttggagctgcggagcatgtgcgttgtcctagggtatccgcatggagtggactaccagggcaaacagctcccggagcaggagggtgacgatgcagagccccacgctatttgggaggtcactgcagtgatcctcactggctcacccgagaggactttattggcagtcaccgcgggtggagattctttccccgccgcttgccagaacgccgcactcctcgccatcggcactcttcaccagcgctacccggacgagttgcagcactcgccgtaccgctaccaccctcgtcgcggaggagcccgtgactacgccaccttcagggatgctagctcggaggatgacgctaccatcatgcacctggcacgcatggtggaggcgtatgacgcagcccgtatcgacttccatcatatggtgcgccgtgggttggtcgagaacaacatgaagatcctggagctgcgtcaggagaatctgcagctgaagaaggacttggacgcggtggaggcgcagctgtgtcagctcaagatcgcccaatgagaggtctgtcgccccaagcaccgccgcgtctgccgcagcatgaagatcaccgcccgcaagagtacctccaggcccgagcttgttcgtcagtccttggcatggacctgcttcgtcgagacccctcgcgccgagcccgcgccctcggttcattaggaggcgggagcctctggcgttggcagcacggaggatgcgctgctgctcaccttccgccctggcccgtcgcagaagtaaacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaaccaatttaatagcagtaataaattcaagaattatggtggtcgtgggtggttagttttaatagtcagctctctctgtttgccggttctgtgtgggattttcagatggtgacaaccaggagaagtgctgctaccggtgaaggcagtcaccccgaaggcagcaaccacaacaaccatggcagcccacctccacctcctcccccgccaccaccaccaccaccaccagacaccaactccatcctcacccaaatcctcgcccagcaggccaacatgatggctgctttcctccatcacatccaaaatccgccacagcataatgttccacctccatcaccacccccgcaacattctaaactcgccgagttcctccgcatccgtccgcctaccttctctagttccaataaccccgtggatgccttggattggttgcatgccgtggggaaaaagttggataccgtgcagtgcaacgatgaggaaaaagtcatctttgccgctcaccaactgcagggacccgcatctctatggtgggacaacttccaggctatgcagccagaaggacagcctattacttgggcccgcttcaccgccgctttccggaggacccatgtgcccgccggagttatggcccttaagaaaagggaattccgggagttgaagcaaggcaaccgctccgtgatggagtatttgcatgagtttaacgacttggcccggtatgccccagaggatgttcgggaagatgaggaaaagcaggagaagtttttggcaggaatggaccctgagctgtccgtgcgtctggtctccggggattatcctgatttccagcgtctggtggacaagagcatccgcttggaagccaagcacaaggaactggagtcacacaagcgtcgcttggcaaatttccgcaatcaacaaggggctaaccaaaggatccgctacaccaatccctatccagggggatcctcctcgcagcagcagcagcagcagcaaccacgctccgcgccccgacctcaattcgtggtgcgtgtcccacagccgcagcaacagcagagtcagcaagggacccgtgcgccccgtcctcatgtgccagccgtgcagcctggacaaggccgcagagacgctcaaggtcagcagcgtctgtgcttcaactgcttcgagcccgggcactttgcggataaatgcccgaagccgcgacgccagcaaggccaagcgcctccccgccccaacaacggtggtaaggatgtcattcggggtcgtgtgaaccatgtgactgccgaggatgtgctgacgactccggacgtcatcgttggtacgtttctcattcattccatccctgctaccattttgttcgactctggagcttcccactcgtttatatctgtgccattcatggggagaaatcagttgggggtagaaaggcttaggaaccctctgctcatcaccacccctggaggggttatgacagcaaagtattatagccctgccgttcctatagaaatccagggaattcctttcccctcggatttgattcttctagacaccaagaacttggatgtgatcctcgggatgaattggttggcacaattccaaggagtagtggattgcgcaaggcgcactgtcactctgtaccgggggcctgatcaaccggttgttttctttgcacccccaacctctgtcgacaattcagaacttcatcagattggactgtcaaaaatccccatcgtccgtgagttcggagatgtgtttctggaggaactacccggtatgacgcccaagcgagagattgagttccggatagatcttgctccaggaaccactcctctatacaagcgaccctaccgtatggcagccaatgaactggccgaagtcaagagacagttggaagagttgaaagaaaaggggtatatacggtcgagcacttccccctggggtgctcccgtgatttttgtggagaagaaagacaagacaaagaggatgtgcgttgactacagagctctcaatgaagttactatcaaaaacaagtaccctcttccccggatcgatgatttgttcgaccagcttaaaggtgccactgtcttttcaaaaatcgatcttcgttccggatatcaccaattgcgtattcgtgaagaagatatcccgaagaccgcattcaccacgcgatacggactgtatgaattcacggtgatgtcgttcggtctgaccaatgctcctgccttcttcatgaacttaatgaacaaagtgttcatggaatacctagataagtttgttgtggttttcattgacgacatcctggtgtactcacaatcagaggaagaccatcagcagcatctctgtctggtgttgggaaagttgcgggaacaccacttgtatgccaagcttagcaagtgtgagttctggttgtccgaagtcaagttcctagggcacgtgatatctgctaaaggagttgctgtggatcccgaaacggtgaccgccgtcactgattggaagcaacccaagacagtcactcaagtccgtagctttttgggtttggccgggtactaccgaagattcatcgagaatttctccaaaattgccagacccatgacgcagttgctgaagaaggaagaaaaatttgtgtggagcccgcaatgcgagaaggcgttccaaactctcaaagagaagctggtttcctcgccagtgttaatcttaccggatactcgcaaggacttcctggtgtactgtgacgcttcgcgccaaggattggggtgcgtgctcatgtaggaaggccacgtggtagcctatgcctcacgccagcttcggccccatgaaggcaactaccctacccatgatttggacttggccgctgtggttcatgctctaaagatctggcggcactatctcattgggaatcgctgtgaaatatatactgatcataagagtttgaaatacatcttcactcagtcggatctgaatcttcggcagaggagatggttagaactcatcaaggattatgatgtgggaattcactatcatcctggtaaggccaacgtggtcgccgactctctaagtcgaaaaagccgttgcaacactctcggcgtccgtggtattccactggaacttaatcaacagatggaagccctgaacctaagcatagttggtcgtggattcttggctacgctggaagccaagcctaccttgcttgatcaaatccgcgaggctcataagaatgatccagatatgcatggactcctcaagaatatgaaacagggtaaagccgctggtttcacagaggatgaacacggaaccctatggaacggaaatcgggtatgcgttccagacgacagggaacttaaacagttgatactttaggaagctcacgaaagtccttattccatccaccctggcagtacgaagatgtacttggacttgaaagagaaatactggtgggttagtatgaagcgggagattgcagagttcgtggccctttgtgatgtgtgccagcgtgtcaagggagagcaccaacgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagactacctatgaagggaacaaactagccgaactctactttgctaggatcgtaagtctccatagcgttcctaagaaaattgtatctgatcggggaagccaattcacctctcatttctggaagaagctccaagaagagttgggtaccctattaaatttcagcaccgcgtatcacccgcagacagatggacagaccgagcgtctaaattagatcctagaagatatgctttgggcatgtgacctagatttcgggaagacctgggataagagtctcccctataccgagttctcctacaataacagctaccaagccagcatacaaatggcaccctacgaagcgttgtatggctgcaaatgccggacaccgctattgtgggaccaagttggggaaagccaagtgttcgggactgatatcctgagagaagctgaagataaagtcagaaccattcgggataatctaaaggtggcacagtcccggcagaagagttatgcagataaccgacgccgtaacctggaattcgcagtggacgattttgtgtacctatgggtcacgccattgcgaggagtacacaggtttcagacgaaagggaagctcgcacctcggttcgtgggtcctttccgtatcattgctcgacgcggagaagtagcttaccagttggagctgcccgcctccttcggcaacatgcatgatgtgttccatgtgtcgcaactcaagaaatgtcttcgagtgccatccgagcaggccgattcagagcaaattgaagttcgcgaagacttgacctacgtggagaggacagtgaaaatcctggacaccatggagcgcaggaccaggaactgggtaatccgtttttgcaaggtccaatggagcaaccacgctgaggaagaagcaacttgggaacgtgaagacgagctgaaggcagcccatcccgatctcttcgccagttcttccgaatctcggggtcgagattccgtttaagggggtaggtttgtcacgtcccaaaacgaccctaaaatatatcctttaatgttatgcctagaataattaaaatccatgtgaaagcctccaaaaattaaaatgtgcaaagttaaaagtcaaataaggcttgcaggatttttttatatttcctaaaagcctaaaatgtgtaaataaattttagtgcaattttcagagcacaaataataattattaagaaataaacaaagttgaaaaagttttataaaaagaaaaaccct

SEQ ID NO: 35370 - DNA, 2135 bp, Oryza sativa
gtggggccaggccgtcagccgcccgcgccctcgggtgcggctgacgtgtggggcccacggcgccggccagtgtgagcccgggtgcacccggtccaccgtggaccgtgaggcttccgcgtgggccccactcccgtggacccggttcgcgcgcccctccccctcggctgacgcaataaaccctttttaaattaaattttaaatgaagaaaatcgcaaatattcatttaaagagcatataaacttcaaatggccataacttggccatttgaactcggaattggaccgttcaagtctctaatttttctttaagaagtcaagaacccatttttgtgctttgttcctgcttgttatatagagtttattagagtaaaagccttttcttttccgttggtcttgtagacgctgcagcttcagaagatccgctcttcgtggaggttgaagccgacgtttaggaaagcgagcaaggcaagtcacatcatccttgaacatattgaatcccaatttataaaattattttgatttaaattattgcattatcgctttatttaaattcccgcgttatcactgttttatttagccatgcctatttacctttgttatgatcttattattattgctattgttattattaccttgttcaccctagaataaacaaaaccccaactagtggacactctactcatggtaccactagtatgaatttaggtagatgcttcgccgcttaattaggcaacattaggtggttttacaactctagactttaggaatattcatatcacctggacattatggaatggttggattattgtggaattggattcacacctccccctctattcaaaaccctcaaaatggttttaggctgggctcggggtgcatggttttgatagtagcacctcggccatataaggaccggtctttgggcctctgttgcaaagcactaccgtacttccatatgtctagtgggtaaggcttagtttgtggctcagtctggttataaataaaagtacacggatggagatggacgaagtcggggatcgatggacatctctagggcaaatgaaggctacacgagctgcggcccggtagtcgagatgtcatggcacagggccggtgtcctgctgctaggggctcagttgtcacaccctaaaaatcctaaatatataaattgttgtttaattagaattattagaatttattttaaaagtatagaaaagaagatctaattttaaataataaattccaatataaaatggggccagataaaatttcattaaatactttgcttaattctataattcctagatttttctgagatttatttgagctaaggaagtatttttaataaatggaattgcatttcatgaataatttaaattgaaaaaggtttttaaaatcctcttttggctttgggccgaaagtcggcccaaaaccttctttctctctccctcggcccagtcggcccagtcagcccgcagccgcccgcgtgagcgccctcggccgctgacaggtgggtcccacctgtcagactcgtcgtcctcctcgcgccgtcgcccagccagaaccctagccgagctgcgtcgccgtctccttccaaattcgctcgcgcctttccttctccagtgaaatcaattgaggggaaatgtttcccgagatctcctctaccttttctcttttggaatcgtcggctaaatcgtttggaaatccgtggattcgagttcgattcggatcgatctctctcctccgaaccctaaactttccttcgcgtcgccggtcgccgtgggccttcgccgccgcctccttgcccctataaaaggacccccaagcccaccgctacctgccgcaccctcgccttcgcctctcgccgcccgtagcgccctagccccgtgtagcctagcgccgcagtcgtcgccgttcgtccagtcgtgcgccgccaccgatcccgtcgtcgtcgttgctcgggaaagtcaccgtcgtggtcggcgtcgcgtcgccgtcctcgtccgcccctccagcgctgctttagaccgccggagcaccgccgtcgtcgtcaagccgaaggttgccgccgcttctttctcattgctgtcgccgtccgttgatcttccgccgccgctttggtcaccggtgaattcg

SEQ ID NO: 35371 - DNA, 10620 bp, Oryza sativa
aagtggaaggaaatcggtatggatttcatcactggtctacccagaacatcattaggccatgactctatttgggtgatagtcgacagacttaccaaagtggctcatttcatcccagtaaagacaacctattccggaagtcggttggcggaattgtatatggcaaggattgtgtgtttgcacggcgtccctaagaaaatagtgtctgatcgaggcagtcagtttacttcaaagttttggaagaagcttcaggaagagatgggttctaagctgaactttagtactgcttatcatccgcagacagacggacaaaccgaaagggtaaaccagattttggaagacatgttgagagcttgtgctttagacttcggtggaagttgggataagaatttgccttacgccgaattctcgtacaacaacagttatcaagctagtcttcagatggctccttacgaagcactgtatggtcggaagtgccgcactccacttttgtgggatcaaacgggagaacgtcaggttttcgggacggatatcctgagggaagcagaagaaaaggtgaaaatcattcaagaaagattgcgtgtggcccagtctcgtcataagagttatgccgacaatcgtcgtagagatctaagttttgacgaaggagattatgtgtaccttcgtgtcacgcctcttcgaggagttcatcgttttcacaccaatggaaaattggcaccgcgttttgtgggaccttataagattgtcagtagaagaggagaggttgcttatcagttggagttacctcaatctttggcaggaatccataatgtgttccatgtgtcgcaattgaaaaagtgtttaagggtacctaccgaagaagctaatcttgaacagatagaagtccaagaggatctgacctatgttgagaaaccaatccgtatcttgaaaatagatgagagaagaaccagaaatcgagttatccatttttgtaaagttcaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctaaaaatcctaaatatataaattgttgtttaattggaattattagaatttattttaaaagtctagaaaagaagatctaattttaaataataaattctaatataaaatggggccagataaaatttcattaaatactttgcttaattctataattcctagatttttctgggatttatttgagctaaggaagtatttttaataaatggaattgcatttcatgaataatttaaattgaaaaaggtttctaaaatcttcttttggctttgggccgaaaaccttctctctctctccctcggcccagtcggcccagtcagcccgcagccgcccgcgcgagcgccctcggccgctgacaggtgggtcccacttgtcggactcgtcgtcctcctcgcgccgtcgcccggccggaaccctagctgagccgcgccgccgtctccttccaaattcgctcgcgcctttccttctccggtgaaatcaattgaggggaaatgtttcccgagatctcctctaccttttctcttttggaatcgtcggcttaatcgtttggaaatccgtggattcgagttcgattcggatcgatctctctccttagaaccctaaactttccttcgcgtcgccggtcgccgtgggccttcgccgccgcctccttgcccctataaaaggacccccaagcccgccgctacctgccgccacccttgccttcgcctctcgccgcccgtagcgccctagccccgtgtagcctagcgccgccgtcatcgccgttcgtccagccgtgcgccactgccgatcccgtcgtcgtcgtcactcgggaaagtcaccgtcgtggtcgccgtcgcgtcgccatcctcgtccgcccctccatcactgctgtagaccgccggagcaccgccgtcatcatcaagccgaaggttgccgccgcttcttcctcatcgctatcgccgtccattgatcttccgccgccgctttggtcaccggtgagttcgccgtgccgtccgctacccctaggtgctctccgttcgcgctgtcgtgccgtcgttcgccggcaagcatgcacgcccgagccgccgccggtggtggcgtcaccgctgacgtcatcatcgtcgtctcccgtggtcctgccgtggaccggtcgatctcggccgttcgttttggatggaaagatctcggccattcgttttcgtgagccgccgccgtgcacccgattcaccgcgaaccctagccgctgacgcaataactcgcttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaatatatccacatgtactgttcatgcttgtttatgtgctgttttggtgattttgctcctttctgtttagattccgacgtttccggagagtccgtttttataggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgttggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcactggggagtccatgccttgtttataagggggtgattatgatccaggaaaggtgcgctgtggtggattgtgttgtgcgaggggtactgtcacagctcctttccaaggtactgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcatcataataaaagatgctataactggtaataatttgattagctcctggtttggaatagtatattcctggtttggagatagatctgtacagccgggtatggttgttcgggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctacgtggcttgctgagtatgtcatatactcaccttgcaatcattcatcagaggaagagttctacagtgatgctgatggtgtggaggattaggtgtagccctggtcaagctgcctgtggagtggagtcgtctgcgccatttatcttttttttttctgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccaggcgtgacaagttggtatcagagcctccttgaccctaggttatgccaaatggttacccatagaagccctctaaaaatattggaaaagtagaattgttctcctccctttctcttttaattaaaccaaactaatagcacatgcacttcataatctcttttagtggttgtcattcaaaatttattccagtgttgttagtactgtacatctaatactgtactaatggctcatttaccagcaaatgttttgcaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggttttgagggatttgtccaggagttgcgtaccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggctgacactgagtatcgctaccatcctcgccaaccccagggaagtgaccgtggcagctaccttgagactgaggggattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttgaagaaggaactagccgcgttgaagggagaagcaccaccgcagaaggccaggattcatcttaccgcaaggaagagagctctatttgtccctcgctaccaattggcgccaaaggtccgtgtggtggagaaagaagttaccccagccctagcggatcctccggtcgtcaatgtaagtgatgatgaaggagaagaatcgaagcgcacccattcaaaggtcgagtggggagctactcaagatgatggagacgagccgaacgagccttcaatcaacttcgatgcccggaagacctagagtgccttgttaagccgttgtcttagatcgttgtgttagtttgttcgtttaagtttggttgtgtgtgtctcacatgtgatttacattagtggtgggatgtaagtgcatgcgtttgtttgcttttgagtgttaggaagttggtgagtttagtggtgtgagagtcttcagttttgtaataatgaaactcagttaagatcagtaaaagttaagttagtagaaaaattaattctctgtcctaagtagtttccccggtttctcttcttgtgatcctgcccatgccagatggtgctcactcgcagcaatgggaatggtcccaacaacaccaataacaacaacaatggagagaatcccacactggcccaagttctggctcaacaggcacagcttatgaacatgatgatgcagcaactccagaatcagtagaaccagggaaataaccatgcacctccccagaacaagttagcagaatttattcgtgtgaggccgcccactttctctagcaccactaatcctgttgaagctggcgattggttgcatgccatagagaagaagttggatttgcttcagtgcactgatcaggagaaggtctcatttgcatcacatcagctgcatggccctgcctctaagtggtgggatcacttccgccttaacagaactactgctgaacctatcacttggcttgaattcaccgctgctttccggaagacgcatataccatcgggagcggtgtctctcaagaagaaggaattcaggtcgctcacccagggatctcgcacggtcaccgagtatctgcacgagttcaaccgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttcttcgtctgttgttcgtccgcagtgtcagttcttcaacaacaatgctggcaacaacatccgcaatcaagctccacgccctgttgcagctccaacacagcaacagcctgccaagagggagcaaggtagcaagcccggggtgtgcttcaactgtggagacccaggacattactctgacaagtgttcgaagccccgacgcgtgaaggttgtcccggcccagagcaactctaccgcaccagcatcaaaggctcgtgtcaatcatgttgctgctacagaagctcaaggtgctccagatgtgattttgggtacgttccttgtcaactcagttcctacaacagtgcttttcgattctggtgctacacattcatttttatctatgagttttgcgggaaatcatgggatggaagtagaagatcttatacgtcctttgatggttagtaccccaagtaatcaagcactctctttgcaacgtagcccctctgtcagaatagaaattcaagaagtaccatttctggccaatcttatcctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtctttaaggtcaagactgaaccaaatgactttggaagagattcctatagtccgggagtatcccgatgtgttcccagacgatttacctggtatgccgcctaaaagggatatagagttcagaatagatttggtaccaggaacaactccgatccataagagaccttatagaatggcggccaatgaattagcagaagtcaagagacaagtagatgatttgcttcagaaaggatacatcagaccgagttcatctccatggggagctccggttatttttgtggaaaagaaagatcatacccagaggatgtgtgtggactatcgtgcactaaatgatgtgactatcaagaataagtacccgctgcccagaattgatgatttgtttgatcagcttaaaggtgccaccgttttctccaagatagatcttcgatcagggtatcaccagttgagaatcaaagaggaagatatacctaagacagcttttatcactaggtatgggttgtttgaatgtactgttatgtcttttggacttaccaatgcccccgctttcttcatgaacttgatgaataaggtgtttatggaatacctagacaagttcgtggtggtctttattgatgacattcttatctactctcgaacaaaagaagagcatgaagaacatcttcgccttgcactagagaagctacgagaacatcaactgtatgccaagtttagcaaatgtgaattttggttgtttgaagtgaagttccttggtcacgtcatctcagccggaggagttgccgtcgatcctagtaatgtggaatccgtaaccaactggaaacaaccaaagacagtttcagagattcgtagtttcctaggcctcgcaggatattatcggaggtttatagagaatttttccaagattgctaagcccatgacacgattacttcaaaaggatgtaaagtacaagtggtcagaagaatgtgagcagagttttcaagagttgaagaatcgcttaatatcagctcctattttgattttgcctgatccaaagaagggttttcaagtgtattgtgatgcatccaagcttgggttaggttgtgttctgatgcaagatgggaaggtggttgcctatgcatctcgtcagttacgtccgcatgagaagaacaaccctactcatgatcttgagttagctgcagttgttcatgcgttgaagatttggcgtcattatcttttcggtactcgtacagaggtatacaccgatcacaagagtttaaagtacatctttactcagccagatctgaacatgagacaacggagatggttggaattaattaaggattatgacatgggaattcattatcacccgggaaaggctaatgttgtagcaaatgctcttagcaggaaaggctattgcaatgctacggaaggacgacagttgccattggagttatgcaaggaatttgaaagattaaatttgggaattgtcagtagaggttttgttgcagccttagaagcaaagcccactctaattgatcaagttagagaagcccaaattaatgatcctgatattcaagaaatcaagaagaatatgagaagaggaaaagctatcagtttcttggaagatgagcaaggaactgtatggttgggcaagagaatctgcgtccccgacaacaaagatttaaaagatgcaattctgaaagaagctcatgatactttatactccattcaccctggtagtaccaagatgtaccaggatctcaaggaaagattttggtgggcaagtatgaagcgtgaaatcgcagaatatgtagcagtatgtgatgtttgtcagcgagtcaaggcagaacatcagaaacccgcaggtttgctgcagcctttgaagattcctgaatggaagtgggaggaaatcggtatggatttcatcactggtctacccagaacatcattaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtcttcagatggctccttacgaagcactgtatggtcggaagtgtcgcactccgcttttgtgggatcaaacgggagaacgtcaggttttcggaacggatatcctaagggaagcagaagaaaaagtaaagattatccaagagaggttgcgcgttgctcagtctcgtcagaagagttatgccgacaatcgtcgcagagatttggctttcgaagaaggagattatgtatacctgcgggttacgccgttacgaggtgttcatcgtttccaaaccaaagggaaattggcaccgcgttttgtgggaccttttaagattgtgagtcgaagaggtgaagtagcttatcagttagagttgcctccgtcaatggcgggaatacacgacgtgttccatgtgtctcagctgaagaaatgtttacgtgtacctacagaggaagcagatcctgatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgattaaattaaaaatgcatattttaaatcatttttagaaattattttaaaagcctacaagctaaaccctaattttctaggaaaattttcaatataaaaatgagttagataaaattttattaaatactatgcttgctcctctattttctagaattttctgggaattatttgagcaagggaagtatttttaataattgaaacaacatttcacaaattgttttattcaaaaaagtttaaaaacccctccctaagccgttgggccgttttcggcccaacatcctctctctctcgcgcggccgaaccggccaatgccggcccaagccgacgccgcccgctcccctctctcgtggattccgacaggtggggcccacctgtcggatccatctcctacctccagccgccgaccgagcccgagccgccggcttccacctccaaattcgcctcaatccgactccgattccttcgggtttttgaggggttttggtcctctcgatctcctctttcttttttcccaagaatcaaagagaa

SEQ ID NO: 35372 - DNA, 890 bp, Oryza sativa
gatgactttatttcctatgggttataatttgattagcatgaaccttatatattggattggttcggctaaatgctatatgtaagtttgcttagccatgcttagaaacattagctaacaaaaggagttaaatataaattatattacataattgttattattaattagggttatattcaatggtagctcacgatggtaaatcgtgtgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttctatagcgtgattcattatagtgcgcccgactgagaagtggcgagaagtccatgggggtcgctggggagtccatgccttgttttaaagggggtgattatgatccaggaaaggagcactgtaatgggttatgttgtgcgaggggtattgtcacgactcctttccgaggtaccgtggtggtactgaggcacatggtgacatgatgtggggttgtgtcttgtgggtacagtggtacacctctgatcagagtttaatctattcgaatagccgtacccgcggttatgggtgagttgagcaatatttttcgtgattagtctcacactacccattaatggtaataatgtggtaattaatttgatgcctagtttggaatggataattcctggtttggaggtttaatttgttcaactggggttggttgttcaaatgtggttgggcctatgcaacacgggtgtgttgtatggtgtttatttaatattggttaattatacaactgttttactattctcttaaatatttatgggctgca

SEQ ID NO: 35373 - DNA, 1138 bp, Oryza sativa
attgtgtgcctcggctgattcctggacgagggtttacacacatgtaagcgtttggaattttggatagaaattccgggcgtcataagttggtatcagagccacattgaccctaggttatgccaaatggatacctatagaagccctctaaaaagattgaaaaagtagaactgttctcctctctttctcttttaattaaaccaagctaatggcacatgcagtttatagtccctttaattgttctcattcaaaatttatttattattcctgtgttgttagtactgtacatctattactatactaatggcccactttctagcagagattttacaacctttcatttatttatttatttattcaatcatgttgcaatataatttagcatgttgattttataactctcttttattttatttcttttgaaacctgttattcaaaagtgcaaatttgtgattctgttttcaactgtttcaacttatcttgcaagattggtttactttatttatttaccttttactttgattttctaactttattcaaattaatccaaaaacttgtgctattaattggataaatgtcttaactccctcctttcacttgtctttagatgccgcgcttcaagcctgagtacttgttcggtactgagggatttgtccaggagttgcgtacgatgtccttcgccataggatttgggactgcccctttgtatgcccagattcctcatgaccgtgatgaagagaagtgccgtgtcaaggtcaccttgaacactaatcatgaagacatcccatcgctgatgttcgaggctggagggggaaactacattcatgcttgtcaggaggtggcaaggatcgccataggagagcttcgcgattgctacagtgatcagttggccgacactgagtatcgctaccatcctcgccaaccccagggaagtgaccgtggcagctaccttgaacctgcaggaattgagaatgatgctaccccaaggcatttggtcagatcctgtgggccatggatgagttccgcgctgagattgtgttagctgctcaagatcgtgaagaccggaatcgtggtaagatatgtaagcttgaggacaaagttgatcgtttggagaaggaactagccgcgttgaagggagaag

SEQ ID NO: 35374 - DNA, 785 bp, Oryza sativa
tgtgctcctgcctatgccaaatggtgcttactcacagcaatgggaatggcccaaacaacaacaacaacaacaacgacaacaatggagagaatcccacgcttgcccaagtcctggtccaacaggcacagctcatgaacatgatgatgcagcaattccagaaccagcagaaccaggggaacaaccatgcacctccccagaacaagttagcagaatttcttcgtgtgaggccgcccactttttctagcactaccaatccaggtgaggctagtgattggctgcacgccatagaaaagaaattggacctgcttcagtgcactaatcaagaaaaagtctccttcgcttcacatcagcttcatggccctgcctctgagtggtgggatcacttccgtctcaacaggaccactgcggaaccaatcacttggcttgagttcactgctgctttgcggaaaactcacataccgtcgggagtggtgtctcccaagaagaaggagttcaggacgctcactcagggatctcgctctgtcactgaatacttgcatgaatttaatcgtctagctcgctatgctccagaagatgtacgtacagatgaagagcgtcaagagaagttcttggaaggactgaatgatgagctctcttacccattaatgactggggattatcatgatttccagaagttggtggatatggccattcgccaggaggacaagtacaaccgaatggagcagaagaaacgcaggattgctcacttcaaagctcagcaggggaatagtcagaggccgtgtctt

SEQ ID NO: 35375 - DNA, 687 bp, Oryza sativa
tcccctcttccttttgtcttttggaatctctcgctaatttcgtttggaaatcgtcggattcgagctcgattcggattcaattttctccctctaaccctaatctttccttctcgccgccggccgccgtgggcctctgtcacatcctgatttttgtttcaggatttataaattatttaataaactaataatagaatttatattaaatgatctttaatttacaagtgaagttaaatgtgggaaataaaatttcctaaatataaagcatgaatggatttaatttttttattaaattctccatggttaattacactctctgaaatattctcggatctttcggagctcaattcctaaatgatacaaagaacagttcagtaattatttgataaataatgatctaattataattgttaagagtttttcttgtttaaaaatccttaaattataaattgttgtttaaaaggaattattagaaatgattttaaaagtctaaaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaatagaaaaatgtttttaaatcctccttttggg

SEQ ID NO: 35376 - DNA, 721 bp, Oryza sativa
ccctgacaggtgggccccacctgtcagagggagagaggagggagagcggcggctcggctcggcgggctgacttgggccgggcgcgcttgcaggccaaggagagagagagaggggttttgggccgactttcggcccaaagccaaaagagaacttttaaaacctttttcattttaaattattcatgaaatgcaattccatttattaaaaatacttccttggctcaaataaatcccagaaaaatctaggaactatagaatcaaatgaagtatttaataaaattttatctagcccacttttatattggattttattatttaaaattagatcttctctttctaagcttttaaaatcatttctaataattccatttaaacaacaatttataaatttaggattttcagggtgtgacaaacctaccgtcttaaacagaatctcgtcctcgagattcggaagagctggcgaaaagatgcggatgagctgactttaattcttcttctcgttcccaggtagcttcttcttccgagtgattactccattggaccttacagaaacggataactcgattcctggttcttctctcatcttctccaggatacggatcggttcctcaacatatgtcaaatccccttggatttcaatctgctcaagattagcttctacagtgtgtaccattaaacactttttcaactatgacacatggaacacattatgaacacctgcc

SEQ ID NO: 35377 - DNA, 476 bp, Oryza sativa
acatgtggcttataagattttaccgttgcaattatcacctcatgagctatctctaccatggcatgagaatctacaggttctgatgagacacacaaaagttcatggggtgtttcttgtaaatccatatactttttagtgatctcctcaaattgagatttgagctgttaattttccttctccaaaggtgctacacaagcaatagaattagtgtcacaagcaaattcatttttccaattttttatacctcataattaatgaagaattagatcccttgagtttcttgtgtttatcggctagaccctcgatttcttcatttttcttaatgaggcatgcttgttgcttctcaataaccctcatgagtttgatcaccattgttgtgtccttcttggtcatgtgatcaaccacgaagtcatcatcatcacccatatagcacatatgatcttcagcaatggaagatgaacaaattgatgatgtgg

SEQ ID NO: 35378 - DNA, 1693 bp, Oryza sativa
agcgccctgggcatgttggatgcccccggcatgcactatgtcctgaaaacaccatagtccctggcacacccccttgatttgggcatgccacaagccctgggctcatcaccgagggctttgcctcctgccctgggctcgccctgggtttctctgtatacctaggatggcctagtggtttaactgcagctaacctcatgattatcattataggggctacccgcatctgcatcttggtggtggcaccgtatgtagcctcctacatgccacatcaaccaaaggagtaagagagaggcagcgtgtcacgtcctcaggcgtccaccgcccaatattccatcagctgtcccatgggctgacccatgggctcatgatataactagatggaaacttcttcaaactcagcaccatctaacagttgtgggagaactgacacattcgcctggcatgtcaggagggacattgacaagactaagtatatcgatttcgttggagtgggccctgcttctacatacatgtattggtatggtggactcccattcgcctgtaaaaggaggatccatgccaacgaataaggggttcgattccttagcaattagatctcgtaaaagttaatttcacaattcttagttaatcatataatcattattcgcatatgtatttagcatatgattaatattttaatattagcccatacaatacacgggttgatgactagtaatcacaatgcagcaaaatttttccacaaaatcaatgaggatgaaagtggtaaatgtttaaattaaaaacaagttatggatggattaattgttaaaatagaattttaaactaaaatagaatgatgccccgtcattgcgtattttttttcttacaattctagcaaatgtttcaacggcaataatttgtttcacatagatttcagacttggacataatataatccctaattaatccagacgacactcctattagtctctaggtgatcaggtacacagagatatcggcgaagggcaccaaatcagcatggagcagcttttgctagttgacaagggcgcatgtcctccggatctccccctggctgccggtgagcacgcccaccctgcccatgttcaccattgacacgccaaagtcccggaggaagctctcctccgatctcatgtactcgtagacgagccccctggtaacgtcgttccggagcagcgcctcgtcggagtggaacatgcccttccgctcggcgacgaggccgtagtaggtggcgtcgaaggtggtcgagctgccgggcaccatctccagctgggtggtgttgtccttggccgacctgcactgccgccgcagccccgcggcgtacgtcgcatccagggtcgggtccgtgttgtggtgcgccgtgaagttgcgcagacgcttcgctatcgatgggcagtgcgtgttgcccagcgcgtgggcgcctgaaagttcaaagtgtcatgcataagaatataaacaaagttaaataatctttaagaatgctagggtacactggtagagaaaccatctttggtcggtcgacccatatccacaatagtcccggttccattaaaaaccgggactaaaaatgatttttagtcccggttaataagagaagatctttagtcccggttgttgttaccaaccgggactaaaaatcatctttactcccggttggtaactccaaccgggactaa

SEQ ID NO: 35379 - DNA, 626 bp, Oryza sativa
  unsure (1)..(626): unsure at all n locations
actatagggcgaattcgagctcggtacccctcagataggtgccaagtaaaccacaccctaccgaagcttttgagggccaggaactttagtttagtattctcactactacgaaaaccatttttcgtggcggccattttggatttttgctggcggaatttgcagccgccacaaagcaaagaccagtgaaaatcaagatcttcgctagcggttattgaccaccagcaaaaatctattttcgctggcgttggcttaagccagccgccagcaaaaatccattttcgctggcgttggcttaagacggcgctggcggttgtgttaaatcgaaaatacccatgcagctgcagagcccgccagcaaaaatacacatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35380 - DNA, 412 bp, Oryza sativa
  unsure (1)..(412): unsure at all n locations
ttaatatgtatgtgatatcacgatttccagcattttattgtcaatgatgtcttgtgagaacgaagcaacgcacgctacttggtgcagtgttgagccttgttttacaataaattttaagtcgttgcagtctcttgggcctgagcgagctggcaaacgcatggctgttcggctgttccgcctgtgcagagtactctgctttgtactcttttgttaagcaaaagatgccctgtgtttcctcgagaggcatttacgttggagatctccatgattgcactctttttttttaagttcttttactgtggtctgtggagtgtggactactgcatcgtggtgtgaattcttttannnnnnnnnnnnnnnnnnnnnnnnnnnnnnnnnnnnnnnnnnnnnnnnnnnnnnnnnnnnnnnnnnn

SEQ ID NO: 35381 - DNA, 688 bp, Oryza sativa
  unsure (1)..(688): unsure at all n locations
ggacttggatcgatccatgacacgccatccgataagacccaaatgcttcgtccaaccgagtatgccattgccgaggatatccagaattttttctcttaatcaatttgattaagctcttgttagatgcctcggcttgcccattagcttgtgcataatatggtgaagaattcaacaatttgatacccatgctatcgacaaactgaacaaactcatcggacacgaaaattgaaccttgatcggttgtaatagtttgaggaataccaaaccgatagattatatgttcttgaacaaattgaattgcatccccagaatcaacttttttcaaaggaatcgcctctaccaatttggtgaaataatcagtcgccaccaatataaacttatgtcctttactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattcctnnnnnnnnnnnnnnnnnnnnnnnnnnnnnnnnnnnnnnnnnnnnnnnnnnnnnnnnnnnnnn

SEQ ID NO: 35382 - DNA, 729 bp, Oryza sativa
  unsure (1)..(729): unsure at all n locations
gtatcagttgagtttgatttattaagtcatgcttagaatatcaatctctagcctgccttctggttgccgattagggtagtatcggagtttcagctgatcttatctgatttaattatatttgctttatatgtttcattgacatgttaaatctgccctttatgtcaggatattattgcatctaagtatattaagcttatgtttggtatattctgtttgtttcaacatcttaacatagtgttgtattggagtattagccgatacatactagatctatccgatcggctatgctataaacatatatagttctgttattaatatatatttcaatctaagtgatttatactgtctcgacatggcgaccgatctatcccaatcactcaatttaagtatagatataaaattatatattgttgatatctacagccgatcgagtaggtttagtactttattatctatttataaccgccgatcgatttacatatgacatcggctcaaagataaatgatatgtcatcggcacttagccgatcgtctatcatttataggtttaaccgcggtttctttgtctctatttcttgttgattgcaggatcaaatcaactggcacgctaacacacccgaaggcgagctttggacctgcactagagttaagcagatctcccaggcctcatgttttacatcnnnnnnnnnnnnnnnnnnnnnnnnnnnnnnnnnnnnnnnnnnnnnnnnnn

SEQ ID NO: 35383 - DNA, 748 bp, Oryza sativa
  unsure (1)..(748): unsure at all n locations
taaccacgtacgttggtcctcgccgccacagcaaccacggcngccacngaagctcctagctgactggcaaccgcttcaactgccacctccctcagccacatcgggcgccgccgccacctctgtcggcatcaccgccgctgtgctgcttgccagatccaggcgagtcttgccatgtcgccccatccaggagtacggaggaggaagccacgccgccagccaaccatagggcgccacacctccagccaatacagagcatcgtagtgatggctaggatttgaaaaactgcaactgaatctgaagaaccaaaggagaaggggaggaaaagaaggggagaaggagatgatggagaggaaacaaggagggcgggggtggcgccgctgccggctccaccgccggtgacagcctcgccggtggcagcagggtcggccggtgggagatccttggtggcgaagttttttggtctcccgggttgctccgtgggagcgacacggaagttggttcgactccttccgtcggtcacaacaattggtaggatcttagagaatctcacatgatcctacaaatacaatgatgcccttccatttcacagtatttctccttattataaccactttacctctttcaaactgtttaattactgagagtatggaaactctgaaataacatcttgaattctgtaatgnnnnnnnnnnnnnnnnnnnnnnnnnnnnnnnnnnnnnnnnnnnnnnnnnnnnnnnnnnnnnnnnnn

SEQ ID NO: 35384 - DNA, 14327 bp, Oryza sativa
aatatatgtgccccccctaattttataatgtcaacagcattaataaaattatacaagcaacttagggcgatatagtaataccggccattgcacatcggtaaaccataaccgattacaattggaaaaaaaaaactaagggcgatataacaatatcggccatctctaggcgatgaaaattcatcggctatcatgtatcggcaacatcagccgatcatgcattaacccaaacacttaggtaatatttcttcaaatacttgccatttagtaattccgttcttctagagccgattctaacctcccatggcaaaatagcctcatgtccataaacaagcttatagggagggacttggatcgatccatgacacgccatccgataagaccacaatgcttcgtccaaccgagtatgccattgccgaggataatcagaattttttctcttaatcaatttgattaagctcttgttagatgcctcggcttgcccattagcttgtgcataatatggtgaagaattcaacaatttgatacccatgctatcgacaaactgaacaaactcatcggacacgaaaattgaaccttgatcggttgtaatagtttgaggaataccaaaccgatagattatatgttcttgaacaaattgaatgcatccccagaatcaactttttcaaaggaatcgcttctaccaatttggtgaaataatcagtcgccaccaatataaacttatgtcctttactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattccttcatgaacttcgccgattgcaactttagcctgatcggcactcaaacacttaagtaacactccatcaatcgtccgatagtaaagctcatcatccaatagagtatacttcaacgccttatatctcaatttcctagaagctgattgagatggattatgtaaatattgatgcacatcatacctccaatcaccggctgttattgctgcaatttcagccttaacatctttgatcatcggcttataccccgatgccccctgggccaaatcattagcttcaatattttgttctcgagacacatgctttaaagtaaccagccgaaattcctgcatcagttcttggcacttctcattataaaccattaatgtatcactcttgcattcatattcccctgccaattgactgattaccagcaaagaatcccccatgatttcaatagcatcggcttcaacttccttgagtaattgcaaccctttgagcactgcctcatactcagcttgattattagtcgcataaggttttatagtataagcaaacttgaaacatgccccccgaggggaaattataaccaagcctataccacaatcatgagtacacaccgatccatcaaagaatgaagtccatggcacaacttcaaccgagccgattgaatcatcacaatgttccacaataaaatcggctatagcttgtcccttaatagccttcggcgactcataccttagatcaaactcagttaaggaaaatatccactttccaacccttccttttaaaatcggagccgataacatgtatttgataacatcggctttgcatatgacagtacactcgttagatagtagataatggctcaaccttgtacatgaaaaatacaaacacaagcacaacttctccataggggaatatctagtttcaacatccaagagccgacgactgagataaaatacaacgcgctcttttccatccaactcctgaatcaagactgagccgattgacttctcaccggccgatagatataatctgaaagatatccctttctgtggaggaatcaaaacaggaggagagctaagatattctttaatatcatccaaagccttctgttgctctgccccccaagtaaactgctgatcagcttttaatctcaacaatggtgtaaaaggctctaaccttccagacagataagaaataaatcttctaacaaaatttatcttgccgttcatctcttgtagttctgtcttgttctccggaggctgaatcttcttgattgcattaacactcctttgagtcacctcaatccccctctcatgaacaagaaatcccaaaaactggccaaccgatacaccaaaagcacattttgtcggattcatcttcaggccatattttctggttctctcgaaaaccttcctcaaatcggctatatggtcctctatttctttagacttaacaaccacatcatcaatgtagacttcaaccaaccagccgattagatcatgatatatgtaattcatggctctttgatatgtagctccagcactcttcaagccgaaagtcatcacaacccattcaaataagccgattgcaccaggacatctaaaagctgtcttatgtatatcttcttcggccataaagatttgattatatcctacgtttccatccatataactcaaaattttgttccctgacgcagcatcaaccagctgatcggctactggcattgggtattcatccttcggggtagctttattcaagtctcagaaatcaatgcacaccctgaccttaccattcttcttaataacaggaactatactagaaacccattcagcatatcggcaaggacgaataaaacaagcatcatataatcgtttaatttcaactttgacaggttcaagcatatcggctttgcatcttctcagaggttgctggtgtggtctaacccctggtttgataggtagccgatgttctacaatcgatcggctgagtccaggcatctcataatactcccaagcgaagcaatctctgaattctttcaacagctctatcaacttggctctaaattctgtagataaattcttacaaataaatgtcggccttggtcgatcacctggacctatatcaatttcttccaaatcatcggccgatataaaaccctgtccttgtttgtcatcgagatcatctaccgtgtccttgatgtagacatttgaaccctccacaacgccctcgaaataacagcttgggttctccatcttcaattggctgtatattagaatcggacacttttagaaaatctctatcccaaacttttccagataaacaatcgagaccatccatctcccaaagagctaaatcagcactagcaacattgactgacctgtcggctggcacaatctcaatcttgtcgtcttgccactgaatcaagcattgatgcatggttgaaggaatgcaacaattagcatgaatccaatcccttccaagcaacaagctataagaaccattcccatcgatgacaaagaatgttgtagggatagttttgttaccaactgtcagttccacattcgaaactcctttggtttctgatagattgccgccaaagtctatgagcaccatgtttgtcttgatgagatcttcaacgtttctgcccaactttctgaatgtagcataaggcatcaagttaacttcagccccaccgtcgaccatcatcttggacattggcttcccattgacataaccatttatatacaatggcttaagatgccgattctccgtcccctctggcttctcaaaaattgcctgctctggcaacaaaatcaatttggctgattcttcttcaacttcatcgacatcggcttgcttggtcccaatctcagcaggcaacgtgaaaaccatgttgaccgaagcagttacgacacttttccccttagctaacctttttgcctcctcagctgtagcttcatcggctacaggaacctgattcttaacacgccactcctgcctcgactttgttttctgcagccgatggttaatttcctgttcaacctcctaaaagcactccctgttcctcaatctttgaacccttctcttttgattcttcgtgaaaataccagaaggacaccactgatttttcctgatttcattgtcctcttggccatgatcttgattcactggacccaatctttgatgaacaggaactcttgtctgccttagccgattgcccctaccatatgatcggcttgaattcttggcaatatcactgcacccaggacagtcttcaatagacggcagccttagaccttcatttcaacaaaatctaaagaactcacaacctcaatgaggatcaaaaccatcgtcatcttcttcatgatgcttctcctgctgcttgtcatacttcctctgatatttgttgataatcttagccgaattcacctgaaaaccccttgcacggcccctatcggctgttcggccagctgtatgcaccatattaacaggaaaaggattgccatcaaccttcatcagcctcttagagtcgtcaaacttgattttgcctccctcaatagccgcttggatctgctgcctgaagaccttgcaatcattagtcgtatgagatccagaattatgccacttgcaatatcttttcttccctaattcttcagccgatggaattgtgtgaccggcaggaagttgaatctgtttctctcggagtagcaagtcgaaaatcttatcagccttggatatatcaaagtcatacctttcctctttacctgagttctttacccattggcatggtataaccttcttactccttacccactcggctgcagctatctcagaatcatcatcttcatcatccgatccatatttataagggcaaacatgattaaccttcctagaatttttcctagcctctgcatacctttgttcatgcaaggctaccttctgtgtaagatgtgacaggctttcaaagtcttcagatgataacttctccctaattggagcaatcataccctgaaaagccaaatcggctaactgggcgtcagttaaactcaagctgtaacacttatttctcatctccctaaatctctggatatactcatgtactggctcatcatgcttttgcttgattgacgtcagatcggacagtttcatctcatgaatcccactatagaaatagctatgaaactgcttttctaaatcagcccaactgttaattgatccatatggtaaagaagaaaaccaagtaaaggttgacccagctaaagacaaccggaataacctaactttcaaagcatccacagccgatgcttcaccacattgagctaaaaatcggctaatgtgctcataagttgatgtactatcttgccatgagaactttgaaaaatctggaactttgaaccggttgggcaaaggaactctctcaaaccacttaggatatggctgccgatatagatttccagcatctttcggcctaagcctgaactgctccttcatgacatctgcaatcaaatcggcccatggccactattgaggtgtcccttgaggttgttgtggcatcggctcgaattggttgtattgaagaacaaattggggctgagccgatcctgcttgctggtattgaacatgaggtgatggtggctgatattgataattcaaattgccccctggtaattttgaagatccggctgaatattacgcaccaaatgttcaggaataactagcggaattaccgtgccatctggttgtacgtgatgtactaaatgctctgggacaacctaatttgtagcatgttgcacaggctgcccaccaggtgttgcaaaccctgccgatgaattcattgaaccttgctgttgaatcggctggacaacctgttgccttaatggagtttgctgaaccggtcgtacaactcattgagctaggggtgtttgctgcactggttgcacaatttgttggatttggggtgtttgctgaatcggctgttgcgggttggatcaacagtgttttggggaggcaaaaacatagatgcaacctggtcttgtgttagccgatccacattttgtccagcgtgttgtggctgttctcttatcagcaatcggggattgaccaattggcctggagccgaaggtggtacagtaggtgcgggagccgatgctggtgccatcggctgagccgatggtgcaataaaaggagctgcttgaacggatggatgactgttggtgatcaaaggccgataatttggaaatactcctccttgcaaataaactgggcctgcagcttggtattcagctattgtaccatcgaccattgacttcatcatatttgacaatgtattgactaacatcccagattgattgatcaaagcattgtgcacggcatagtcaacccgatcttggaagttattgaaaaactcctatgatgcattgccatcctgataaaaatttcctccacgcaacccctaagcaacatcaccttgaactccatgcaccccatcaccttgaaccccatggactccttgagaattgtcacgttgacctcctagagaaccgtctgtagcaccattgtcactcggttgagccataccgtccggagcttgtttaccatcttcacctttacaagaactggtcctaggatcatcggaaactacctttactttatacttatgaaccactgttcccttgctagtctgcatgaatgagttcaagaattgatcccgtgcctgctgcatcatcgcgtcgaaatctttcttctgatcaggtgtgaatttttctggatcgatgggcacgacgtttccttcattgacgtcggtcaatcccaacttctggatcttttccttaacagtgcttggactagccgaggatggcgatagcggtggtttctcggccatgaggaagaattgcttgctgacttcttcttggtcccactgggcatgccaaaagcgtgttgacgtaaaacacgaggcctgcgagatctgcttaactccagtgcaggtccaaagctcgccttcgggtatgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatctatcggcggttataaatagataataaagaactaaacctactcgatcgactgtagatatcaacaatatataattttatatcgatatatacataaatcgagtgattgggatagatcggtcgccatgccaagacagtataaatcacttagattgaaatatatattaataacagaactatatatgtttatagcatagccgatcggatagatctagcatgtatcggctaatactccaatacaacactatgttaagatgttgaaacaaacagaatataccaaacataagcttaatatacttagatgcaataatatcctgacataaagggcagatttaacatgtcaatgaaacatataaagcaaatataattaaatcagataagatcagctgaaactccgatactaccctaattggcaaccagaaggcaggctagatattgatattctaagcatgacttaatagatcaaactcaactgatacagcattacgtatgaaaagaagaacaatatctagacaatcaagtcgctggaagtttcatatagtggtgggtatcttatataatctaaaccaacatcgatatttaacctaatcggctgccctctattaacagatgttagccgattgtaggctagatggcgatatcgttagagattatgtaagatatatgataactcggcaaattacataaacaaaattagagtatcataaagatggaaggactaatcccgagaacacaagccgacataacaagttttacctcttgttgaagatcgaaaccgatgcaactcaacccgaaagcaagaaatcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtctttgtggcagacttttgcccatatttatctctaagaaatttacataaaatatcctaattaatagatacaattgccttcccaggactttatccatgtatggcaatcatcttgaagtacgtcaactcaaacccgatatcgaatacaagtcgtattgtcagaatcggctgcatcacttaacccagtcttactcggacttaaccgattctaatcgtagccgatctaggctccagccgattcttgctctattctcgaatcgatctccgccttcggctccacttcgatctaatcctcttttccgatgctgatattactaaatttggtcgttaacagctttgtccaagccatccactctctcttgaagttgagcatttgccacctcaagattagcgtgagactctttggtttgcttgtaaagccgtaccaaagcctcatttttctctctccttagcaagctcacccttgagttcatgagaccgctctttctcacgaatgagtaatgcctcttgcctcctctcaagggttgcatactgatcatcaattctcccaagcaactcactcaagtgtggtagagactccttggttatggacttgaacaattcctcatccataacctcatcctcaacatcatcctcctcatcacaaacaagatcaacattgattgacttgagggaggaaggtaccttaggctcttttgccatgaggcaaatgggagcatcctcatcacttgagtagttgaagagtcttggtggtgatgaaggcttgacggcaaacgtggcaactccttcatcacttgagcttgactcggagtcggagccgaaaatcatcccaaggtgagcttggccataacgttcccgcttgctatgcttgtgcttctccttcttctcatccttcttttcgcccttcttatcttccttgatgtgggaaccatccttgaggtaagggcaatccgcaatgaattgcccgggctctttgcacacgtagcacacccttgcagaatgtcttccacttgacttgttggagtggtgcttggaagaacttcccttgaagaagcagcttcacctcatcaacttgccgaacttcttgacgaagagagccatttcttcatcatcgatctcctccttgctcttgctcttgcggctctattcttcttcttcctttgccttcaatgccaaatcttccttcttgatgcttgtcgttgagctttggttgatgtattggatgacctccttggactcttgcacaagcatgtcatgggctaggatgcgcccgagcaaatcatgaggtgtgagagtcttgttgtccagacgctcacgaatgatagttactaaggtagagttccttggagtgattgctcgaaccatcttcttgaccacaacctcatcggtcatgtccttggagccaagtcccttgatctcattgacgatcttgctcaaacggtcatacatgtcgcttgggctctctccatccaacatcacaaacctctcaaattgccctttgaggatctccaccttggactcgcgaacactatccgtgccttcatgcaaattccgaagcgtgtcccaaatcaccttggcactctcaataccgtccacgcggttgaactcacttccactcaaggcgctaagtattgcattagcggcttgagcgttcttgtgctcgttctcgtcatcctccttggtgggatcctcaggtttttgcaaaacatagcccttttcgactattctccaaatagatgggttaataaacttcaaatgcatcttcatcttatgtttccaagcggcatagtccgtgccgttgaagtacgaagctttgccgctataggtactcacataagaggtagatgtggatggatagtcataaggaaacgtagatcccttatcaccatctttgccatcccccgtttggcccgacatgatctctccaagcggttaagcctaattagtagattaggctctgataccaattgaaagggtcaattaggcctagagggggtgaataggctaatttaaaactttatgcggaagctcacactgagttagggtcggaaagtctgatccacagtcagaccatctgaaaatatcagatagtctgatgttggatcagactgtctgatccactaaagaaacacaacaagtagatctagtgcacaaacaggagtatagcgcaaacagcgactagatctatagcggcacaattaagcaaagctaaagaagggatgaagagatatcaccaacaatgaagttcaccgagttgttcccggagttcaaatccttgaggggattctactctccgttgaggagctcactaagagcggggtctttgctaaccctttcctcaagaggttgcactaagcactcctccttccactaaggggtatctctttccttgcggaggcgagatccggccttcacaaacttctcccggccaaccacacgtagatcggtggctcgggagtaacacctagccgtctaggagtcctcaacctccaagagtaacaaacaccacacaactcttggtcaaaccctagtgctcaagatcgagtgaaacagacagtaggccctcaaacaccaaatccacaaccaccaagatccaccacacaaagaacgaggagggatttgagagagggagaaagagctcaaatatccaaagcaccttagcaccaagctcaacccaaagtgaatgtgaatgaatgagttgggtaaccctagaaaagggttaggtggggggtatttatagatcccccaaaatgtggccgttgggagaaaatattttcatcccacctcggaaagtccgaggtgacatcggatagtccgatgtttttgacccccaagcacgccagagacagagaacgaaattctggagaatttcggacaatccgatcgatcggatagtctgatgttatattggatattccgttatttttgaatcatgaatttcatcctctcacagagactcaagttccattgaatttcagagtctctgggtcatccgatactccgatcacatcggatagtctgatttgaaaaatcactcaagaggaataaaaagcaattcaagacagagagtgaagttctgagaaagttcagacagtccgatgtatcggacaatccgaccttatatcggattgtccgatattttttagccaacactcagaccaaagacagagggaaaagttctaagaaatttcggatagtctgagcatcggatagtcttatcaggatcggatagtccgacaggaataaaataggaacagtccaaataaaggattttgagcactagtgttctaccaattatatgcatgtggtagccctcttaatagtacggcatcctaatactcaagaacacaagatatacatggaatagaagataattaccacaaaagatgccgcaaagcttgtaaattcaagttccactcctttttatccttgcatccatctcaacaaagagcattagtgaacctctaattgtgttgttattaacaccaaaataaatgaggggtcctagatgcactttcagggtgaataggctttcctgaaaatcacaaacaaatcgcagcggtaaaatttaacaggcccggaacctcctggtgtagaacaccggaatttccggtctgctcagacaatccggaacttccggtgttcttgtaccggaacttccaggcaatagaaaaacctgggaaaaactaacagggactaaagctaaaattcacgagatgaatcacaggataactgcagtagcacaatcacatgcacatgcacagaaacatcacagagtggacaaagatgattttttttcccgaagttcgaatcttgcaatcctactctccgttgaggtgctccaaagagccggagctcgattaaccccttgcctcacttgtgcaaaatccttagaggaaatccacagccttcaaccccaacacctataggttgttttctagaattgagtgaccaccaagatccaactcaacctccttctagaaaacaccacaagtgtgagtagctctactaggaaaacctctaggacttcagcacaaggttctttactcacttacctcattttcttacggaggtgaggaataccttcacaaactttcccgggacatccacaattgcaaggaagctcgcgggcgacacctaaccgtctaggagaagatctccaagagtaataagcaccgagatgacagcccacgagataccctaagtgctcacaccaatcttagccttcaaaccttctccaactcttctccttcaccctcaaaatctcactctcttacaagaatggctcaagattgggtggaggaagcaaagaagctcatgggagaggctagcaacagctatggagtggaaaagcaaaactgaaatggccaaagggtgagctggggacgatctagatatatataacggctaggtgacgtcatctagccgttactcacatttttgaactgggaagggtccggaacttcctgaccactggaagttccggacaacacttaggaaaaatttcacctctcaaaggtccagaacttctgggtccaaggaccggaactttcggccagccttctctgcccgaggaagggctatttccaaaaatagctcccaaaaatatttcaacacttgaatctccctaagagcacttgttgtatcccagaaccacacctggaacccctcttaatagtacggtttttcctaaaactcgaatgcaaaaattaaactatcctatgcgcccttcgagttccaattccgcttgaatatttgttgtggggggttctccaagcatctcttgatcacatacaatcatcttgggactaaacacctgagtatgctcaataatactcattagtcccttaaccctattcgtcattaatcaccaaaacccactagggggataaatgcaacttcaacaccaagctgtgagatcgattaggtcgggtggttggggtggaacgtgaatcctgtggtggaaaactccccatacttgattggagaaggaacacgccacaagtaggtgatagcatatcaacggctccatcatgcaaaggggacaaactagctaacttggcaatccccatcaatctaggttggctgacatcaagcaactcttccatgtggcaaggtacatgaacatcttacagcgacctagaatcttagcccccccaaatcagctcagcgcaacccacgaggactttccccaagaagtacagaatagctatcgttaaatgttagcttcaacatcggaaacttgatcccacaactgaagatattctagtagtgtccacatcaaaagtctgtctttaattacacgcacccacgtgtaatcgtcgagagccgctaccaccgtgtgcatgctccttagtacaaaagaaaagagcacctttctgaaactcattcttcatacaactaagggtgtgttcgggagggagagttcggaacttctcctccctgcaaggaaaatgagatcgctcattagcgcatggttaattaagtatgtcggaggaatggagatgcggtcgccatctccccgggtcctcagggctttgacaaattaagtcaacaagagacatacaagatctacatctacaagagacgtacaagatttacatattcaagagatgtacaagatttatatcttcaagagacttataagattacatcttcaaggcgtctagaagagtgaggaaacataagagatctatatcttcaaggtgttgaagacggggcgtaccacttagcacgcctcaatcaggttatatccatcaagaactccttcaatcattgacatcttggagaagcttgtccgagtcaagaagaaaatctataaaacagcgatggagttgatgcgagcgccctgggcatgttggatgcccccggcatgcactatgtcctgaaaacacgatagtccctggcacacccccttgatttgggcatgccacaagccctgggctcatcaccgagggctttgcctcctgccctgggctcgccctgggtttctctgtatacctaggatggcctagtggtttaactgcagctaacctcatgattatcattataggggctacccgcatctgcatcttggtggtggcaccgtatgtagcctcctacatgccacatcaaccaaaggagtaagagagaggcagcgtgtcacgtcctcaggcgtccaccgcccaatattccatcagctgtcccatgggctgacccatgggctcatgatataactagatggaaacttcttcaaactcagcaccatctaacagttgtgggagaact

SEQ ID NO: 35385 - DNA, 11100 bp, Oryza sativa
cgcctcgctgtcgacgggtacgtcgcctaccactgaaagcacaacaccgttaaatcctagaaaattcgctctcatagagagtcgaacctagaaccttagatgctactgaggctctcgtaaacactaggctacagactacaggccctttcgcaaatcgtaatagtttctcctacacgcgacatcaataggccagtagtaaaagagacatgtgacttcatgctctacaggccctttctcaaatcgtaatagtttctcctacacgcgacatcaataggccagtagtaaaagagacatgtgacttcatgctctgtctgatactagctttgacggtcgacattgtcatacaaaactacaatgggtttcaagtagggcatcatatcgacctcatgacaaaaattacatatacatggttgttattcaaaatttttaactgaacagggggtttagacctgaaataattcaatcaaaaatattggaaagtaattaaatacatatcaccagtactgaccacttcgttgtcaatttgttacattttggaatatttcactcttagtataggccctattcatgttgccagacaacggagcagctgcaaccactatgagtacacaggcacaagtaagctacctgactgctgcagccattgccgcagaactggatgcccaacaaccgcgtaaaaaactactcaatccattttatattataagacgttttgatttttttaatcatttttctaaaatttaactaagtttgtagagaaatatagcaacatctataacacaaaataaattagttttactaaatttaatattgtatatattacgataatatgtttgttttggattaaaaatattgctatatttttctaaaaaaattcagtggtgtgaaaacggtatcattatgttttcactgagatgatgtcatactatctcctttatatttttttccttgcatatttgtataagtaatgattggaagtgcacgggtgatatatcggcaactacatgttgtcctgaacaggaaactactcatggtctaattttgccactattggaatgctatcgtggtgaatccactagaatcttttaatgttttcacatgaagccaattcaaaatttttactatatatgttatttcagaccgagtatagttctaattttttttttcaaacttccaactttttcatcacatcaaaactttcctacacatacaaacttcaaacttttccgtcatatagttccaattttaacgaaacttccaattttgacgtgaactaaacatatcctcaatatctcatcaggtgaagtttgaacacttttggtctgcaagaaactgtatgtgtgacgcctgaaagctaggctgaatggagattaaatatgtggctacgtacctgacagaacagccagatccttgaggctgaggcccttggaagcaaacctggtgatgagcctgcgaattccatcgaaggagtcgggcaagtaggtcaccgcctccttggcgctcgacacgcggccgtctcgccggccggtctccacctcgtacaagttgccgtccttgctccaccgtccttgcctcaccgcctttgttgcctaagcacaaagacttgcatcttagagtgattttacagtttctgataaggtattgagagttacaatatttttttaagtgtaaaatgatctctcacgatatctccagtactaaaagagatcaaactttatattaaaaattatattaaaattgtgataaaatttttcaacatattaaggtatgagatggaattattaattaataatcttcattaattactactccctccgtcccaaaataagtccagttttatactattaatctccaacattcgattgttcttcttatttaaaaatattttatgattagtattttttattattattaggtgataaaacatactccatcgtttcacaatgtaagtcattctagcatttgtcatattcatattaatattaatatatatttagattcattaacatcaatataaatataggaaatattaaaatgacttacattggaaagcggagggtaaatactagtactttatgtgtgactaatttttttaataagacggatgattaaacattagacacggatactcacgactatatttattttaaaacggaggtactagtgattaccaaggagacggcgtctctggcagcaatggcgaggatgtcggcgcaggagacggtagcggggcacttgtgctccagcttctccttgattgcgtcgatgacgtcgtacgcgtccagcgtgtgattcggcttggcgtccttctccgccgtgttcttcttggtcgagttgatcagcaccgatccttcacacccctgtacgttcatcgaccaattccatggtaacatatcgatcaaacaatcatggtcttgaaagaatgctaatttgcacattttaatttgtacagaccacttcatctacggcattgcggatgtttgtcttgtggaaagaaaaaatttggcacttgtcagggcttgtgagtggattactagtgtttttttatgattattttatacagaaagtttcagagggtcaccactttagtttgtggacgactgatgatggactgcatctcatcattttagaccggctttggatgccatttcactcaaaaaggcaatcaaacaggatgcagaaaaaaggcccattttgaaggaatctagctaacccacatatcttatcctctcctcctttttactttttcaccttcactagctcacagttaaaccctttttttttttagctttgaataatgaaacctttgaatcagtagtaaaagagtaaagatgacatttggacttcaatctataaaaagaaaataacgagacaagtagtaataatgcattttagtttaccctgacgaaacaatcgtggaagtgaagcctgagcagcggcgcggtggtggtcgggtcgtcatggacagccgccgccaccaccttgcgcactatcttctccgcctccgggcacgactccttgtagaacccgaccgtcagcccaccgccgccgccgtatccatggacgacgggaacagccgccgccaccaccagcagcagagaagaaagcaagaaccaccggcgaggaggaggaagaagcacgcgcactgccatggcagtacactacactacactacgctgcaggtagcttagcgctctagcaatgcttaagtgcagctggcttgtcagagagaaaacacttgttaaaaatggagtgccgtgtgtgtgtttgagcaggcagcgagtgagtgggacgtgtgcctgtgtgtatgtatataaagggccaaggagtcgaggagtgtgtgtatatgtgtggatgccatctacggagtacgagatcttggggagtgttatataaatggagttgctgtttccccggctgtcatgggcatgatgccatgtgattaggcgtgggtttccgggattttagcaccgtgacagcgtggtagagatgttatctgaaatgtaattaaactctagcagggcgcgcgatcgacctatgctgattaacccagtgctagttgttgccatcagaatatcctggtgatcgcggatcagatgctgacagacgggccaaattaccctctccgggtttttcttttcttttggatttgctaaaaaaaaaaccttgacagtttctccctcaaaactttccgtttgtgaaaccgttagatcgtgtggagatttgtttgagggagtgaagatttttttttttttgacatagctgcacaaggcggactttcgtacgagaagccagattgctaaggggcgatcgattgccccagcgatcatattcgtatcgccctctccctccacctgttttttttttggcaccacattacttttttattttagtaaatttatgtacctaaagtttatacacctcaagtttacacatccaaagtttagaaacctaaagtttataaatcaaaagtttatatatccgattcaaatttgaatttgaattcaaatattttttatatatagtatttctatacatctaaagtttatagacccaaagtttataagtcaaaagtttacatccccgattcaaatttgaatttgaattatatccgattcaaatttgaatttgaattcaaatattttttatatatggtatttctatacatctaatgtttatacacctaaagtttatagacccaaagtttataagtcaaaagtttacaaatccgtttcaaatttgaatttgaattcaaatatttttttatatagtatttctataaataaatttttcaactttatattttttattgttttttaaattacgtagttcctacgaggtgatctcgtagttcctacggggtggagataattggggtgtagtaggaagagaagaagggaaggaggaaggggggagaggagagtataggggtggatggggatcgatcgcttggggtcttttttaaaaaaaagaccacataggttgtcttttttaaaaaaagaccacataggtggtctcatagcataacatagcacataggcatgctagccaccgtgcctatgtggtcttttttattttattctatctctattttttaaatatatgaagccattaattttttacaaccattcgtcttattcaaatgaataatatttaagtaaatatcttttcttttgttgtggcttgatttatcaataaaggaactttaaacattacttatatttttttatatttgcacaaatttttgaataagttgaatgatctaagtttgtaataaaagtcaacaatgctatgtattaaaaaaacatagggagtagtaatttatataagttaagtatatcgcagtgtaattataatgtacatcctccattcaaaagtcttaaggatattttatttattatttttcaaaatgagataggtgtgtgtatatatagtcttcctgcatctaagacttacataaaaatattgtgtttttgttttgtagtgctagattaaattattgattggaaatcgaaacccgaataaccatcttaatatttaatactcctcattggtttgcatgcaggcgtataatccttggtactttttttttctcaatgaaaaaagtaatatgccttagatttggatggagggagtaattgtcgaatgttctatggcaactattttttttcatattggtcatctttaacttttggataagactatttatcttataaaaaactaatcccttcgttttatattataagtcacttttactttttttttccaaatcaaacatttttaagtttgatcaaatttataaaaaaatatataaatatttccaacacaacacaatcagattatcaaaatgtattaaatattacttttaataaaactaatttggtgttgtagatgtcgctaaatttttctataacattgattaaacttaaagaaatttgagaagaaaaaaaataaaacgacttataatataaaaggagggagtatgtaattatcatttgttttgccctgatttattttaccattaaaggcaatgtcttatatatttttttaatatttgcacaaaattttacaaacttggtgtttcataatttatttttattttatatatgaaaaagtactgatcaaagcttggtacaactcgatcatgaactcaatgtgaaaagtacgaccagcgtgcgaacgagaagagagtaccacaacggtagctgcggtgaatgttgcgctgtgggatattctgttatagttaatcgtgtttactgcatttcctgcggattaattaattggttgatgattgattattaaattagctagtcgtataacagagcagccagtcagtagtagatggaattacgatgcgatcggatttcaagcatacaggaccccaagtgcggaccacgtggggtcggggagattatttgctttcttttctatgcggcctgatggcccaatcttctgccgtatgtcctggttgatcttatctatagcttgctagtttcattagcttagaggcgactttgaccaaagcttttactcgccaatcagccatacactaattaagctactcttgatattacccttcaaattaaggatcaaggcatgcatgttccggtgttcattatgacaagtaccacggtggggtgtgtcacatgcatgttttgcagctggagatgtatagaaaaccgtgtattactacttgagcgaggtacaaaaggtcaccgtcgtacgtcggcaagctcgagcggcctcaactgttatgccctcgggtgggtcggcacacgggccaaactcttgctgaagtgcttctccaagtcatgctctactgccgaccgtgctcggctgctcgccttgcattgtgccctcatttcagccgccacgcctgccgatatggcgatatctgctactgctactggtactgcttttattttcctcctttgtcctcttgctatttattttttggtcatggctcacaattcctgccggttaggattgttttctacgcgcaccctctattataataaaataaatcaatatatataatatttttagattcgcaatcattttagtagttaggaattgatttattttaagcaagaagcaagcaggaactatgattgatccttagaactcatatgtgtttggttttataggataggatggatcgagcccacttttgagggtatttggtgtgtctatcatctaaaaataatattcctttaaaatttatgttggcatttttcccaatcaaagctagagttctctcgtgttgatatgtgggccatgtcttgaaaactaggaccattacacccctcatgccgaactgatagttaggatcattccatccaaatacatggatgagtctaacatatcctatttcatcccgaaaccaaacacacactagaaggagaggcaaagcttttaaggctaatggggactatagcttctctagcttttgaaaattagaataaagtccttgttattatttcatgactccaatgatattgtagtttagctagtttgctcttcttttatacttgatgtgatatactccaaatcaatacatgtaaataggagtagagccattacccatatcaagtccgaacctgtataaaatttttatcccatgtcctctttattccatattcatgtatgccatgtataccttgttatcagtagtaccttacgtccctaaatactgtggtagagtataacccgttgaaagtgattagctagatagagggcctgtactccaaggtattatcaagatgacttcgagacactggcggagggctcggtagggcgaggtgtggcgttcgccatacctcgcgccgcccgctaaccccccaccccctcatgtcacagagcggcaaccgccagccggaaaggacgcagagagcgcggcgactctggaggaagacgagcgatgaccgagacacgtcgtgggcgtgtccgcgcgtggccgtgctgggcctctcgttggtagctagtaggcccattgtgttcaggcctgccagtggtttcaaatccacctcgcacctacaccaacccaaaagcaactacactagcccacccaatccaaaccaacccacaaaataattttctaaaccccacccaaccccacctgcacattctatccacccgatccaatccaacccgcaagttgttccccacaggcaacccatggattctacccatggctaaccaaaacacacaagcacacaacagttggctaacaaaaacacatagtgacacagccacacagtaacacaggcacaactgaaattagtcaggaaatttgtacaacactttgtcaatattacacgaatagttagtttaacatgtagaagcatgctacttccgcagctcaaatcagttagcatgcaagccatgatcctctgatgtgattgcttgatgtggttatccccacaaccaaaaagtggtactactctcttgaagctcatccatctcaggtgctttgatctgtaatagcatcaagagagtagaaccaaaaggttacagtaaagattcaataatactgataccacaaaatttaagtgtaaaatatcaacttagagctaaaatccatcatacaaaaaactactaccttttcagaccatcatactttagaataagttagcgtacaaaaataaatgatatggccacacatacaagcatcagctaccaactgcattacagttttcaagttaatttgagaataatcatgcaaactatagagaccaagttttcttacaagctaagaaagaaacaatgttactttgttagtctagctagtagtagataggcaaaaaaatatacatttaattaccttgtttcttcggtttaaataaccaatctttagcacaaactagtgcctcaagcatatccggtgtcaaggaacttcttgtgtctccaagtatccttcctccacaactaaaagctgattccgaaggcacaatgctgagtggaattgctagaaaatcccaagtcataattgccagtacaggaaaccttttagcatttctcttccaccaagccaaaacatcgaaatctttactatcatcctcacaaacttcttctagatatgtctcaatctcagacttatgtaatcgtgttcggtttgacttgaaaatagcaaactcttggtcaagttttcttttgcctagaactggcgagcctacaccactagcttctccttgcccagaatgtgataggcaggatacaccccttctccttgcaattccttcatatactctaaagtaagacttcatccactctataacagaatccactttagtttcagcttcattcatattgggagacaccttggcataaaagaattccaaataatctcgttttcttcttggatctaagacagtgctaatgacaagtgccaaattaaaattgtttggcaatttttcatcccaatacttagcaaacttcatatgcatagcactagccaattgagtcaaaatactagttgtttgcgaatcaaaatcacttaaagcatggcgaatgcagagaaccaagtgcaagaatgagtgtgctgttggtttcctgtcagctgacacaagtctagtagcctcttcaaaggctttaagaaactcacaaattgattcagcagtcagccactcttcgtcagatggtgcaacctcaccattttcattggcataactattaaggacagctctatagaccaatgcttctaaaaccattttgaaagttgtgttccaacggttaggtacatcaacagttaaaccaaattttgaacaaaggcatgaactgttggcaattgaattgaacgcttggatacgtgaggctgaattttctatgtatttcaagagctcatgtatcttatgtattgccccacgaattaacctcattccatcttgaaccaataaattgaggatgtgtgcgcagcacctaacatgaaaatgtctaccttcaaataacaactcattcttctgatttttcaccatttcctcacaagcagccgtgttattactagcattatccaaagttaaagtaaatagtttgcccctcaagccccaatcagtcaaacacctcatcatggcttcttctatagcaaagctagtatgtggatacttcacaggcttcaagcttatgattttctttttcagactgaattctgcatcaatataatgtgccgtgacaaccatatatcttaagttttgatttgaggtccacatatctgatgttaggcacacacgtgaatcaatattttgtaattcatcatgcagttcttgtttcatcctaatgtacaggtgtaaatcttatcacgaattgtttggcgaccaacaactttaaaggttggttgcatggacttccatccactcagcaaagtaaggatcttcgatttttcgaaatggtatctcgtcatggatgaaaaattttatcatcaattcttcactccttctaggataaaacacaaaattttccacgggttgtttccgagcaattgctatgaacctatttctaacttcaacctcaactagtggacaagagtcgcaaacatggtttatgagatgactagttcctgattttctagttgctgtcaacattaaccgacaatatttgcactgtgctttggggacaccatctaccataacaagctcctgctcaaaatgttcccacacctttgctcttttacgtggttgtaaagataattcatgactagaactattgccagttgaactttctgaattgtgtgtagacatgtttaataagcctgcttgtgacaatattaaaaaattaacattcaatctgctacaaacagccaaattaatatgaatctaattcaacccatatttgtaatcttgtagaatctactatcaatctgaggtatttccaaatcagtattaccaggcataagtcataagtcctgaaaaggagagaatacttgctggatcttgaagggagagagtattgctagatcttgtgggggccggggcagggacacacggcaacagatcttgcatggaggagagcagcagcttcttggcgccgacggagcggagatggcgatctggcggagcggtgccgggagatgacgccggagcggaggacgagcgggaggccgggagccagtggagctgcagccgcttgcagccaggtcgaagtggcgagcagcagcaacttcttggcgccgatgaagaggagatcgtgatctggcggaggcgcggagcacgccgggagatgacgctgaagcggaggacgagcgggagccggtggggccgcagccgtttgcagtgaggacggagtggtgaggagcaacaacagcagcgacgccgtcggtggcaatggtggcagcggcggcggaggagaaggagcgaaggacgcgagaagaagaatgagttagcgtgtggattcagtccatggattagtcccgtggattcagtccatgaatcagttattttactcagcctgcatccaccccaaaccaatccacatgttttgtaagcccagttcaatccggtccaaaatgaaatcccaggccgtttcaatccaacaaaaggatccaaatgaggatccagcccacttaatccaaacaaagtcagcccactggcaagccgaattgtgcttgct

SEQ ID NO: 35386 - DNA, 12316 bp, Oryza sativa
gtttttcctatatttttgatatgggcttactctcgctgtggcccaccttaattttttttcattcttccgcactgcttcaaaaggaagttttttccatggaaggttttatgatcgctctgatcaggaagatccaccccaatcgatgtcaccctcctttggatcggcccggaacctttccagtctactcagcatcgatgctcccgatcaattatcccactgttgggaggaccatgtcagatcgacccaatcagcttactcttgtcccaaaagtggtggtgtccaattcataggacatggtaccactccttcattgaatgtaagtttttttcacagggtagcagccaacaagccgttgttttatattctggtcgagttcaaggtgtttctcagataggtgccaagtaaaccacaccctaccgaagcttttgagggccaggaactttagtttagtattctcactactacgaaaaccatttttcgtggcggccattttggatttttgctggcggaatttgcagccgccacaaagcaaagaccagtgaaaatcaagatcttcgctagcggttattgaccaccagcaaaaatctattttcgctggcgttggcttaagccagccgccagcaaaaatccattttcgctggcgttggcttaagacggcgctggcggttgtgttaaatcgaaaatacccatgcagctgcagagcccgccagcaaaaatacacatgaagccccatgttttgattcattaaatttcaaaattcaaatccacatctagatgctcatttccaaattcaaacacgaatttacacatcatttactcatcatcatcagcacagatcaaacatcatttacacagatcaaaacatgtgcatcatctggaacaacatgcaaaaaaaaagagaaaaaaaaatcaaatccagccgcgggagcacggtcgacggcgtcgaggtcggtgccgccctccccgtggtccagcggcggcggatccggcctcccggtggcccgacggcggcggatcgggcctccccacggcacggcggcggcggatccgccctccccgcggcctagcggtggcggatccgccctccccgtgagcagccgcctactcccgagcgccgccgcgttcgcgcccgagtcgccactgcccgcgcccgagctcgccgccgccttcgccgcgcactccatgttgggagatagggagctggaagaggaagagaagagggtcggagcggcggtcatatgcggcggtggagctgcggtgatggcagccggcggtggtagggaggcgacgagctggcgcggtggagaagggagggaggagagacggagagagacgggaagggaggagagacgggagagacggtggaaaagggataaagatgggactggtgggtgggcggtggattttattagcctcgaattttttttagcggtctttcttacctaccaccagcgaaaacgtgatttttcgctggcggacacttaagaggtccgcctcaaaaaatagagtatttttcatggcgaacctcttagcgtggccgctagcaaaaatcggttttcgctggtggtccatggccccccacccctcgatatgtttttgctggcggttttcgcgtatgcccgcaagcgaaaataataggccaacgccatgaaaaatcgtttttctagtagtgtctagtgctaagtggagtagaatagaatagctctcgttgtcctcggagtctttggaggaattcgggtatggctctagtagcttttcttatttcttttgtaagactttcggaagtaatgaaatgttattctttatatactctcggtactttagtttatctgagtatcggccttactttctatttgcatcggtatagtcgtgtagtcagcctaccagggaggtgcagtggtgtggatttagtgtccggttattcggttgctctatgtcatcttggaggatgtagagtagtatttaataatgtagacgtggtgtctagattattaagtatcattatctgggcatatatgctacaggtcagtcgaggtgagccgctgatgatgacagctcagtacgggcattcctccacgatagtatatattcctaagaaactttcctggggagggtactcctccgtatttagccccggttggaccatgacaggttgtcgtaaggaactcggcaatccgaagtggtccctcgaagcaccaggagggcattgttagggggtattggctacatggttgtatactaatagatgtaaactaagattgagtgtatactattattataagaattgattgtttttctatttcttcttccacatagcttaggaatgattagtgagagatatgagttctttgcttcgtgtcactttaccctataaatatattaacccatgcttagactctgatcatacaagtggcatatatacattattagcatagttctctcttacaatcttcccttgggattaaataaatacgatactttagaatactcttgggtgaaatgctacaatggtatatccgtgcgcttgcggattctttctttaacaatatatatttcttgtaatgtcattcagaaatatcaacaggaatcggtctccagccatcatccatccttcatcagctaactccataatttcgcacccaatgcgcaccatctgatacagcctttctagccttaacaaatgcaatatgagatcctaaaatcacgtcgttgacttcgctccatattttccttacttaacggaatatacaaaattttacagttagcactaccttgtaggatttaaatttaaacaaattttaactgaagttaaatatatttaggaaaactaaaaacttgccccacattgggtaaatgacaattacccaaaaaaatgaaattcaaaaacaaatattgccttttttttctaaaaagatataaaatgtttgtaatttaaacaatttacgaaatttttaaattttgtaaaatatatctaaattcagccaaaatagtttcagatttaaatcttgcaaagggtgaaatcatcttttgcaatgttttttttccattagaagataatatattaaaactatggccgagtgtttgttagtaaacaactataatattagggtgtcataaagcaaattttgcatacaattttctttaacaaagccctcacatgcaacaacatggaaagaaaagagggttaatttgcattttttttagcttgtcatatgaactcacatggtgttcaacttggcagaaaaaaacaacatgaacaattcacttattcaatttacatgattagtgattatatcacgccaacctcgccagttatggtattagtgtattttaataattatttgtttgaaattcattttatgcaaaaagtactcccccaatattaagaatataaggcttattagcttttttttacattctctaatactccatctgtttcatattataagtggcttatcttctttttttcaaacttttctgagttataaaaatatagtaacgttttgaatcccaacaaacatactatcaaaatatattcaaagtacgttaggttcaattaaattattttggtgttataagagttgttatcattgtttataaacttgatcaacttgtaaaaatttaacttataaaaaaaccactgtgatttatatatgaaacggagggagtattataatcgggccattgatttctttagtaatgtactaatatcaacaactacgaaattaagatcatacgaaaacattttctgaaataagaatacaatgatattatgtgtgtgatactaacacatactatattgttattagtagattcttaggtggcgttttctaattgagttacagatttttcgtaggtttctgttaggcttttcagatgattaaacggtgtatttcgtgcaaaaaatttatatatagaagttgttttaaaatatcaagtaaacctatttttcaagtttgtaataattaaaagttaattaatcataacctaacttcaccttcctcttcatccatctcaaattttttcaatgatgattttgctgaaaacaaagagcgcctttactgaaaacaaagggcataggtcagatgtgcataggatcatcttgttttctatatagctctattaaagcatgttattataagggaaaagaaaagggatgttaaccgatatattttattttcgaggggaaaggcaggagctctgccaatttcattaaaaaaggagagaaacaacgtacctcaaggggtgccacccaaagaaggtacaatgcagtcgcaaaagattttcaggaaatgtaaagctacaagcatcaataagtggtgctaaattatctaaagaatctgagcttcatcaagtcgtgtagatggttaaaccatcaagatttcgcctattttctttgatcatttttctccgacaagcttcccaccattccataatgtccccattggaaagggatgtcgtgggcatatgaaggcctagttttgaccaaattttgctccatacctatctagcgaacgggcaatccatgaagaggtgtctggctgtctccggctcaactccacaaagggagcaaattgggctattgtcccaaccctggagctggagcttatcggaggttaggattttcctttggaccattagccaaccgaaaaattttcacttggttttccatctttgctttccagatgtagttgaacctctcctcctgtatgctccccaggaattggatccggtaagccgagtttgctgagtagatgccaattgggatccatctccaagttactatggtatccgtttgctcctctagatgtacctgttggattaggtgccaaagaagaatgaactctctgacctgggtggttgtgttcatcctcttcatcagtctcaaccaacagttgtcttgtaactcctgtcctatgccactgtcctatttttccttgtcacgagctgaaaaagagatggagtcaattccttgggcgattgcccttccagccatctgtcatgccaaatttaacttttccccatttgttaaccgatagtaaatttaatatgtttttgtcatttgtagataactaaatgcccatgctttgctatggctaaaaggaaaaaaataataatattgttgcctaaaataaaaaaatatttttcatgaaatattttacccaccttttagatttagttactacatctgtttcatattataagttattttgattttttttcttagccaaacttctttaagcttgaacaagcttataaaaaaatatagcaataattttaacacaacacaacttatttttaatgaaactaattcggttttgttgatgtattttttctataatcttgatcaaacttaaagaagccttactaaagaaagacaaaataacttataatatgaaacaaatggagtatgtcatgttgaaaagtataaggggtaacatataaaaaccagaatggagtagtgtcactagaattttttgaattggagtatagataatgagacacaaacttttatacggattaagttctttggaataattgttgaaatagattttttctaaaaaaagagaatctcatgggatattaggaaacaatacaaatttaaatattttttaactcgtggtatgggagtatgagacaatgcttgctgcaccacgatatctttttcataaaacttgattgttttgaggaaaaagaagttcaatagataaagtaaaaacggggccttgtagcagaagttcttctggtggcaaaagcgggctttcgggacttgtgctgtggatactgttgtgggctttgggatttcatgcggacttgagtccaaatccagtccgccaatcgcatccagggtctctctcgtcggcctatcccaacgaaatctctcccaatccctctcttatcccctgaaaaccactcaccgtccatttcccctctccccacctccgcgtctcctcaccatggcttccgccttctcccccgccaccgccgcgcccgccgcgtcgccggccctcttctccgcctccacctcccggcctctctccctcaccgccgccgccgctgccgtctcaggtaacatctcctctccctctccgcttttccgtttccaaaagcaccgcattcgaatcccccaagccaggaccttggcaatttacttacactcgagagtggtttctgctgcgcagcccgtatcccgtcacggagagggttccgccgcggccgcttcaccgtctgcaatgtagccgccccctccgccacccagcaggtaaccccacgccctcaaatcccttcgagacttgggtggattgtttcgctcatgtccagcatcttggtgaaatgcgcgtaggaggctaaggcggcgggcgcgaaggagagccaacggccggtgtatccgttcgcggcgatcgtggggcaggacgagatgaagctgtgcctgctgctcaacgtcatcgaccctaagatcggcggtgtcatgatcatgggagaccgtggcaccggcaaatccaccaccgtccgctcgctcgtcgacctgctcccggatatccccgtcgttgttggcgaccctttcaattccgaccctgacgatcccgaggtcatgggccctgaggtccgggaacgcgtgctggagggtgagaagcttcctgttgtcacggccaagatcaccatggtagatcttccccttggtgccactgaggatagagtctgtggcaccattgatattgagaaggcgctcaccgatggtgtcaaggcgttcgagcctggtttgcttgccaaggccaacagggggattctttatgtggatgaggtcaatttgttggatgaccatctagtagatgtgcttctggattctgctgcgtcaggatggaacaccgtgaagagagagggtatctccatctcccaccctgctcggttcatcctcattgggtctggtaaccccgaggaaggggagctccggccacagctgcttgaccggtttggcatgcacgcgcaggttggtactgtcagggatgctgaactcagggtgaaaattgttgaagagagagctcggttcgacagggatccaaaggcgttccgtgagtcctacttggaggaacaagacaagctccagcagcagatttcatctgctcggagtaaccttggtgctgtgcagattgaccatgatcttcgtgttaagatttctaaagtgtgtgcagagttgaatgttgatggattaagaggggacattgtgactaacagggctgccaaggcgttggcagcactcaaaggcagggacactgtcactgtagaggacattgccactgttatccccaactgcttgaggcatcggcttcggaaggacccacttgaatcaattgactcaggattgctcgtggttgagaagttttatgaagtcttcacctaaattattctggaggtaaatggttttctatcagaaagttcggcaggagggcttttgtttgagtttaatgacattgtttcagaggcttgaacttgatgtctatttgtacatctatcattagtatagattttattccccttcaatcgaaatgcctgctatgagttgcagacggttcgtacatttgaatcttccttgtagtcattgatgcagccaatgattaggaaaggagcatctaagtcaagctaacatcttatatttctttttgaaaaaaaaaaagaatcttgcagcatatatgaacaatctttgaactagtgtccagagataatgtcatgccataaatattctgctgcttttgtcatttctcctagatgaaaggtcctaaaaatagaaaatacaatgctagaaatcttgaatggatcttttgcccaagtaagcttcaatagtaattatctgttggtattttagggaattacattctgtgctactagaagttttcatcatcatttttactcactgtttcaatgaaacaatgtacaatggaggtcctggactcacttgtcattgggtcaatgaggagttttgcaatttcttagtggcatataataagaatagctgaatgcccaggtgttgtgattgaatagaaaaatgaattgaatgtcactttaactatgtgcttacatgtttttaatattggtaaaacattaaacacgtcttgtgcaaacataagggtataagataaagggtgcatcagtccatgggagcatattttcctttttcttgtacatattttctttgtacaaaaatacatgacaacgaaatgttattctccaaaatgatatattattatctcaaatgataactgatcgagtaagattataaaataatctgtaattgtgacaattgatggtactaaagaaattcttgacattccaaactatgaaaagaaggtgagttcaggtctctctgacattctacatgcataaaaaaaagcacgcattcattttgatttatcaaattattggtcacctgtaatgcctaaaaaatatagtaacaaacttcagcaacttgagaaactctttacaaatatgttaatgaaaaggactcctggatattgtaggtttatttatctcacccaacaataaactcgagaaacagttcctttttgtgttgagtaattagatcagttagttacatgcatagtgcggatgctgctttcatgagggtataggtactgcagaacacaagtagcataacgagcaatttactaaatcaagttgtataagaatgtagtaccaaaattcacaactttgaactatggacaaatgttcaagtttgtccacacgctaattacttgaactgtagttttgctgaagactgttacttatactctacactagtaatcgtgcacgtgcaaggcacgttttggcaatctatgtacgaaggtagaacaatagtaacttttttaaggcgatccttttttttaattgtgcacgtccaatgcacgtcatgacatacattaaacttacattcattcgaaaatcaaattcatagtagtatataatcaaaagctaggactttttaataaaattatcagtcaagcatcatgtcctacaagtcaataacattatatatttaaaaacaaaggtagtaatattcatgcatcaaagtgtgactgcaattttggatctttcatcaggccccttgattgagcaatgtaccagttagacagacttaagagaaataatttttttcatgtttagtataaaatttcttagaatttctaactgttccctatgcgccaagtgggcaacaaagctgaggggaatgtcttggttaggtataatttattcgaaaattgtaaatataacccctttctcactccatgccaaattttgcacagaacaaaatgtaatgccctgctaggttgctatagagtacaaccacttaacattggtaacacttgatgaattacaacagctagacgattatgagggtacaaaacaccatatgaggaaaaaagcattagtttaacctaagataatttattgtgctaaccatcttcctcatgtattgccttcctcgaactgaatcatgcattatgcactttgtgaattactgcattgatatcctagatcattcatgctccggatctgagcgatggtcaatcgaatcaccatggaaaagctgttttcattttatttttttttaataatgagtttcccttccatttatgcctatgaagacatggtcagacttaactgtgctgtaaaacaattttatcactgccccatcttgttgttgccttttgctcttgagcagcaacttgtattttatttttcaatctcaaaccattaaagccacaaatggatcaattttgatttaacaaaattcatagtaattaaagctccttatgacataccatcctagtgatataaactattcgttgttcaatttggaactgcacatatgtcaaatgaagctcggatccaaattatagctattgaagcggcaatcttatgataagaaagtgatctagctagctgcatacaacttccaacctgcagttaggactaaataaatatgtaaccctcttttcaatttggcaatttagaaaaaatattaactggcatatgatgaacatcaagagtatctcgacaattccagatttgcatcaaagtggacatgcatgaatggagggatggcaatataagtgaaaaaaaaaacagtagttttttttaaaataaattcagtcacaacccatcaatagactatcagtagcacagtgccgtgtaaaaataaagaattgcaaatatgtacaaatatgttcaagtgcatagcagggaaatgttgggctagttgtttatgcgcaatcaacacaatctattatagataggtgttcaggagtaaagaaaaactctcatattgtctgcaatatatatatatatatatatatatatatatatatatatatatatctttgacttgtaagcaatactggtttagctgccaactggacctggaaaacgtaatcaaactttggagataattagacaaaaaagaatcaaatagcatgcaagcgtataacagtacctaagaagcattttgtcgaacatttgctgctcacgcaagagtgtgatgcaacatctcgcaccaaaggttattaccttgtgtctgttgcttgttaccaggattgggaagaaatcgtggttaagccgtttcaacaaacacccttgcaagcacagttaatcagtttgtctagcaatcaagagacatgacatgcaattctgaactttcttttcatccacaaattctttcacttcagtttcgtgcgaaacaatcatggtagacaaaacaacaaattgagtgaaaggaagatggcaaagtttaactcacctacaactgagcagcccattcttctggccggtgcatcggatccggtcgtcgatctggcttgactggggatttcatcggcacgggggatgcttgactagtcgatctggttgcggcgtcggcggaggcatggtgttgtggtcctgtgggcagggcgacggcgttggttgcgggcagcgacgatggtaacccaccctcaagtggctcgctgcgccaccggcgagttccatagcgatgcggaggcggcggcaaccggggcgcagctgagcggacgactcctctcgtgagtcgcgagctctccttcgcgctgggacggaggaaacggcatggcagattggtgggttgtctgggcacggtacaaagctaggaacgcgatttggggaggaaatagcggccagtgatggagctgcggtgtttgcgcagcgggaggatgccccatgcgaggaggtgttcggcgtccggggatagcgcggcgcggcagcggtgtaaacacggggcggatttcgcggtggtggggtgcgtcgaggttacgtgatttcacggtaggatcgcctgctcgtaaccatttggagccatcggatgaaaagatgatttcacctagtggactgacggatgagatgatgtcacctggctgatcgatagatgagatgagatgggatgatttggcagataggattgggaggtacaactcctttttatattagtatagataattgtagcattaccacataatttaatcggtaagtacccttatttcctcctgttacatcattttttactgagtttcccccttgccttctcatcatcgtgtggtctttgacatgttcagtacaattggtggattgattcattcagctacttctgcttccttttgcactagccttttatttcagtgaactctggttctgtacaacaattgctgatcacagtattacttatgaaaataggaaacatatgttttatattaaagcatctatgtagcaacaagcaggtgaaaacatcagttaaacatagttcaggtgtagtagactgaacacctgcaaatctatctgtgcaccatagcaaattgactgaattgtgatttgccagcacattagaatcaccctttcttcagttgcttttactgtcgaatgctcggtaactaatcgccataagaattcactgaagcgtgtgtccgacgtgatcaaactacatggactacaccttggtgcagaccctggcatccttgtacaccttgccggggcgacacacataaccttgctccggcgcgcagtgcgcgtcctgcgagcacacacacatcccctccagcgcgcaacccggcgcgtccctggtcggcgcacggccgccaatgccaagcatcatgtcgctccagtcgctggagaagaggccgtcggggtcataggcgtccttgatgcggaggaactcgccgatgcgcgggtacttacgggcggcgccgacgaaggcgaggttgcggttcttgccccagtgcggcaagccgccgtacttgaacacccccatctgctcgatctc

SEQ ID NO: 35387 - DNA, 4325 bp, Oryza sativa
  unsure (1)..(4325): unsure at all n locations
ccccatctgctcgatctcctccaggacattctcgaacagccgcgccctgttggggtcgcggctgcggtagtacgtcatgtcgagtccaccatgtcgtccgactggccgcctcctgccgccggtttcccgaggtgcgcggtcgacgccttgacgtagcggatcaggattccgtcgtagagctccacaccgcagagcgctttggggttcatgtcacggagccgccggacctcctcgacgaacgccccggcacggctcaccggcaggctgaaggtggtctggtggaagaagctggagcccctcacccgggggtcccacgggcacgccgtcaggagcgcgtcctccggcccggtgatgcagccgccggacgcctgcatcaggtgctgcgggcccaccaccgggtacccggtgaacagcccgccgctccgccgcatcagcccgtacccggccgacgagagcgccgcgtgggtgacccttgacgtcacgcacttgccgttgccgttgcccgcgcgctcgaacagctcctccgcgaggcggttagtacggatcagaagtctcggcgtggcacggaagccgatgaagtcgaggacgccctcgccggaggcgttcatcggcagccggtcgtccacgcggtacaccgctcgcccgatgcccgggtaccaggcgatgtcggcgaactcgtgctggtagccgaacttggtcacctggtccgccaggtcgtcgtcgtcgcgctccatgaacgtcacagaacgcttgaacagaggttgcagcgccagagtcacctgcactaatcccatggctgtgcattacttggtttgtgcaacggatcaaattttagagggaaagaaaggaaataagatggtttcaaaattaaatttatcccaaaaaaaactttctaaattccccctttttaatcactatttagtatttactcggtccctccttttggccttgccggatcttaaagaaaaagtaagaggaactgaaagcacaaatttataatgaaggacaggatgcaagatgcatcatgacagcatgtgaagaaatgagaataaattctttgtagcccaaacaactccaaaagaactaaagtggaaaagattgtgataattacactaaagctggttattttgtactccaagtatcatattttgtactccaagtatcacacaatcccggcagatcgactacgtactcattaaaaagcgatgtactaattcgtggaagtacttgtacgtaataagaaatgagcaatctgtcacactgtataggagtgactctgatgaatcaattgtttagatctcaagtttcaggtaaaaggagtgtttgctaacacatatcccgctagatttgcatgttaattgaataaacatgtgtcacgagataatatttttttaaactaaaagatgaccgcgttggcctatatttttttttggatggacataattaaaggaggaaaaattttaagaccagaaaattcaacgaatagtaattcctctatttcacattataagacgctttgggttttgatatattcatgtgtctatgtatatgttttatatatgtgtttaaattcttataaatgttagtgaatccagacgaaagataaagatgtcaaaacaccttatgacgtggactgaacgaagggagttagcctgattatcactatgtaagtgccgttaattctaattatataaacaaaccaaactattacatcatattcacttgtatgtccaagggtaacatcaactgtagtttgatccttttgtatatcatcgtttgtcaatcgtagacaaaaattaattctatgttagagttgattttgagttttttttgacataattcaaaccactaatcatacacatacattttgcccataattgtttttttttacttgcatataagtaattaattgttgtttctactggatcggtcaataggaaacggcccctgtaccagctggagtgcttatatggtactacccctttttattagcgtctctaccagactagcgatgtaccctgtaggctgaaaaccttcagaaaacgtgttaagttttagtgcattttcttcagacgtttttatctcctatcaccaagttgtcccacaaattaatactgcatattattaataagaattgtaaaaaaaatcatatcagtgatcaacccatttcgatacaatggttgatgtaaaaccaaaatgaaattgtcagtctttagtcacaaaaggttttagaaaaatagacgaagaggctgcaattttttgtggcgaagagcacttcaaaaaaaaaaaggggggggggaggataatcaatatattttcaataatgccaggaagaaacagaaacaacctataattaacttagctaaaatgtttcgtcgtcttgttcaatactagtcctacatatagctacatataacttaaacgtacgcatacagtggagcatacctagataccttacctgagaaatgactcctaggacgcctagggagaccttggcggcgtcaagctccgggtcggccgcggtgagcacccgcaccttggcgtacccgtcggcggcgggcgccggcgtgacgatgcgcatcccgaccacgtactcgtgcacggcgctgcctttcccccacagcgagctgccgtgcgcgcccgtgccgagcatgccgcccacggtgagcccccaccagtagggcgcgtacggcagcgccatcccggccttgcccgcctcggcgatgagctcccgcagcgatatgccgctctccaccgtcacctccatcctgccggcgtcgacggccaccacgcggttgagccgcctagtgctgatgacgaggccctcgccgtcgccgtcgccggggcaggccagctgcgggatgctgtgggagtacctggtggccaccttcatcttggtcccggacgctgtcgcgttggccacggcccggaccagctcctcctccgtagaaggatacacggcggcggccgcgcggcacgtcgaccggtccgggaagacgccgtacgcgctcgacacggtgcagtcggccgtgccgctgccggacgagcactgcaccgggtccggtggggggctcgcggcggccggcgcctcagccgcaggccacgccaatgccacgacgaggacgagcggcagcaaccgcacgagagtgatcatcatcttgttgtgctcgaggctcattctaattaagcgacggcagctgcagccactacatatatatgttgcaatcaaccattggtagcaagcaaagcagcttgcttccacgcctatatactccctccgcattataatatatgacaccgtttactttttaccaatatttgactactcatcttattcaaaatttttatgcaaatataaaaatacttatgtcatgcttaaagaatatttgatgataaatcaagttgcaataaaataaattataattatataatttttttaaataagacgaaaggtcaaacatttgtcgaaaaatcaacggcgtcataaattaaaatagactgatggaatttaatttttgtgtgatgaactagcggccgttctagctagtgacagcgggaattgatgataaatatatactccatatatatgcccaagcatcaaatttgcctataaaaaacatgtacttcattttttttttacagaatctgcatgcatgtgcaccaaagtaagtaaagcatgcaagccagattgcgatatatacgagtatatgaccaagatttgataactcgtaggagtgcaacaaaacatagcgtgtggtgaggagcttgctctacagaaactagcctggtactagcaaattgaagtagaggaaagcttgaagcattatcttcttctgctcatgtggtctataactagtcaggtgtcaggatgtccgttacaagcttgcaataaactgcttggcgcatctacttcatatttggggttgccacttttagatttatcaattaactatttgccacacctatctcagtgacatgtgggtccacatgtgtttatgacatgtgagtccagtggcaaatagttaattgccacatctaagagtggcatatagttcaatatctctcatatttgtgtctacgcgcgtacttcttcttccaactgggatcgacgttatctcttatatacgaaatgccatttaaactttctataaacgcttataagccatcacacactggtggagaaaccatctttggttggtcgacccaaatctacaatagttccggttggacaaaaaagatttttaagtcccggtttataagaacaacatnnnnnnnnnnnnnnnnnnnnnnnnnnnnnnnnnnnnnnnnnnnnnnnnnnnnnnnnn

SEQ ID NO: 35388 - DNA, 20868 bp, Oryza sativa
ttaaaaaatttgtgatttattgcatgatctatgatgtatttgatttgtgtgtgatgtgaacttgtgatgtatttgcgatgaattttgtagaacttgtgatgtaatttgatttatgtgtaatttttttaggatttgtgatgtatttgatttgtgtgtataagtaactttaagatttgtgatgtggatttgggatgttactttgatttgggatttggagatatgcatgccacttgattcgggagaaaataaaaaagaaaaaaaaggaagaaaggggaccatctggactgctgttatcccctctttagtcccggttggtaacaccaaccgggaataaagatagggatctttagtcccggttatttcgttcgggactaaagatagcgatctttagtcccggattcatagttagggggttacgaactgggaggaaagatggtttctccaccagtgacatgtacttgtacaaacgttcgtagatcgtcatgtggcgttctaataaatttgagaaaatactaaaaatactaagaaagaaagaaaaacattcgatcgttgattttctcttagagcccctttgatttggtggaaaaacatagaaattttggagaatttaaatcctataggaaaaattccaatgaatgcttttgaatcaaagaattgaatcctatccaatcctttgaaattcctatagaatggacaatcctatagagattttggaggaaatttagcaagagctctatcctcttggaaaatttcctttgagtctatctcttttatccgattcctgtatttttttcctacagtccaattaaacgatcattgctgtgtttttttatgttttgcaatcctttgttttatacttcaattcctgtcaaaatcctgtgtagatcctcccttccaaattgtcgtcgctcgtatattctcatgccacaaaccccagatcggtcatatgaatagtaatagacgagaagccatggatttcactcatataagccattccctatatgatacgaccgtcgcatcctgactcatagtgttcaacacatcattggacagtgatggtcttcatatcttgatcgtgttttacggcgactagttttctttagtagatttaagatgaggaagatgagttcggtgcaatgctgtgtcgctgataaaaaagatgtgtttgggatatattcatagaggaatgcgctatgtcatacaacatataaggaaagagggcaaaataaaaacacgcagacaacgggaattggggaggaactgacatagctaaatttattatatcaaaatcttaattatattgcacataagtattcgctttgttttgtactataaggcacattttgtttcgttaggattaaggtttcgactcatagttactttactaacataatacaaaagtataatgataatacagatctaataacatcgattttctattgagaaagcaatcttatgttatccttatctattatatctatctatctatctattatatactaaaagtctaatgaaactttctacaaacactctcaagtcgtcacgtggtgctcctaaaaacgctcctaagtcgccacgtggcgcattgataaatcctaaaaattcttaggaaaaaacaaaacatctaaccgttattttcatttaatcgggtagacccattattttcaactattttacaaaattaccaaatcaaccaccgttagatctatcttacgagtacaaaattaccaaatcaatttatctctcttaaattatccctcggtccgtgtacctgtacagcatgtacgtttgtacgtacgtatcatcccaccgtacttctttttctatttttttctttcttatttagattagatgaaaaacgaaaataaataattcaagtccattcacaaccattgattttccataaaacatggtggactaattagatttttgttattaaaaaattgaaaggtccacgtgtgccacgtcctctcttccatcatgtacgtccgtacttagtacatacatgtatatatcggtccctctacccattcggttccctctctctatgatgtattattagcaatcaaatcgtattcacaatggttgtgtagagcctcacacactatatactacatccgtcccataaaaattaaatttttaccttcgaaccttttcccataaaagttatatttctgctaatgtgggacccagtaaactgattatatttccttgtaatcttctttctttccatctcatctctaacctattctctttaacattccttttaatcaagtttatacatggaatgtgtatatgtactgtgttcattaaatagggttattgaagtcatttgtctatcgtcctaatatgtccttaattccctagaaattcaatttttatgggacggaggtagtatgaaatgttcccaaatgaattatctatcatataatgcaaatattttggagtatacaaacccatcaatttaccatagccttatgtcccatataatctatttattaataaataatgagaatctataccaatcttacttgcttattgatagtttttttttaaaaaaaaagttgcacatagggtgtaatgatgtcactatttgtcatatcatgcatttgaacttaaaataatatttgtataaaataaaacaaaagtgtaaaatgaaccaattctagaaaaccttataatttcttagaaccattgtggttcataactttcccttaaattgagacaaccatgcataaccacttcatcattttaagtgactacatatcaatagacttctctctgttctatgccatagcagaagatagttggctttgaatattatatttcttactattaaatttgggttttaacactcgggtttgactaaatgtatttaaacaaatatatagatcacacatattataggaagcgaggtctagaatatatctactctatatttttattgattcatacataagtacgtataacaaattgcatcaaatgtgaaccaattaaaagaaggaataaaacacatttattataaataacctttttgagattttttttaaataagagcccaaaacatttaattaaaaagaaaaacaacaccttactttaatttggatttaaagacccacgtcttcttaaatgatgaagatgattaactttatagataggtgcttatatagataaatcaaatattacatattgtaaactaacaaatatcttaaaagaaacatttaagctatgattcaggaatgcccgcgcgaatgcgcgggctaccatcctagttattaaaacagccttgaaagaaggcaccacgttcgctgtggaggctagaaattttcacattaattggagaaaaagaaaagaagagttaaagtagaatacaacttagacatatctgaaattcggaattaaaaataagtaatattggaagaagagtcaatacagaatcaaatacgagattaattaaaattcagaattaaaaataaaataaattctgaaattagaaaaaagaaaaagagagttcaattagaaatacaatttataaataactgaaattcctaattaaaaataagtaatattagaaaaggagtcaatatacaatcgaatacgagaataattaaaattcggaattaaaaataaaataaattctgaaattagaaaagagaaaaagagagttcaagtaggaatacaatttagaaataactgaaatttagaattaaaaataattaatatttgaagaagagttcttatagaactgaatacaagaataattaaaattagaaataaaaaaataaaataaatttcgaaaatagaaaaataaatataagagttcaagtaggaatacactttataaataaaaaatatcagaataaaaaatatggaatttttaaaaattaatcaacctagaactcaacgatgacaaataacaataaataagggacaagtaataggcccgtaaaacagtaagatggtgaacggttgatgagaaatctaaaaattataaacaaaaccaccaatagaacccccaaggacgattaagaggtggtacgacagatagaatgttaagcagcatagacacgatggttggcgggacttttataaagtaaaaaataaatcgcaataacaatcatgttttatttttaaaatcttaatgataataaacaggggaggcaatgggtaggccatacaggagtataatagtgtggagccggcggcggttggcgggacttctagaaatttaaaaaatgagtacttaaaattcgaaataaaaaataaaaaaatttaaaaatagaaaaataattctaagagttcaagtaggaatacactttacaaataacaaaatatcggaatgaaaaatatggaattttttttaaaaaatagtccatctagaactaagcaatgacagataacaataaagaggagagaaatattaggcccataaaggagtaagttggtggcagttgatgcgacatctaaaaactataaacaaaaccacaaatagaatctcaatgatgattaagaggggggacgatagacaagccgttaagcaacacggtcacgatggttggtgggacttctagaaagtaaaaaagtaaatcgcaatgacaatcatgttcgattttgaaaatctcaatgataataaaaatacattagtatagtatggcgaagccggcggcggttgggcagatttctagaaaataaaagatgaaccccaacgatagttatgttcaatttttaaaatcccaacaacaataaatatgggagacaacaggttgatcatgaagaaatacaatattgatgtttgacaacattcctaaaaattataataattgaacctgacgagacaatgaactctaaaaactagaaggtgtattttttagtggtttaaaggaagataaataaaagccgtgatatattgggtaaacaaataaagggttgataaaagagtaagaattaaggactggtgttacttttaaataaaaactataaaagattaaggatgataagattcgatcttttaaggttataagacaacgtaatggctatttaacaaattttaagtaatgacaaatatagaaaaatagataattttatatgggtgctagccgcgcaattgcacgggtcacccagctagttagtaataaaaatacaacttattcttttaaaggagtgagagtatatatatatatatatatatatatatatatatatatatatatatatatatatatatatatatatatatatatatatatatgtatatatatatatgtatatgtatatatatatatatatatatgtatgtatgtatgtatgtatgtatgtatgtatgtatgtatgtatgtatgtatgtatgtatatgtgtgtgtttgtgtgtctaaatatatgacggccgttttgtacttccgggagtacgtattcttattatcatccgattgaggttttgatcttattaaggaaacatatactccctccatcccataatataagggattttgagtttttgcttgtactgtttgaccactcgtcttattcaaaaattttggaattattatttatttttttgtgacttactttattatccaaagtactttaagcataactttttgtttttcatatttgcacaaatttttagaataagatgagtggtcaaataatgtaaacaaaaacttaaaatcccttatattatgggacggaggaagtataatttaccgttgcgtgcatgcacacctgattccggattcattgcagcgattcgttgcagcggcatgtgattcaattcaacttattaaatgttaaccataggatgaataaccaacatgatccttgaactttcgcttaaggattaatttagtccttgatattttgtattgtccaaacaagtccctaaagtccattgtatgatttaatatagtccttaaaccctctaaaaatgccatgtgtacatgccacatcatctatgcaagcatattgaatatttaaatatccattctacccttacgttttcatagaaaataaagaacaactattgagaaaaaaacaaaaaaaaggttttggcaattggtaaaaagatgtagcattggtaacaaaaagaatttggcattttcctttgttttatgatggcttcttcttgtttttccctttgtttttttataaaaaatgtaaggttaaaatggacattgaaatgttaacttgacatgcatgaatgatgtggacatgccacatcgcaatttaagtggttccaaggactatattaagccgcatgataagtttggacattacaaaacatcaaagacgaattgacatctgaacaaaagttgtagactggactggctattcacccttaacaatattgctaatattccaattagcatatactataagttatcagatactactactctttcttttcttgctaactgcttcttagaagtatatgctacttacgcaatgcaacagtacatatatatatgtatatatacgtgtatgacgtgaccatggttgctattgatataaccattgctcacatcatggatcaacaagaattcatcacgatcaagtcatctaagtgctggaatctgattcggccacctactacgctgacttcaaacggccactccgttttcgggccgcgagtacttgatgaaaagctctcggagtcctctttccaatggatccagccacatctccaaattctatctcagtcagctgtaatcgtataaacaaggtgttacgtcacttataatgggcgtatgaacttgtaactttatttgggaccccggcccatgtggggtgcgccccaaccaggtggagctcgactctggagaccccttgatcgtcctcccacctccttaaatagctaggtatcccttcagggtttcttgggttttgtttagattaaagtttcgcttcgcaactttgccgtgtgatccactggtcgattagatcgtcgttttgctagttacggaatccgaacttatcatttgtgttcaattcctatttgcaatttagattgtttttatcttgttctgcttgtttcttcactttttttttgcaggaataaggttgatctgcaccggcaagatcaacaacccatggagggctgtattgatcgctaaggcggaacaccacaacatctcatacgattgtagtcgggtcgtcaacgtttcacctaaatcgtagttatcatcaactcatcgaaagatcggaccaatagaaaatagccagaaaatattgcacccattagaaaatagccatagaaaatattgcatccattacctagccatctttgtgcccgctgcattggtcttttaagtttttactttgttgagttttgcgttgcatcgtcgagtcgtgttactggttttagcgtctagttagtttgaagtttcgagttatggtcacgtttagtaccactgttgtcaccgccgccgtgagtttgttgtcgtcgggacctgcaaaaaggggctcgtctcaccaccgggggttcgattttggtagtttttagaaatttccatcggtccatttgggaattgcatgtaaggtttgcctagacgtctaggtctttgcagtgatcgagagcttctgtttttgcatgcgaggaataaggaaggggacaagtagattagattggatcggttaaaagttagtttccgtttatatcttgtgcaagtccgcactcgccgtccttcaacacaaagaaatggcacatctctccttcgaatctgatttctccgtctactctctgtttcaatctataacgtgagttgcccaacagcttggtggaattttatcgagtgtcggattgaagatctgtttgcaaaaacaaaacctatgaatgagagcatcccattttttataattttaattttaggtttgcacttttgcagttgagttcctataattttcatatttacgtttgagtccctgcaatcttacattaaggtacttgaggtctttttttaaaaaaaaatccaaaaaagagaaaaaaaagtagaaaggtgctaaaaaaagaaaagaaaagccaaaaaaaaaactactgttgcctctagctggatccgccgcaaggccgcatcgctgcaggtgcaggaaccacctctgaccaacacccccttttcatcgctgctctggatgccacaaccattgctccctccacgcgctgccacccgtgcccccgcacggtgctgctgcagcttgagctcctgcagaccaccaccgtagaactcgccaccgagaaggcctgagatgaatggataagtggactggaaatgtggggatagggtttgtatactaaggggcattttggtcagtttaggatagtaaatacattttttttcctatatgaaaccctaaaggtgtagtgaaaatagggttagatgattgcttcgattgtaatacttacaaacttataaaagtgggatcgaatgaccaaacttataaaagtggggtcagatcggtagttaggcttcaaaacaaggtcaaataaaaaatcgccccatatataaaatatattatttttgacatatggaaattggacaaaatattctaactagacccaattgtaatacttagcaagtgtaaaccctatacaaaatactacttggcccatctttcaaaaaaaaaaactacttggactacttgtcatactctagacttaaataaataaaactacttgtggtggagtcgcatggtcgcaacgttaccactgtagtcgtgcaagtgctgagggtcatccccatggaagagcacgtgttgcgggtcggtgccggggcactagtggtcggccatatccggaacaagagctggggttcggtgtagcgccttctccttcacctatgcagccgccagcatttattttcagctggccggcaccctggctagcggctcatctagcggagccacagccacgcaagcacccccccccccccttcttgcgactccgcttcgtggaactcctcagctgcctctttcttcacgcttccctccacagtcattgccctcttcattgtcatcggagttagagtaggagtcgttggagtccttcttcggcagggccctgtactatcacttgaagtcgttgtccctttcattttcgcctgtcattttgcatggcaatggaggctgtgctttccactctaacgaggtggtgtcgccggaggagctgccggtgtagccttcgtcctcctcctcactggtgctaatgtattgggctgctgcagtgattcgctaccgcaggattgtgggtggagaaaggtgagacataaagatggtgtgccaagaaaacccacattacttattgttgacggtcgttatcgactagtttcgaccgtcaatattacccaattaatgaagactaactatgcttgtaatgcattattccataaataaaatattctattccactatatgcttggaaaactaaccatgcaggagaagctatcaaaatggaggagaatcgacagtacaacaatcgatcaatcaaacagacactgccgagaatcagacgtgtggatagatgggctgagaactcagatatgacatgatcaaataagcccaaaattctctgttctgagttaaggggcaaacgaggaatccacctgccgaattgtgggctgattgggcctggctagggttcggccgaaccaccagctggcccaatccagtccattttccaccggcagttatctacaggtatcctatgatggttgggagcaattctactagtagaaaccgtcataagcatggacacatggcacaaggaggtgaaatatgctctttggatgcttcatcatgctacatgtcaagaggagagcaaagatgctcctaggatgcttggagcatctccacactcccaaggcacctcatgggctataaatacccctcctctcattcattcccacacacacatcaaaaagaagatcaagagctctctcaagtattgtttagtagttctagtattagtggagtaggaaatataatagtctttatagtcctcgagtcttcaggagaattcgggtatggctttagtagcttttctctcttcttttgtaagacttattgaattaatagaatattcttctttataccctttcgataatttattccattcatattacttgagtgccgactttactttatacttgaattaatatagtcgtgtaactagctttccagataggtgtattggtgtgggtttagtgtccgattattcggttgctctatgtcggttgcaaggatgtaaagtagtatttagtaatataagcgcggtgcttagattattagataccattaattggggttgtatattgcggatgagaggtgggccgctgatggtgacagctcagtacgggtattcctccgcgccggtatataatcctaagttaattctctggggagggtattcctccgtatttagccccggttgtacggtcatgacgggccgtcgtaaggaactcggcagtcaggggtggcttctcgaaacaccaggaggacactgggtacggggtattggttgcatgactgtataatagcaagtatagactaaagatgtatgtactagaagtacaagaatgatacttttcttattctttctccacttagcttagactatattttagtgagagtagttcttagttctttcttctgtgtgtcaccctaccctttgaactaaattaacccctgcatagactattagcatagtactctcttatcatatcttctcttgggataaaataaatatgataccttggaatactcccgggtgaaatgctacaatagtatatccgtgcgcttgcggatcacatctgtaaccataatataccaggaatatttctagtgctactgctgggaattatattttcagtagtgtcgctaagaaataccaacacttatcctctatttatagcacaatagttgttccatgggagctaagaaggtgcagcatggtagtggaggacatgaccggcattcggcagttcatcctccggggagaagtgactacagtccacgtgaaaaccaatggtagtggatgttgttgaagactttaaattagtggaagggaagaagaaatgacatcaacacaacatggaaaatctgttttatatggcagcgcgtagtagacgagtcatatgtgaactagctactttgtggggattgggggaaggattggacaatatgcatatgtgaaccattttgtaattcaggatgttgatttggtgatcgcaattgaattattttttatttgagaagttgattttgggattacaacgtgtcgacttggctcggctcggctcgacttggcttggctcgttagagataacaagctagctcgagctagctcgcgagctggtcacgaccttaacgagccagagcacatgagctgtgggcctgtggactgtggcatagctgcatagaatagaaggcccaacagcctaacttggcaacagaaaaccctagctagtgtcgatcggtcaataccctttcatgactcctcgagtcgatccccttctcgtcgttctcgactcctctttcgcactgcaccgccgccagccaccaccgcctctgccgcctgctctcctctcctcacgcgttggcggcgccggacttcttctctcaattcctgcatctggccatccttagccaccaaaggagcggcgccagcgtcttctctcgccgcccgcatccagccatcctcagctaccgaaggagcacgacgctagcgtcttctcttgccgcccgcatctggccatcctcagccaccgaaggagcagcgccgacgtcttctctcgccgttcgtatccagccgtcctcagccaccgaaggagtgcggcaccggcgtcttctctcgccgccgcatcaggccgtcctcagctaccaaaggagcaccatcctctcctcctctgctggctgcgactgaaatggatgaagaacaagaggtgctgctttgacttctgagttctgtttggatggttttgctcgcgagcctaacgagctagctcaagctttcaaacgagtcgagccgagctaggtttctagctcgttaggatgatgagccgagccgagctagctcgttaggagctagactaagccgagccaagctggctcgctatccacccctatctatgcctataggtattgggggcgatcggctcaatttgaaccgattcattgagctgcttttttaaaaaaatttgtcactcctcttcggtgcctgttgtcaatcaggcacagatgagctcaccctatcaatgccgaggtgcctatcccaaatctggtgtttatggggttttggaaccgacgcatattagtttttctgtagtagtagttcgtggtatcccttctttcttaaacttaatgccaaaagttcaaacctcatgcttccacgtcatcatcaattgtgaaccgttagatgaatgcattagattgcttctcagtcgttggatggaacgcaacatagagcccaacccatcaggcaccgggtgagtctcttcgcctcttcagtgtcaaatgtagcccacatgaacacattggcccaacttcatacacatctacatgtatccggcccaacaatccatataaaagagctttatggttgaatgcccattcagataacattacaatttgttaacttacgtcataccattttgcttctttgtagcttatgctttgaatgtgctgtttgctaaaaagattttctccaagaaaaccatttgtttcttctgtttcttcttgagattgtacctcctatctaacaaattgatgttaaccaagtcccgcagcaacgcgcggggcatcctctagttctatttatatgggtgggtatttaaccctcttaccgggtaaacattatgtagtggttatgtatttttattcgcccgtgaaattaacgttagggggcatgtgaaattgatttctctagtagtgtctgatgtattaattactaactcagcatcatgtttacattttcgagggcagggcataagcaagcactctgtagacactggttagctcttccaaagaaatatacatgccaccttaattgacagcttttttttttaattctcttgctttccattcaacagtttggcagtcccctgacgatggatgtgtaccgtagagtcagcaatatatattaatttaagtgattcgatcaatccgatccgctggatcaccgatccgatatgcatgtgtaccacggtgacgaactaattaatctttatatgtttagcactccctgatggaggagcactaatgcatgcgtcgatcatgcatagggatggcaatcgggcgcgacaggcacgggtagtgcctacccatacccatgcccgtgagattatttttgcccgtgggtatacccattactacatgacgggtaaggatggttgtccatgcccattgcccgcgggcaccttatgcccgtgggcgtgcctgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagagaaaccgtagaaaacaaagaacgtggcttatgtattctagtggattttgctcctaacctacatgtaagttagattttgcgggtaaacgggcaaagcgggcatgggtagtgattacccatacccatgcccatttatccatcgggcatagcttttgacccaataagatacccatgggtataaaatagagaacaaacccaaccctaatagggtttttacccgtgggtaaacgggcaaacgggcacaattgccatccctaatcatgcatatgccactcgaacatataagctagtggggttgggggtgtgccagcgttatactggccttttgaggcgacatggcatcattagcgtcacgagtggtgagtgcaggtgaaaaagcaagtcaaagaagcttttatgtggtcgatcatgtacaaaaaacttgctcacggctctgctaccagcttatacgagcaggggtgattgatattttgatgagtggaagataactacggtttagaaaaaaaaaaaaaccttgagctaaaatcgtacaatacgtggtcatgtttttccatagcttattgatattattatgtagatcaaccttattcctctaaacaaatcaaacaaataaaccataactagataaaagtaatcaaacttgtagataaaaatcaaatctcaccataaatcggacactcggtaagatggggttccgaggacgagtaactaggaggttttatcgacacgcgcaactataaggttaaatagcaatgattaaattttaatctaaacagtattaaaaaaagatttttgcagatagcacggaaagggttttcacgtgcggtagggctagccgtgcgtgctaaatggtatgcaaaaattgctatttttgcatgcgggtggcgcaaccgcacgcgaaaattttgattttcgcgtgcgggtgattacgtcgcccgtacgcaaaaataaaaatatgaaaaaaaattaaaatcctaaaaatcatgaaaccctaaccctagaagctgccgctgcgccatcctcgtggtggccgttgtcttcgtcgtcgcatcgtcccttgttgtcaccgttgacctcatcctcgtcctcatgggggtgtaggaggcaaggggtggccgggtccagccactcccatcaccgtcgccgaagccggactcgttgcccctgtgcctccccatcatcggatccgccgctgccgcacctcctcatcgtccgatttgccgtcgccagcatcctattgatggtcgttataaaccaatttcaaccgttaataaaactataataaaagagaattagttatgcttataatacatatttgttttagaataatatagttctacttgtgcttggagaataatttattgcaggaattgagcaaataaaataaagaaaaatgaggaaaactcacttccaagcaagcttatggataagatgggcccacaagtcaggtgtaaccgtcctgaaaactgcgtcaactacaataacagtcataaggacccacctgtcaatgacccagagaagtgtggaggcatgctgggccagcctaggttcggccgaaccaggggttcggttgaatcttggctgctgcggctccggctggccttacacgtggacgtctaggatggcttgctgatggtggttgccgggtagaatggtcatttcgccttttctacaaccttcataccgaccttataaatggaggagctcattttacttcacacacactcaagcaatctcaagattcctctctacactttagtttagtatttttagtgctaagtggagtagaacataatagttcccagagtccttggagtcttcgaaagagttctggtatggctctagtagcttttctatctgcttttgtaagactttcagtattaataaaatattcttatttatatacttcggtactttacttagtctgagtatcgactttattttacatccgtgtcgttataattatgtgggtagcctaccagagaggtgcagtagtgtgggtttaatgtccgatttatcggttgcactatgttcttcgcgggagtgtagagtagtatttattaatgtaagcaaggtgcttagattagtaaatatcattatctaggcatatatgccgcagggcagtagagttgggccgctgatagtgagagctcagtacgggtatttctccacgttggtatatattcctaaggcaaattcctggggagggtactcctctatatttagcccgtttggatggccatgacaggttgtcgtaaggaactcggcaacccggagtggtctctcgaaacaccaggagggcactgctaggaggtattggccacatgattatatactagcaaatgtagactaaagattgggtgtgtcacatcctgattttcgtcttaggatttataaattatttaataaattatttttacaatttatattaaatgttcattaatttacaagtaaagttaaatgtgggaaataaaatttcctaaatataaagcatagctggatttaatttttattaaattctccatggttaattataatctttggaattttctcggatttttcggagctcaattcctaattttaataatacaaagagcatttcagaaaccatttaaatattaaattagtcataaaatggtctgattataatcttgttaagtactttgagtgtccaatcagtttcaggattttccttgaaattatttgagcattggaagtacttttaacaattcaaagatcatttccgtgattaatttaattggaaaagtatttaaaatccccttctccttttcgggccgaaataggaaaagttcagcttcagtcctcggcccattctcccttcctttctgctggccttatccctcctccaaagtccatttgtggtccctccttcaatcgggcctagtataggaaaccacacagaaaagtctagtttgcgtccccgcgctactgttcttcttcaagctccagccgcccgtgctgagctctgtgctgccgcttcctccgttgaatccgccgcatcccgtgcttcgtttgcaaaattagttgaggggatttgtttcccttatcctcctctatcttttcccccaagaatcggactttatcccgatgaaatcaacacggaatcgagctcgattcgtgtttatctctccaaaccaaaccctaggttttcccggcgcgattacttgcgttccaagcccgatctctctcatccatgcctatataaaggatcccctagccgccctctttcgtttgccacccttggccgagctcgctgtcgcccgtagcgccctagccgcctccaccctagcgccgccgccgtcgtagccgctccagccgtgccgctcgtctccgtccatcgtcgccttcggtcgccgtcgacaccatcgggttcgcaaggaggagttgcacaccgtccacccctcggccgaagccgaagcccgccggagcgccgcggacgccgtcaagccgagcccgtcgccgcttcaatctcgtcgccggccgtcgtttgtcgtcgttcgtcgttgttctttgcaccggtgagttcgcgtcgtcgtcctcttcgtgttggtgtcttcggatagcccaaccgagctctctatcgccggcgcagttgtggtccagtgccatggctgcgatgatgtcatcgtgacatcataaaatcttttttttagtttttctgtattagatgaaatctgattaaacttcggaaattcataagtaaatcatcgtaactcggatttaagttgttcaagttgctaaattcatctaaaatcatgatctacatgtttgtttactttttatgtactttttatttggtttttattagtctttttctttgtgttgcgtgttagcttgtcgttttcgtcgttgcgaaggttcgtgagtgcgtcagaagagattcagaagactaattgaagaccgattattgcaaggcaagtcacatagatcccaaacaaccctttgagcatgttgaacccgtttaaagctaatgttttatttcaacttatgcattattttttgaatgtcatcgggtggtgagcctttctcaattaattaatggccgaagatgactttattttcctatgggttataatttgattagctagaaccttatatattagtttggttcaactaaatgctacatatgtaattgattagccatgcttagaaacattagctcattaatgagatgaatcatactacattattatttatgattatatttaatggtagctcacgatggttaatcgtgttatgataattaaatgataattaaaacctgtcaatggtgggttgtgagcacatggttttgaaggtcgtgttcatgacaattaaggaccggttcgcgagctaccgttgtgagacattaaccgtaacaaccagaagccagcgtgggtaacggctttaccttttgtatagcatgattcattgcggggtgccagattgagaagtggcgagaagtctgtgggggtcgctggggagtccatgcctctggttatatttatagagggggtgattatgatccaggaatggtgcactgtggtgagttgtgttgtgcagaaggtactgtcacagcctctattcgggtactttccagtatcgcgacgcatggaagacatgatgttgaggctgtgtcttgtgggtacagtggtacacctctggccagattaaaactattcgaatagccgtgcccgcggttatgggcgggttgagcaatgtttttcatgattagtctcacacctctcacaataattattgatgctataattggtaataatttgcttagctcctggtatggagttagatctgtgcagccgggtttggttgttcagaatggttgggcctgagcagcatgggtgtgctgttcagtgttgattaaaattgatgattactctactgttttactattcttaaatatttgctaaatactgcttttgcaaatgagcctatattatgcaatcctttggtatccttgtgcacttgcatatttgctgtgtggcttgcggagtatgtcatatgttcaccttgcaataatcaatcaacctcagttgaagaaaaggatccagaaggagaagacgtttggcttataccccagttgagctgcctgtgggagtggagctgaagccatcgctagaccgttaattccgctgctgttttcttttcttttgtaagtatgtaacgttattattacgatggatttgtatattaaattgtcagtttgtgtacctcggatgatttctggatgaggattttatgcacaaattagttcagaaattactagtgaatttccgggtgtgacagggtgtatattagaagtataggagttgagttctttctatttcttcttctacttagcttaggattatttatttgagggaatctaaaagcttcgcttcgtgtcactctacacatatattaaattaaccccttcttagactttgatgaaggcaagtaatatatatgtgtataattattagcatggttttctctttcacatcttcccttgggattaaataaatacgataccttggaatagttcaaggtgaaatgctaatagtggtatatccgtgcacttgcggattacttctataaccataaatatactagaactatttccgtgccattgctgggaaatgaatatttctagtaatatcgttaagaaataccaacacatccccaccaccagatctgccgccgcgccttcccaccatcatgcctcaccactgccagatccgtggctgccgcacgtgaggagtgcagccgccgtcggatccgcgtgggcgacggccagcagatgatggccgccatcagatctgcgccgtcgcacgcctcctctacccttcctcgttgtcccgccgcaatcgccactgtcgccgtcggagtggggagaagtgggggagtggggtagtggggagagagagaaagagtgcagggagagagttatgggagagagagaggagtggagattcagtaaaatgagagtgggaatctttggggtatttttgcatgcgggtgagttaagagcactgcatgcgtaaaaacccttacttttgcgtgcaaataatttaagcgggccgtctaaaaaaaatggatttttgcataaagatgtctgaaggagacacaagcacacacgtgtgtgaaagagatttagattgtagaaggcagaaaggctatgacgcgaccgcgcgagcggagtcagatgcgccccgctcgtgtgacgaggcccctttccttttttatcccaaatcccatttcctttctaagtagttcattttgtggtttctattttttttttggaaaaagtacaccgaaggtcccttaacttgtcatcgaattataaaatcatccttaaaccgcaaaaccggatacaacacatcccccaacttacaaaaccagtgtaaattatgtcccttggcagttttgactccggttttgtccgatgtggcagctgactcagcgtcggacccacgtggatcccacatatcagcctcttcttcccctctcctctccacctctctacctctcatccactttccacgggcgacattgacggagagcagttgggcatggtgcagcgcgcgtgggcggcggggtagcagctgggcacgaccgatggccggctggggaggtggtgggcacggccgacggccagcgggggaggagcggggcatggccggcacccgccgggaaaggagctaggtagcggcggcggggaggaactggatgcagccgccgcccggtgcgggaggttggagaggatgctgaggttggtgaagaaggcgatgacgaccgtggcgaggagcatgacgacggtgccggggcaggcgcggagctggccggcctcggcgacgtcctggcgcttccttgtcgtcgccgttgaaccccatgacggcagatgggcgggggcaacgctggccctagtagagtgatgatggcgagaacgcagtagagcgcggtggtaagcgaaggtcgcggtaatggggaaggaagagaggacgagaaccgctgtgaggaggaccgagcacgaggtggttcgtcggcgaggtgggggagagcaagcagaggacgtcatcgaggccttcgagcgggagcgctggaaaaaggggcgcctcggcgcaggcgtcacggaagacggtgtggagcacggattccgcggtgggaggaccgcacggcctcccgcccgccctcccctgtcgccgtgctcccccagccgcgcaccgctccacaccgctcccgacggctgcgcgcctgtgaccagctcctcccttgtcggtgtcggcgtgggagggtggg

SEQ ID NO: 35389 - DNA, 7074 bp, Oryza sativa
  unsure (1)..(7074): unsure at all n locations
nnnnnnnnnnnnnnnnnnnnnnnnnnnnnnnnnnnnnnnnnnnnnnnnnnnnnnnnnaaattgagctaatgctactgtgttaataacggtctcattaggaaattatagaatctttaataaatcttaaatatcggacaatattaaattttgggaaaattcacacttggacacttaatatggtcacccaaatgcataggagtaatacaaatttaatttataacttttctcaatttataaatcaaccaaagccctaaaagtaggaaaataggaatacttaggaaaatatataataaaaataaaaatatgttcaatattaaatttgaatacaaatttcgatggagtaacttaggattggtgtattttacattgtgacaaaattagtggcaatagtatatttttcctaattgcaaaataccctctaaaataaaaaaatagttggctagcactgttcattagccctctaggtgtttgatttggttccctaaccaccacccctcctctgccgcgctccgcctggaggcctgcgtcgcccctgcgtgtgctgcgccgctgccttgcaccccgcgccgccgcgcgccgtcttgtcaccgccgtcaccctgccgcgccgccacgtcatgtcgccgtcgccgcgccgtcttcattccgccgcacgccgtcgctgttgtcggtcgcatcgtctcgagccccacccctctgtgcgtgccgtcgccttcgccgtcacgtcgtcatcatcgccgcgccgcgcgccgtcgccatcgccgtcgcgtcggcttcgctgccacgccgcgcgccgtcttgtcgcgccccgcgccgccaagccatgtgccgctgctgcaccgtcgtccgtcgcgtctcacaacgatgagccccgtgccacgtcccgtcaccgcgcgaacgtcctgtcaaggcgccatgccatgtgcgcctatgccctatcctcctctagcccagcatctagcccggttggcaatgggttggcaagcttatcttctccggcttgcctataaaagcatccccaccatctcccttcctccccacgccatcttggctgccatcacaaggccaagcccccataaaaccccatccctctctgcctcttccttgtacacatttcgtcgaacatcttgtgggcgtgctgcaccttcttctccacaccaccactgcagccgatcttcgttgtcccgccgtctatcggtaagtcctcgctcctctggcctcccctagttccgtagaaactagagccccctttaatttcaccaattagcaaccgtcgccgtgccggtccggccaccgttttgccgccggtgagctcgccgtggacaagccattccggagctcctcgtagtcatctcgttagtaaaatggaaccctcacacgtcgtagatactcacgtcctcaccaatttggtcgaaaaccctccgtatcgccctagcacctagctacccgtgcccggccatggcggccatggcggccatgcggcgccgctcgccctcgcgccgtcctgcgcagtgactgccgacaggtggacgccggagccttgccgctccctcccctggtcaccgtcgggtcgccctcggccggccttgccgcgcgcgctgcgtctcccctgctactcccgctcggtctggagggagagaagaggaaaacagagaaagagagagagaaaagagaacagagaagagaggttagagtgggcccacctgtcaatggttcataggatttgctttagaaaaataatccagtaggaaagcaaatacaatcctaaaccccacatgtcagtcacttggagttttggataaagtttaggaataaaaataatggattaggaacagtacctttttacaatttctcggatttattcaaatttgaaactttaaactagcataactctctcattttaactcggatttgagtgaaacttgaacctaaatttatctaaattcataagctttccaatggtatataattcactattttataaaatacatttataattattaaataactaatactaagataatgcataatagttaaaaatgtgctaataaataaaattgatattgtactgtaaagtagatgtcaaataattgtctttaacacgctttttcactgtaaaacctatgtaaactaattaggagcattgtttcaaattaattaaagcataggaaatactagtgccatttattaatatatgtcatgtcaatatataattatacccataacgtccaaactatataaataatgtttagcctcatattttgtgactaaaatataaacacatgttgatgagtctttaacttgtttatgagaaataatagcagagcttgtatgattaaaccaccaatatgaaattaattaacgacatttccaatacagtagtatatgtttaggttggaaatcgacccttaagttgtatagacagtaactcactcataaatccacttaaaatcacatgtactatatagcttaagaaaatagcagctattcaaataaatgattcaatattaagatattgtgcactcacatatactgtacagtccattatagctatacgttgtagtattaaatcgcttgattgcacatattaaaattaaagaggatatatgacaaacatgtatggtggataaatactaattatagaccttgaccttatataacccaagtccaattgtagattaggattattcattgtaaaattatgtgatgggataatctgtaaccataatatgattaacctaaacaactctaacatacaaagcatggataattattaaccttttataatttattgtgacaagtaaaatatgttcataattaaagcaaagcctccatcaattaaataataatacaaatgattcattatttgattgatactaaatccatctaacaacagaacctctggtatgtaaccgtgctatttagatagatgcatatatagccataatccttccatagccatttgatagactaaaccgccgattagccaaatatatatgtataccataaatgctatgttggttaactcctaaatagaccacgatgaaaatagaaagattaagaaactttagcccttggcatgattggaatccattagcaaacacgaatagtacattttattgtgcatatttgattgttgttgaatattagtttttctcgcgtattatagaccttgtgtatcggttagtcgtgaggcaacgtctgcaacttctaggaggtgaaggttgatcaagaattatatcaagaataaggattatcctgagcaggcaagtcatcactattctttgaacatgttgatcccaattgcgaaattattttgtttacaaataaaattgcatgcaatgatgaacatcccacttgattatgccatgccttgattgttgtttacccttaaaatctttgtaaccatgattacgtatgagtccttgtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtgtccggaaaaggctagtgccgtccccggtcaattaaggaccgagccatgaagttaagcatgaaacgacccccctacaaccgcacttctcgtatgggtatagacctagcggagtagatagctgagcggaggcaatatccatgcatagtggtttcttgatgtgtgaggcaggggctctacggtggggcagccattggtaggaccacgaggcgggtgtctacagtggtgtcgccattggtaggactgccatgtgagaatttaaacataattataacttaatgcatgtgtgagtcttcccttcccgggtgcgccagaactcctctcactgctagaaatcgtattacgcctagagtgcatgaggatgtaaagttcatggagcgggtactgccaatgcgaggttatcaaaaggctttgccgtgacgcatctcatgtgttgggatgaggctcatgtgttgggcagtcgcggagtgctggtaaagtgtacatccaccgcagtgtgagtaaaccaaatctattcgaatagccgtgttcgcggttattgagcaccgggacgtgtattacacttggctagactctaaattcttaacttgtgtgggatgggttattgcatgatgattttatgctgtgggagccacttcctgagaggagggaaggtggacgtcctcagaaaaccatgacgactcaatgggggggaagcaatccttgggatcacaatggatggtggacagaaccgtcgttgtttaatgtgaacactggtattaaaatttgatcaatctatgctaggtcttaggcttgtgaaaagatttgcaaaacttgctttgcgcaaaggaacctgaagccattccttgaaataccctatatcatatgcatcgttgctgtggtggcttgctgagtacggttggtactcacccttgctatttatatattttttaggagagtgttgaagagaagcccttgtcggtacgcttgcgtatccaacaagatgatcggagtgcggtcttgttctaggtctcgtttccccagtcgactgcctgtggcatgttaaccgggcccttatattattttgtcttccgctgttgttctctgatagttgttggcctacctggccctaatgtaagtatttaactcttttagcctgaattcattcgtgatatgttgtgatccaactatgtatgtgtgtaccaactactgatccagggattggtacggataaacacagaggatttccgattttcaaaatcgggggtctacacatgtgggacccatgtgggtcccacgctcatgagtcagctgccatgtcaattaaaaccgtagtcaaaactgttgagggacctagtttgcactggttttgtaagttgggggacacgttgtatccggttttgcagttcaaggatgattttgtaactcaacgacaagttaagggaccttggttactttttccttttatttttttttcaacggatggggctacgagctacatgcttgggaggcccacgactgcatgcgcgcccttatatacccacctttgggcctccctactagttgggctatttttacccaaattcctaagaatacaagtttttttttaacttttttttatcgatgggaactgcacagtatcgatattcaaatgttcgtatttttataaaaaaattgtatttagaaagttttagggataattgtgttcttgtccttactttgagttacaattgtaattttgcccctcttttttagggtttgtgattttaccctactttttttgaattgaagcttcggtttgcccctgttttagatggcattaggtgggtccagattctgtaagataataaaatgaataaggtaaagaaaaaattgtttacaaaatgtagaaagaccattgtagccctgtaaaaaacacttaccagttaccaccacccagccatccaacccatcctcctctcccatcccaaacaggtggatgcatgcgacggaggtggcggcaccggagcaactcacgagcaggctacgacggcgcaagtggtagcgcttgccggcgtgagcagcggctgctcggtagagagggagtaggcggtgctgctcggtcaacacgcgagcaggtggtggctcagcgacgcaatagcaggggaaggggtggctcagcttggctcagagacgctgtagcttgctgcgaacatcgtttagagtaggagcagccacaaggacacacgacaagcaagctgtggagattatagataccctatacccacatggtatatatatccgactgggtataggggtactgtatgtagatagaatatctttaagagacttgggttaaattccaaacttgtgtatcaaggaaatacccggagtcttagtcgtttacgattgtattttatctttactcgcctattccgttaggaatatgggctgtaccttgtaatacggactccttcccctatataaggaggggtccgggtgcctcttggggcataacttttctcccagatcatacgatcaataatacactcgacggaccaatccatggacaggagtagggtattacttctcattgaaagggcctgaacctgtataaaattctgtgtctctaaacccatccacttctccagattgatagctacccctttttgtattgctgaaattttgtttcgacaggttgcgtgccaggtaggcgtagcgtcaagtttttcgccgactagtgcgatgggttttgtctccggcatcgacgacttcgtcttccctcccgggcaggcgttccagttcggcagcctcgacttcatcactaacgactttggcaatatttctctccttgactcggatccgaaccagtcagggagaggtcaggcctctgccccgttcggtctcccaaactcggccgagatctactccaagatcatctcatctgagtcggcttcaaactactcggaagagatccaatctacttcgacacgacctgatcaagacgatggggcctatccttcaatcctgatgaagctccccgatgacttggctgctatttttaccacaaggatgtctcctccccgtaggtctagacgggatctggtctctgctccaatccaatctagctccagggaagtcggcgtcatactccagcctctcgggacagtttcgacggaagaattggacggctacctcagcttccccggtgtcgactctcgaccgacggagatcctcgagtacgacaacttcggctaccactacgactacagcaacctcgacgacttcgacgaaggctacgaagacaactacatgcctctcttctttggcgttttcatggctaataacgagacggcataacagcgccaagcccgagaagcagaagaacaacgcacatgacaagaagctgagcgtcgccgactggaggaggagcgactagcacaagagcgagaccggctgcagcgtgagcaa

SEQ ID NO: 35390 - DNA, 13603 bp, Oryza sativa
tcgatcttcgcgatactatcaatcggcgtcacgcgaaaagaggctatattccccaccattcaccagatcgttacgacgacgatgtggatggagttgccgccttcacaagcgacctgcgtcgagtggattggccagccggcttcaagccgactggaatcgagaagtacgacggcacaacaaatcctgagtcttggctcaccgtctacggtctcgcaattcgtgcagcagaaggagatagcaaagccatggctaattatctgcccgtggccttagtggactctgcccggtcctggcttcacgggttaccccgtggcacgattggatcttgggcagagcttcgcgagcacttcatcgccaacttccagggcacttttgaacgccctggcacccagttgacctctacaacgtcatctagaagcctggagaatcccttcgagattatatccgacgtttttctgaacaacgcaacaagatctctgacattaccgacgacgttatcattgccgccttcactaaaggtattcgtcatgaacttttagtcggcaagtttggacgcaagcctcccaggacagtcaagcagatgttcgaaaaggccaacgaatacgccaaagcagaagacgatgtcactgcatctaagcagtcgggcagtacctggaaacaaaagaaagatgcgccaactacaggagggagtggaagtgccaatcacaaggatcgcaagcgtaagcccgaggaacttgtggcaactactacaccatcttcccgacagcaatcacgtgtcaatacctttgacaagattatgaatgcccaatgctcacatcatccgaactcaaaccatgcggccaaagattgcttcgtttataaacagttcgcagaacaatataccaagaaagcgcggaagccaactgatggagaacagagctcgtcaaaaaagaaagatgaagaagacgatgcaccgattggctttcaagatcctcgaaaggaactcaatcacatttttggtggccccatggcatatgagtccaagagcaagcaaaagctgactgaacgggagatcaacgccgtccagcccgatacaccccaatatcttcggtggtcggagacaacaatcaagtttgactgctcggatcatcctgaccgagtggtccacccggggcggtaccccctggtactagacccagtggttcacaacgtcaaactccgacgatccctcattgatggtggcagtgcactcaatatcctttttgccaagactctggatgacatgcggatccctcggactgagctgaagccgagtagtgcgtcctttcatggagtcatccccgggctatcttctactcggccagatcactttgccggtcaccttcggcattcgggagaactttcgcacagagaacatttgcttcgaagttgttgatttcgagacagcgtatcacgctatactcggacacccggcgttagccaagttcatggccgtcccacattacacctacatgatgatgaagatgccaggacctcgaggagtcatatctttgcggagcaacatcaagcaagccgtcacctgcgataaggaaagctgcgagatggcccagacacgtgagatcacacttgctcgagaggagatccgactggctgcatcaacgacaaccgaaggagaagtgcctgcacccaagatatcaaagaacagagaaagcgacgccaagaccaagaaaattccccttgacccttctgatcctactaaaactgctgtaataggtgccgagttagattgtaaataggaaagcgtgctcatcacctttcttcaagctaataaagatatttttgcatggaaaccatctgatatgcctggtattcctagagaggtgattgagcactctttacatgttaaggaaggcgctaaacctgttaagcaacgactccaccgtttcgcacaagatagaaaagacgcaatcaaggaggaattaaccaagctgttagcagccgggttcattaaggaagtcctacatcccgactggctggcaaacccagttctggttcggaagaaaacaggacaatggcgtatgtgtgttgactacaccgacctcaataaatcttgtcctaaggatccctttgggttacctcgcattgaccaggtagttgactcaatggccggctgcgagttactcagctttttggattgctactcgggttatcatcagatcagcttaaaagagtccgactgcttgaagacctcattcattacgccttttggggcttactgctacatcactatgcccttcggattgaagaacgttggagcaacttatcaatgcatgatccagaggtgtttttcaacttagattggccgcaatgttgaagcctatgtcgacgacgtcgttatcaagaccaagtagaaggatgatttgattgcagatctagaagagacctttgccagcatccgcgcattcaggatgaagttgaatcctgagaaatgcaccttcggagtaccgtcagggaagctgcttggctttatggtgtcccgtaggggtatacaagccaacctggagaaaatcaatgccatcctcaacatgaaaccgccgagttcccagaaagatgtccaaaagctgactggatgcatggcggcactcagccggatcgtttcacgactcggcgagcggggatgccctttttcaagttgctgaagaaaaccaacaatttccagttgggacccgaagcctagaaagcctttgaagacttcaagaaacttctcacaactccaccagtcctggcttcaccacatccgcaagaaccactgctattatatgtgtcggtaacatctcaagttgtgagcacagtcctggttgtcgagcgggaagaagatggccatgttcaaaaagtccaacgaccaatttacttcgttagcgaggttttggccgactccaagaaaagatatccccaggtacaaaagttgttatatggtgttttaattaccatcgggaaattatcccactattttcaaggtcactcggtcacggtggtcacgtcatttccactcggagatatacttcgtaatcgtgaggcaaatggacggatagcaaagtgggccctagagttgatgtctttggatctatccttcaagccacgcacctcaatcaagtcccaggccttggcagattttgtcgccgagtggaccgagtgccaagaagacacgcctaaggaaaagatggaatactgaaccatgcactttgacgggtcaaagaggctttcaggcactggagcaggggttgtactgatttccccaactggagaaaggttaagctacgtactgtggatacatttttctgcatctcacaatgtggcagaatatgaggcacttcttcatggattaaggatcgcggaatccttagggattcggcgtctgatagtacatggagattctcagttggtcgttaatcaagtcatgaaagaatggtcctgcctcgatgacaatacggctgcttatcgacaggaggtacgcaagttggaagataaattcgatggcctgaagttaacccatgttctccggcatgataatgaagcggccgacaggttggccaattttggttcgaaacgagaaacagctccttgtgatgtgtttgttgagcatctttatgaaccaaccgtaccaagaaaagaaataaccgaggcggtagacattcaaaaagtaagcatgatcgacaccgactggagagagcccttcatcaagtttttaacaaagcaagcactccctcaagataaagacgaagccgagcgaatttccaggcgcagcaagctttatgtcatgcataagaccgagctgtatgagaagagcccatcaggaattctgcaacgctgtgtttctttggaggagggaaggcaattgctaaaagatatccactcgggcatttgtggaaatcacgctggcgcacgaaccattgttggcaaggcttatcgcagggttttttctggcccaccgcagtatccgacgccggcaaaattgtgcgaacatgcgaaggttgtcaattttttgccagacaaattcatctaccaactcaggagttgcaaactatcccattgtcctgaccgttcgcggtttgggggctcaatatggttggccctttcaaaaaggctaccggtggtttcactcatctttttgtagctgtggacaagttttccaagtggattgaagccaaaccaatcatcacaatcacagcggacaaggctagagatttcttcatcaacatcgtgcactggttcggggtacccaatcgaattatcactgataatggtactcaattcactaatggtgtgtttaaagatttttatgaagactttggcatcaaaatttactatgcctccgtagcgcatcctatgagcaatggacaaattgaacgcgccaatggtatggtacttcaaggcatcaaagcacaagtctttgaccgactacgtccctacgccggcaagtgggttgatcaactgccatctatactttggtctctgcgcactacacccagtcgggctacagggcaatcaccgttttttctggtttatggcgcggaagcaatgttgccgagtgaggtagaattcgaatctttgcgatttcgcaacttcaaggagcgctacggagaagaccgagttgatgatcttaaccgactggaggaagctcgcgaggcagccttgattcagtcggcccggtatttacaagggttgcggcgctatcacaaccgcaatgttcgatcgcaggcattcttggtcggagacatggttttgaggaagattcaatctacacgagatcggcacaagttatctcctctatgggagggaccgttcataatttctgaggttactcggccatgttcttatcgactcaagcgcgaagacggtactcacgtcgacaactcttgaaatattgagtatcttcgttgtttttatgcttaggcattactcatgtatattcttttcctttttgactgccaacatcaaattatctcttgaagttaccagtcgggggctattataataataatggagtgtgatttttatcaattcaatttgcttacttaatttatcattgccctgtctgattttttggcttagctaatgaggattgaaagttttttaaggacttttgcgggttctaggctcaacaaggtctgacgagaacttttaagaaatcgaacgctaagtctagattatcaagcacagcataaatacatcagtattgtacaaattgagcctccagcatcaaagattacatcatcaattagattcagttttctcatcgtcagattcatcagacccagtcggaccaagattgttgtcttgaaatctctcaacaacatcagcagcaatcttgtcggcagccttctgtgcattgttgatgaggtcaagggcatcttcttcacttgtcccatccgcaaagcagtcgatggcgtcaatatcgatcttcggatacaaggacttggtcatcgccaatgccatgctcgctcccatgcatccagcttctttgatgttcttaaagtatgtatccggagtagttctcagcttgtcaaagatttcaacaacgtcgaatgtactcggaccattgttattaaaaaacatagcttggatgagtggtgtagcggcatttgtgccttcatccctagctccttctagcttcttaatcttgttgaccaagacttcgaattgagcctgagatttaattttgcgatctgcataaaaggttcaaatcaatgtctgggcacgaagacaagaatagttctagagttctaactacaaataccttcaacgtccttgagagctgagtctcttcgcttggttagttcacccttgtctttttccagagctttgattcgcttttctagctcggtgatcttggcagcttgtactgtgatacatcctagtggttaattgaatgcggatggcggcttggagtaagttaatcaaggatagggaatacctttggatgaaccactcagctcgaaattggaatcttgaagctcagcaattcgatccctgagatcatgttctgtctttctggctagctccctggtttcatggagttgggttctagttgcttctagagtcccgagatgagggaccagtttctcaagggttgttgtttttgcttcgttccgaagatggattctctgcatcacaaatttattcagttcagcggagtggccgacaggataggtaaagctatatgcaggaaacatacatttacaaaacgggtggcttgattgagtgtttttgcaagcagagacacttcctcgtcttctttctgcttatttattacgatcccttgtggctgcatttcatcatctcaccatataactaagatgggtgggcgagaatcttcagctgattgaatccgaagaacttcttcttcgtcaccaatcattgggcctttacatatgcatagatggtggtaaagcaatcgaagagaatttttcaaatgtaaatgaattcagagaattgattacatgctataatcttcggtggaggacgagcaggctcttgcaccttatcagatgaactggatttcgggccggtgtcggtatcttttgggggagggctgcttgcttgtgcatctgtttccgggatatccttattatgttccatacccgactggtctctagtcgggggctcctgattagcatcggcctcagcttcagccgactggtttccagtcgggggttcatccccagtctttacattgtcggtcgccggctgatcaccagtcgggtgattttcgtcagtcggcccggtttctttggtggtcgtagatccagtctccttgtcagttgattcagggtcttttccagatagagcaatgtcagatggcttcctgcagattcaagatatgccatcaacgatatcttgatggagtgtttgacaatacaggagaaaattgcaagatgactcatacctggatgacttcctgattttgggtatcggacggctggatgttttcttcttcgggttagcctgttttggctgctttccagtcacctctttgcttaaagttttttcagcattgtcaccctcgtcatcgctcaagactaattttctcttctgagagcccgactggttagtcggctttgggctgctcggttgaacagttggctggaattttggactgccactggcctgaccagtttgtcggcgaggagagcggcattgagcggttggaggatcagatttcattagagaaaattcctatgcatgatatttctagttctcagccaatattacaaaagataaaaggatatcgtaaggaatgccggaatatttgatacataccggtggaggagggttgaaggcgttatatggcaccactggcagtaggtgcgaatagctgaccacaataccggttaagaaaattttatacatcctctccttcatgatcttaaattcgagggactccggatcttcacggttggggtcatttttgccatcaaactcaaaggcggtgcgggatctttctttgataggcgccagtcggctcttgatgaagtgccgagtgatttgctccccttgcagaccttgctctttaagtttcagcatgcgctccatcagggtaagcgcttgaacagcttcatctcccattggaagcgagttccaggtgtcttgatatactggaggaaggcaagagtactcgggaagcgccagttcaggattctgcacatagaaccagtttgcgtgccaacccttgtttgatgttttgaagggcatgaagaaatatttctggctcagggtgccccttagctgaaaaccggctcccccaacaacgcacggcttacttttgtttggctggggcttcaggaagaaaatgcggcggaatagggcaaaatgtggcctaatccccagaaaagctttgcaggcatggataaagttggcaatatgaactatggaattggggttcagatgatgcaagctgattccataaaactccagaatctccctaaagaatttcgaagttggaagagaaaaaccaccataaaagaaatgggagaatacaacgacctcgtgcgtgtccggggtcgggaatgcttcgccatacgctggacgccagccgatgatctcctttgtcagaagaacaccgtgcgccaccatctctttcaagttttcctccgttacatcggagggagcccattgactctcgaagctttctctctcctctgccatggatgtgagatagatgatgagatttgaagtgggaatggcaaaggaatagatgggagattgatgcagcggttgcgcggaagatcttcgcggagctacaaagcctcgtcaaggtggattgatgtggatttgtgaaccctaattttcgctggagtggttgttgtactgtagcgaagaatggggatagtggcggatgtttcggcggggaagacgaaacgactcttgttctgtgtcttttgttagggtatcgggaggtactaacgggcccgggcctacacagtactttcagcccaacttcattattggcgtggttggtcgtgatccttagggatttaagcatatatttttgccttggtaaaaattgctcacaacagaatagcccaatgccgttaaaatcctttttgatgcagctagataattctttggaattactacaatgcgaaataaaaaggtgcccgacagaaaagtgtaatactaatttttttggccttcttaggctacaaagctgcttgggttttattgagatggctaatttcagatggctattctctcagcatgttatatgcttatttcgataatgacataagtcatagcttaggctattttgacttgtcatttgtcattctttatacaacggttgatgaaccctttaagagttttttactcggattcttatcatatatgttggtctatagatctttagagtatttttcactcgggtctttctctgccttttcgggcattttaaactaaagcagtcggccggatattttatcaggtgccacatatgcttaactatataatcaccttggagattcagttgtaaaaccactcggatggatatttcatgtaccttgactatatgtttagttcttatttaactaatcacatagtcgggggctacacctaattaggtgcatctagtcgatgcacctgattttttattttttagcccttcacagtctttgatttaagtattcgggagaccaaggcaggaataattaaagcacttgggatatcggttttcaagattacaagagaaggctattccgtcgactgtaaaggcctcaggggctactgtggagattatagataccccatacctacatggtatgtatatccgactgggtataagggtactgtatgtagatagaatatctttaagggactcgggttaaattccaaactagtgtatcaaggaaatacccggagtcttagtcggttacgattgtattttatctttactcgcctattccgttaggaatatgggctgtaccttgtaatacggactcctccccctatataaggaggggtccgggtgcctcttgggtcataacttttctcccagatcatacgatcaataatacactcgacggatcaatcctccgacaggagtagggtattacttctcattgagagtgcctgaaactgtataaaattctgtgtctctaaacacatccacttttccagcttcatagccacccctttttgtattaccgaaatcttgtttcgacacaagctcatccacgaggtcaatgcaagggatgctgcctcctgattttctttttgtttttttgcccatctcatagtatatatttgggagaattttgtttggtagattttttttcttgtgaatgcgatgaatccttggtgaattttttgcgccctgtgcaacttctgtaaaagtgatatccaagctctatcaaaatctgtcaagtttggtcaaatttgagagcaaatgtaatgggtatatatgtcttcttgcagctcatttgacaccgttagttggtcttaacagagtaagggcaaattgaaacttcgtttgaaaaaagcaagggcaaaatcacaaaccttaaaaagaaggggtaaaattacaattacaatccaaaataggggtaagaatgcaattgccctaaagttttaatatataaattttctacctatctctactataataaaaattgaagatgtttttattggtattttgatatgtcattcgtatttgagtcggtttttaagtttattttttggaaatacagatccgtgtatgagtcggatttaaattcgtttgcttttagaaatacaaaagaagtcgtataagaaatttctttaaaaaaattttgcatgctatcttgaggtaaaagttaaactcctaattacagctaatgattttctaaaaatactatctaagtgaattcacataatgattttcatcctagctaaatgttgacgtaaaacatgaggcctgggagatctgcttaactccagtgcaggtccaaaactcgccttcgggtatactagtgtcccagttgatttgatcctgcaatcaataaggaatagagacaaagaaaccgcgattaaacctataaatgatagccgatcggctagatgccgatgacatatcatttatctttgagccgatgtcatatgtaaatcaatcagcgtatagttcttatatcgatatatacttaaatcatgtgattaggatagatcggtcgccatgccgagacagtataaatcacttagatcgaaatatatattaataacaggactatatatgtttatagcatagccgatcggatagatccagcatgtatcggctaatattccgatacgactttatgttaagatgttaaaacaggcagaatataccaaacagaagcttaatatatttgtatgcaatgaaatcttaacataaagggcagatttaacgtgttaataaagcatatagagcaaatatagttaaatcagataagatcggctgaaactccgacactaccttaatcggcaaccaggaagcaggctagagattggtattctaagcacgatttaatagatcaaactcaactgatgcaacattaagtatgaaaagaagagcaatttctagacaatcaagccgctggaagtttcatagagtggtggatatcttatataatataaatcaacgtcattgtctaacctaatcaactgccctcttccaacagatgttagccgattgtaggttaaataacgatattgccaaagattatgtaagatatatgataactcgacagattacataaacaagattagagtatcataaagatggaagcactaatcccgagaacacaagccgttataacaagttttacctcttgttgaagatcgaaaccgatgcagctcaacccgaaagcaagaactcgtcgaaataaaactaaagcaaggcgatgcgctaaaattgtattgaacgtgtgtgttaattgattacatggggttcggggtctatttatacctgaaaattacaaacaatgtccatatcggacacgactcttatctctaacaaactctaagataccataagtctttacggcagacttttgcccaaacatatctctaaggaaattacataaaatatcctaattaatagatacaattgccttctcaggactctatccatgtgcggcaatcatcttgaagtacctcgatccaacccgatgtcataaaccaagtcgtattgtcggaatcggctgcatcggcttacctagtccgactcagacccagtcgatcctaatcgtagccgatctggactccagccgattctttctctgttctcgaaccgatctccgccttcgactccacttcaatctaatcttctttttcgatgccgatattaccaaatttggttgtcaacactaaaccatataataataataaaattaaaatagcaatcacccgttataacgcacgggtattttttctagtagttatatacattgaaactttacacatacaaatgcatatacatagaaagtatatacatggaagaaatatctacgtataaagtatatatacaagaaaatatctacaaagaaagtttatacatagaaagaaatttgaatggaaagtttgtacattgaaatttgggtatataacacgaatagaaaaaagaaagaaaaatatgtgcattcgatcaagaagataaaattaaaggtgctcgtgaacctgtgtgcacatgtcattttttaaaacaaaattatacgtgtatgcatttttcttttgaaacattcagactttcgtgaccaggggcggagccacatgcattaggggggtgcccagaacccggttcataaattttgttaactatagtttatctattttcaccatatatatataacctgtcaatttaaacttaggcacccgtatcaagctaaatttgatccaaaccaaagtatagcaagcgagtggaacccccctcattttattctagctccgcccctgttcgtgaccttaggaaaagacctcgtgcaagtgtgagttacacattgatactgatagacacaatagactcgcgccggccgactagacgaagcctgcgatgcgatcgcgtgtggcccaccctcgcggtcggtcgcattctagaggtacctgtagacggaagaactctgctttcggaaccaaaataagggcatgtttagttccaaacaaaatttttcacgctgtcacatcaaatttggacacatgcatgaagtactaaatgtagaaaaaaactaattacacagtttgtcaggaagttgcgagacgaatcttttaaggctaattgcgctatgatttgataatgtagtgctaccgtaaacatttgctaatgacggattaattaggtttaataaattcgtctcgcagtttcctggcggaatttttaatttgttttgttattaaacaacgtttaatagttaaaatgtgtgtctgtatatccaatgtgacattgcatggcacaatttttttttgccaactaaacatgcccttaaaaaaagtaaaaaatgaaaaaaatagttccttagccttggaataagtccactttgactcccttaaaagtgacccgaatctaatccgtaaccctcaaccgcaaaaccggataagacgactccccaaactattgaaaccagtgcaatttgacttccttagtgttttggaggacggttttgctgatgtggcgctgacatggcgatgttgacctagccttcgtcccacgtggtgcttacgtggcattagaattaaaaaatatatgtggggcccatatgtaattcacacataaaaaatattgtgggcccacatgtcatcctccctctctcttcttcttcctcttccctctctctcccttctctctctttctttctcgtggcacaattggtaggcaggggctacgacggcaggcgggagttggagcggtgggcgagcaatagccggagcggcaacggcggcggtaggcgagggccggagcagcatcgggcaagctgagatgtcggcgagcggcggagacacgggcatggcgtggcggcccgcgagcggcggagactcatgattggcgtggcattggggaggacgacggtggtgcttaacctctcgccggtgatagggcaggtgcggcaccccgcctcgatctcca

SEQ ID NO: 35391 - DNA, 14266 bp, Oryza sativa
cggaggtggccaaggcgctctgctctgcagaggctcttgcggtcgccggacgctgccggagctatcgctcgacccgcctccgcactcctccaccccctccccactcgcgccactagggtcgccgcacgccaccggagctgctgctcgatccgctcgagttcctctcctgctcatagagcgccttcgctgtcgacgtccctcacccgccgctgccgccgtggggttccatgacgctcccgccctcgccctaggtggcgctcgccgccgactggctctaaatcgacatgtgaagagaaagagggagggagaagggagagagggggagcaagaagaagagaaagagagagaggacgacatgtgggtcccacatgtcagtggggcccataactttgtgtgtgtgaatgacaaatgggtcccaccgatatttttttaattgtaatgacatataagcgccacggtgggacgaataccggtcaacaccgccatatcagcgccacgtcagtaaaactgccctccaaaaccgctgagggagtcaaactgcactggttttaatagttcgggaagtcgtcctatccagttttgcggttgaaggtcatagattagatcgggtcactttaagggagtaaaagtggacttattcctaatgtggtattctctattgggcccattgcccatgggctctaagcccatcttccacatcttcatttattgaggtgtgttcgcatgtggtggccgggaacttattccctcctcaccaaaaacacgcgtgattaattaagtattacctaattttttttaaaaatggattaatttgatttttaagcaatttttgtatataaatcttttataaaaatcacaccgtttagcagtttgaaaagcatgcgcgcggaaaatgagggagagtgctgggaaggttgcaaacacagctgcgcccctctcaaaaaaaaaaaagaaacctatacctgcgctgtcgctgtccacccgtccgtccgtcgtcgatggcgtcgtcgtcgccgccggtccggccatgggcggacctgcagcacgacctgctcgtgatgatcatgtcccgggtgggcctccccgatctcctctccggcggcgccacccgcgcctgctccgcatggcgggcctcggcgcgcgacccgctcgtgtggcgccgcgttgacctccgcgactgggccgtcctgacctcggcccggcgccggctcgctgcgggagacggtgaagcagcagccgccgggcgcgggcgtgtccctcttcaagccgctctctgcagtgtgctggagatcgtcgtgcggcgggcggccggtcggatggaggccttgctcctaccggagttcgccgatgaggagcacctcctcttcctcgctcagaggtaacgcctccttctcactgtctctttagtatatgttttgtgattgatgtgaagatcccgtaacgaaattagtgtatattcctcccaaatccgctcatttctggttgaaagagagatattttcttagttcattgtggtcctttggtactgtagatagatagaaatgctgaattcttgcaaccttaaaaggaatgatgtcacaacagatgttctattcatttttcatgggaaatttcatcttattgtcataatgggatgaaaatttcatttttgttgtttcagtgttggaatttagatggattgggttcacctgacttgaatggtgaaatatcacgtttaaacgaaattaatcctctttttttccctgaattaaggatgtcccagagcatcttttgggacctaattatcccagatatcctctaacctacctgactattaggatatctttgctaatagcttcaccatattgcagtcaccctaaacaggaaaaaggccagactgtactgtgaacaaaagaacacctttccattgagcggtaaactgtattcaatgcttttccaatttgtcatgcatggatcttggtataggactataggagcccattgcttgtggtgggaagtttctccacaccaagtatactattgctgtttcacttttcaatataccttccagaacggtaggaatgtacaagcatggaaggttatgataccaggacatcttagtcatactgccttctttcaaaacaatatccttttttttttcaaagaatggctgctaaacgaacatatgagaaaaatttctacaggttacttttttggttacccagtaatggaaatgaactaaagaaacagcctatgtcacaagacaaatgctcgtagtggtatggaccactttgcccactacacctggaatgatacttttctattgtttgtctgtgatatgttaacaaagagcttgcagggttcccaacccagtttctcccccacaagttattcaaatgactccctgttcaatttttcaacatatttaaacttaagttgtattgtgcttttccaaatatgttcatgagataggttctccagatatctaaacatgtgtttgcactttgcacagaatttgcagtgaagtcaccagatttttcataaccatgagaatgtgatctatcacttttactgttagttagaaacaatatgaaaaaaaaattgcttttcttttgtggggttcaactactacatttatggagttaggatggctctataattttcacgaggcataataataaaattgaaagatagtttgccaccgtcaaatatatgattgccattcctggctggctggctggtcataagtcaaggataagtagcgaaccagcaacaacacctttgctttattaactgtatcatatcattattggctattttgttgcattcaaaatctatttcctacccgttagttgtgttcaatactctattagctatgttaaggaatagacactctaatataagagttcattgtgtcttaagtttggcaagcagaaaaaatcggcaaaacgtctatgtctgcactgataacaatttggaactgccaccatgccacattacaattaaatgttctcttcaaaataagtctaaatggaaatgtaagctagtgcatggaaattcgacaatgtctggatgtggtagcaagtgtttgatttcagtgcatgatcctacaatgtttttttagataatggattttcattaatccgtcctctatatccataaagaatatacacaaccaaaacatgcactagttcttagactccaatcctcacactaaggaatacacacaaacacacacacaaaaaaaatgaaaagcttgaagacttagcttaaaccttcatcgacaacctaaactttccaccttagtgcgagagggtggaagaggagaattggaactaagtccgtgctgcccatcgccgcaccatctccgtctttgcagatcacaacaccatctgttgccaactgatgttgtccgccatcatcgtccaaaaccccttacgctgccactgcattccgaacgccactactgcaccctgagttgctctgctgcgccaccatcatcttgcgcatactgtcgaactcactgtcgctcttagagcaacgcgaagccgtccagcataacatgcaactgactttactgccatcagctcacggcgtcaaacacctaaccgcagctagaccttggcgtcgattctcgcttggcaactgctgcctgtaggacaccgctgccgagagtctctgttgccactgccctcatccgcgtcaggcgagccaacgaccatcacatcaatagccactgacacccaccgtcctcccatcctcacctggctgtggtcagatccgagcgctggagcttgcctagacgctgccgcctctagaatgccgtcaccgagagtctccgctgtggttttctccatctactgtggctgacctgaccatataccatcgtcgccatgtgcaacaactgacctgccatcgagggagaagggttagcccccactgttgcccgttgtcgctaaccctcgctataggtgccgtggaagggatggaggactagccctgtctctgcccgatggcgccaccgccgccgcccaccaacgttgcctgcgacggaggaagggatggagaactagcccctatctccatccaacgcaatcgcccaccaagtctgtcgccgttgctagtcctcgccatcggtcacagaggaagggacaggggactagccctcatctctgctgcccaccaattccgccgatgacagaggaagggatggagggcttagcccccgtctctgcccaactccgccactaaccacgtacgctggtcctcgccgccacagcaaccacggccgccaccggagctcctagctgactggcaaccgcctcactgccacctccctcagccacctcgggcgccgccgccacctctgtcggcatcaccgccgctgtgctgcttgccagatccaggcgagtcttgccatgtcgccccatccaggagtacggaggaggaagccacgccgccagccaaccatagggcgccacacctccagccaatacagagcatcgtagtgatggctaggatttgaaaaactgcaactgaatctgaagaaccaaagaagaagggaaggaaaagaaggggagaagaagatgatggagaggaaacaaggagggcgggggtggcgccgctgccggctccaccgccggtgacagcctcgccggtggcagcagggtcggccggtggaggatccttggtggcgaagttttttggtctcccgggttgctccgtgggagcgacacggaagttggttcgactccttccgtcggtcacaacaattggtaggatcttagagaatctcacatgatcctacaaatacaatgatgcccttccatttcacagtatttctccttattataaccactttacctctttcaaactgtttaattactgagagtatggaaacactgaaataacatcttgaattctgtaatgcactaatattgacatagagacattgtgaggcggatagactactacgaaacaatcctgcattcgtaatatattaaagacgataacaaatactgcctaggatcctgatataacagtcaccgctacatacaggtgggatgtgctgtccacaaggttcggagttcagaataagtttattcagtatttctggaattactggccacccagtgaaatgttactatctcctttgatgtccaggaggcacatggaagcaagtgtagcctacacatctattgtcaaaattaatccaacggccattttctactaagatatcatctggtttaatgattcccctaccatcagcaaatgactgtacagctttcaacttctatttccaaatagcatttactagtgccagagtgaaacttgctgcagcgtaaagatgccatttcccttgcgtgtgcactctgatgtgccgtctggttacaccatcagtgctctggtgaacagtgcatgccattgctcaggcctcatgctgttgcactgagccactgaccatctggactcatgatcccgactcctctgatggcagtggcttcgatgaaagaggttggtcaatcaaccaacctgtctcaactcttcccgattcagcagcttcctaaactttttgctctgaatttccattagaatgatgtcggagcattgtgctctttgcatgttagcagttagcgcgaatactctctgccccctgtagttctttttttctcgtgttctacggatctgctcaaacaaagaactaggagaagtcatctcatacatttccaatttagtgccataaatgattactctattattttccctccaaaatgatttctttaagaaaaaagtaatgatttctttaagaaaaagttttgtgaatgaaccccgggcattggattaatttagacagtagatatatgtaggcaacatttcaccctaagatgcctcttggatgtcagatgatccagttcccagtgaaatctggtgacctgcggtctgcggagactgcaagctaccatagttattgagaccggaccggaccggaccggcggttggaccggaaaaaaccgaaaccagagcctccaccggtctggtccggatgaaagatcgctgtgcaattgactcggcagaaattggatggaccgtccggtttttcgttaaaaccagctagaaaaccagtccttgatccgccgattgatgctaactatggcggggcgcgtgcatgcatgagcgacatgagtggagaaaattgacaaaaaaggattttggtgggaattgaacctaggagcacatgcaaggaagccacgcaccttcccaccaggctaagcttgcccttatgtttgaatggaatcagtagtttatataaacattattgaactgctttagaccaggggttcaattggtcagaccaatgaaccgttgaaccaaaggcttcgccggttagattgccggtccagtctcaataactatgccagctactgggtagaaatttaataaaagaattgaattttgactggtaaccggctgatacatttccaaatttaaagttccggtttcaaatttgaatttatatcctctggctggtaaccgcccctaatttttctttcatagtgttggagaaacaatctatcacgtgaacgtgcctttttgggacccaagcaaatctcactccttttattgcgatattagtcaaattttccatcttttcactagctatttctgattcagtaatgcttgtcaaatattttttgtcagaacgttgtgaattatgtgataaatggtatttttgatgaggcttaaggccaaaactatccaacattgaattgagattcaattacatgtggttttgcagtgtgttctgttcctcataatactcttatggcattttgtgttaggtatcatttgtatgtaattatttgtggcagtgcgctatttgtttcgtctggatacttttggccaaattggctaacagttattttccagatatttatggaaatattgttatggttaaccatggactaagtgtatttcatgttatttttctgcaggaatccaaatctgcactatttcagccttcctgccacatgtataacttatgatcagttccgtaaggcaattgacaaattacaatttcttaaaggcatggcagtggatgagggtcttattaatcacgatgttctcagccatgtacatcagtgttgtccagattttctggagttgaaggtgtttgctctttatgtcgacgaagagatggcttcaatcatttgcaactcccttccacgtctgaagaagcttgagataccaaactctgatatgtcttgtgctgcaataataaaattccttgattgcctagaggagcttgagtacttggacatatctggttatgagacttcggcaatatcaagtgctgtgctccaaaaagcttctcggctgaacatcttcatctggaactcaaaatttgagcttggggagttcacggactgttcgaattgtggtgaacattgcattaatcctcaagagccttgtaagtgcgtgatggagcacagagtcatggactggctggctggaccttcacaaccttcctgatgcagtaaactgtgacttaagttaaattgacaatcctacctgctcgtcaaatttcaacatttgtctgggttacttgtcaatcaaatggtgggtaaggtggtaccacgctttgatgtgccttatgtggcactttattttggagtttaatatgtatgtgatatcacgatttccagcattttattgtcaatgatgtcttgtgagaacgaagcaacgcacgctacttggtgcagtgttgagccttgttttacaataaattttaagtcgttgcagtctcttgggcctgagcgagctggcaaacgcatggctgttcggctgttccgcctgtgcagagtactctgctttgtactcttttgttaagcaaaagatgccctgtgtttcctcgagaggcatttacgttggagatctccatgattgcactctttttttttaagttcttttactgtggtctgtggagtgtggactactgcatcgtggtgtgaattcttttaccgcctccgcctccccctcgcgccatcgccatcgtcgtctccttcggctcgcgtcgccactgccgccgctttctccaccgccgtcgccaccgcctccccctcgcgccgccacctccgcctccgcctccgcctccgtctccacctccgcctccgccgccgccgtcgcgccgccatctccgagctcctccgcctccccctcacatcgtcgccgtcgcggagcggcggtgaaggcgggtgctatctccatcggcgacgaggtcggagcaccgacgaccacgccacaggtcccagtctccctcgaccctagcagccgcccttagccctccgccctctgccgcctctgtcccatccgccgccaccgtctccgtctccgtttccgtctccgctccgcctgcgccgttgccgagcgtctttccctcgcggcacgccgtcgccgtcgctgggtgcgccacctctgcatccgcctccatctcacgccgccactgccgccgtcgctgccgaccgccgacgtctggatccggcctctggctcggcggggtccagctcggtggtgaggagatccaaggccgtcgagcgcatcctggatctccggcaccaatgaccgcgcgcatggaactggcagtggcagtgaggagcacggtgacggcgcgccaatttctgagataagttttttgcggtttgtactagaaagaatagcccttccaattttttctgcgtcgcccattggatgggaggaggttagaagaagatagaggcagtgttatacagggttccaccgggtggcttctcatggaggatgctggtacagggagtggtgaagcatggtggaggatgcaagacggtgcggtgctcgagaggcgggcgcgaggtgatgtccggatgaggtcggcatcgggtgggaagaggacggtggggtactttctttcttaatctaggcaactcgttggtccatttttgcttgattttgtttctgcttatgatggttgaaaagaagtttggtctttgcagcttgatgtttcccctttgtgactgttttcatgtacaggtttggagttgcactaaatcaaaaccgcatttcatcaatggtatagggagctccgtttcagatttggggaagcacagaacttgtccatgtttgaggatggcaccgttgtgtcaaagtccgaggaggctggatttacttactgttaaagatggtgattatccctcttccttaatctccctgtcaaatatttgctgttcagagtgttgaactcaatcaactgcttatattaactaatgaaagtttggtactttggttccaaggttcttttgtcctgcactgcccaaagctataaaaaccatgaaaaaaagcagacaagttgctccttacagctaaaccatgaaaaatattattcagtttacttactaaaagcaatctatctcttctgtcatgcagatgagaggcctcctgtgatttacctgtaggatcatgtgagaatacaccaatctgcaggcggtatacattcatttatctgttttttctggaaatcctataggagatgcaattctgtcaacataagtgtgtatagtgtgttgtggagtctgatcgaagtgctaagcattcatactcagttctgtgtccctgaaacttaattttgtatgtagattaactatcacagttgtctctgaagtgatgatacacttctttttttttaaaaaaaaacttatatctcgcaaactgacttaacctttgatatcaaattatttaatatgtaggaaaaaaaaagttcagattgtcgaagcaaagctgactggacaccatgccaattgctattgtttactgcacaatcaaggagatttttggctgattctactaaatttctgtttggtaaaggtaatttccttccatcatgattaccccttacaaatagtgcaaatgtctcctgcatggatcaatcttcgctaaatggtctgtaaacatttctactgcaccatgctaagggttaaattgtagccatccagtcaagaatttctttctttgaacctacagtaccttggacatacaagcagatttctctttgtgctgatgtcatgtgccgaatacttcgtaacaagggagttgtgtgggctgttaggattcacgtctcagtcattcagtttctattctagatagcaaaatttgctatagggcatccaaaaaacgtgtaatttcacaatgtgtctgtgattaaattaaactgattactccaaataaattacaagaaccacatccacgtagcttattaatttgcttaggattacaaatgattccgagcgccacagtcagtcctacaagatcagcgtcggcagtcctctctgccctggtacaatgcgagctccttcctcttcttgatctatcctcaattggactaaagtcttagaaaaaaatacaacttgttgatcatgcagattaaggagtgcttgaacaaggttgcctagacggtgtttttcctcgctcatcctgaaagccctgatcctgaaggttcattccttctattactgacatcataactgaagcttgcaacagtttatgtgtcatattaatgccattggtattcaatccatttcctgataatatagaattgctcttattttccttgtaaaattatgtgcaagcagtaagattttaaattggttattgtcttcatgatcattggctcttttttttccaatgaagtgtattgaactagagcaaactgttactctgaacatgtcaaatcggtcatttatctgaatttataaaatagcgttaacttcctttttcgttcacaaatttcttgctttgcaatcaatataaattcagacaaattttcaagctgttaatatatcaatgaccactacatatcctatagcaactaattaaatcttctaataatggagatatttactaaaatataatggagatatttactaaaaataagatggtgttacttatttcagattcagcacatgatttatatttcagattttgtatataactcagtttaaagttcagaatgtaaataggcacaatatttagttgaatcatttggaaataaaacatgcttatgctgaactgctggtatccctatagactgaacagctagaaaaacatgcgtacactgaactgctgataagacagtttaagttcaaacatttattaagtatactgaatcattgggaattcctgtagattgcttccccatttgaattttactgacattacccatgtactgtatcaatgttaaattttggttgcatcaataaatcttctacttgttaccagcatctttgtcgcacctacttaatttgtttgatataacgaaatgaacaaggatgtgaactacagttggtacactgaattgctaagagaaatgcttgtaacaacatgtatattgttgataatattaagtattttcagtaaatacctaagcacaacctgtactgattcactatgctatgctaaggtgcatccatacatgctgattctgtgctctcatcccattattctttgacgcaagatgatcaaccctgattttgtatgtgatgtctaaaaatttgcaaaggttgagtggaactgatttttgtatgatcaaaccattattcattgctcatcccagttttagactagattgatcaagattcatcactgatccaaattttgccatgaattggacgaggttgataaagataattgtatgatttcaggcctaataaagttgtatgctttagaatggtcaattaattgcatgttttagacccaagaaaattgaaattaaactacggatcttattttatgaaagatggcttctgtactcagctcactgaatcaggttttttaattgaactctccgatacttaagttaatgtgttgaaactatgcttgattgctaattatatacttttagttttgccggatgtcatatgtgatgcttctgagggagcctaatgtacagcttgagattatttactcttaacctgatgcgctcatatgtgatgctcctggaggatatttatataaatcgatgtcgtcttctcaaattataatttactgtttttaataatttgtactggcatatcaaattactgtttttaataatttgtactggcatatcaaattaactgatgtttttaataatttgtactgatatatcaaaatcactgttgttacgcttcatggctcataataaatcgctggtgcattgatatctacatgttttcacatttgctatttacagctcaggtactttcagtgaacatgaagcttactcataaggaatcaaaccaattgtgaagatagcaggtactctgagaattgacagagatgagagtctggctaaatagtcagccatgtgaaatgccttaatgaactctgtatttcgatagatgagatagctcatttaggcagtacatacatgacgtgggttcttcgatccattcaaactctagtgctgatccatttatagatatttctcccttgcatatgctctttgcattgactcccaaccatataacattgcggggccctaaaatttatattactacctacacgaaatcagtgtaatgcacaatttattttttatgtagatatattgtactcttaaatttgtttatacaaatgatttttatttttaggtaatacaatattgctaaagtacctaaatgaaataaatgtgacatgatatccaactagcaattttcgattagatgaaatgttatgtgatttgtttgtaaatcacattatatgtttgttgtggactaaggtagattgatgttttatcggataggaatggatccaaatggatcggcgtttgaagaacgcgccccatttcgagacataactaatatttcttcaggtattgtgacatgtatatattttggactttctttgtgatctctacatactcccatcgcatatattcatataccttgtctgctgatttttcgataagcatagatgcaagagctggaagtacaacttctactaagcttcaacgtaagaaggagatgcttattaatatcatattattatgcattatgacacgggggcacatatatatgcattatatatgtgcatgaattggcatatcatattattatactttatgttaaatatatttgtgcatgacataaattgaattaaagctcaaatgtaccgttcatatagtaatattttttgctaacatgaaaattttaaaaattattaaagacaaatagaattacaccgtagcatttagcacgggcatattactagtagatgttaatgtaccagctgcagcctgcaaaaactctctccatcagcaactttttaatgctcattcagttctttcacaaacaatgcaaatactaatagaagtattttcatacaggcaacactaagcgtacgcttgagctgtgtttctgtgcaaagaatgttgatccaacagctgacttgaaaaagtatatcgaagatcttgagtgcctagaccgttcaagcaaattctatgctgttgctgtgaataacacattcatgaagcaggatagagttgtaagttcctacacctgctgctcatttatttatatacaccatacatggctatctatcttaccaattataagtcaaggctgatatacaatgccaattacagtactttacgaaagaattttctaaagactacttaaagccattgatggacggcaaggaaaccatcagcattggagttcaaatggcaggtggtgtttcaaagaatatgatgctccagatgtcaacggatgatcgatgcaacctgaagaaagtatgggcaaaatttgcaacccgcaatcacatatacctacaatcactatgcaccttccatttcaacaaaacaactcgcctggaagccaccttcgatgttctataaagaacatagcaatactcatggctatgttgcagccattcttttgctgccaccaaccaggttgatcactgtcaagataacctgtattagttctaggccttacatggtaatcatggaacctcctaatatgaagaaacatctatatatgtacttactgctattagagacctctaaatatcaagatgcctgtgtgtaatttgtactatggacacttcctcatactttctgcccctgcttgcgtccaggcggcgcgccaacggcgcgcccctagctctagtgtgcttgtatcaatcaaacaaaatgttgacacatacagtttgtgctaaatctgaacatatttttcttcaggtgctgctacctgctagcctgctgcgattcacaagcaaaaccgag

SEQ ID NO: 35392 - DNA, 681 bp, Oryza sativa
tcggttgggctatccgaagacaccacacgaagaggacgacgacgcgaactcaccggtgcaaagaacaacgacgaacgacgacaaacgacggccggcgacgagattgaagcggcgacgggctcggcttgacggcgtccgcggcgctccggcgggcttcggcttcggccgaggggtggacggtgtgcaactcctccttgcgaacccgatggtgtcgacggcgaccgaaggcgacgatggacggagacgagcggcacggctggagcggctacgacggcggcggcgctagggtggaggcggctagggcgctacgggcgacagcgagctcggccaagggtggcaaacgaaagagggcggctaggggatcctttatataggcatggatgagagagatcgggcttggaacgcaagtaatcgcgccgggaaaacctagggtttggtttggagagataaacacgaatcgagctcgattccgtgttgatttcatcgggataaagtccgattcttgggggaaaagatagaggaggataagggaaacaaatcccctcaactaattttgcaaacgaagcacgggatgcggcggattcaacggaggaagcggcagcacagagctcagcacgggcggctggagcttgaagaagaacagtagcgcggggacgcaaactagacttttctgtgtggttt

SEQ ID NO: 35393 - DNA, 764 bp, Oryza sativa
  unsure (1)..(764): unsure at all n locations
nnnnnnnnnnnnnnnnnnnnnnnnnnnnnnnnnnnnnnnnnnnnnnnnnnnnnnnnnnnnnnnnatccttttcttcaactgaggttgattgattattgcaaggtgaacatatgacatactccgcaagccacacagcaaatatgcaagtgcacaaggataccaaaggattgcataatataggctcatttgcaaaagcagtatttagcaaatatttaagaatagtaaaacagtagagtaatcatcaattttaatcaacactgaacagcacacccatgctgctcaggcccaaccattctgaacaaccaaacccggctgcacagatctaactccataccaggagctaagcaaattattaccaattatagcatcaataattattgtgagaggtgtgagactaatcatgaaaaacattgctcaacccgcccataaccgcgggcacggctattcgaatagttttaatctggccagaggtgtaccactgtacccacaagacacagcctcaacatcatgtcttccatgcgtcgcgatactggaaagtacccgaatagaggctgtgacagtacctcctgcacaacacaactcaccacagtgcaccattcctggatcataatcaccccctaaatataaccagaggcatggactccccagcgacccccgtgggcttatctcgccacttctcaatctggtaccccgcaatgaaccatgctatacaaaagggtaaagccgttacccacgctggcttctggttggtccggttaatgtct

SEQ ID NO: 35394 - DNA, 801 bp, Oryza sativa
cttgattgctagacaaactgattaactgtgcttgcaagggtgtttgttgaaacggcttaaccacgatttcttcccaatcctggtaacaagcaacagacacaaggtaataacctttggtgcgagatgttgcatcacactcttgcgtgagcagcaaatgttcgacaaaatgcttcttaggtactgttatacgcttgcatgctatttgattcttttttgtctaattatctccaaagtttgattacgttttccaggtccagttggcagctaaaccagtattgcttacaagtcaaagatatatatatatatatatatatatatatatatatatatatatatatatatatatatatatagcagacaatatgagagtttttctttactcctgaacacctatctataatagattgtgttgattgcgcataaacaactagcccaacatttccctgctatgcacttgaacatatttgtacatatttgcaattctttatttttacacggcactgtgctactgatagtctattgatgggttgtgactgaatttattttaaaaaaaactactgttttttttttcacttatattgccatccctccattcatgcatgtccactttgatgcaaatctggaattgtcgagatactcttgatgttcatctatgccagttaatattttttctaaattgccaaattgaaaagagggttacatatttatttagtcctaactgcaggttggaagttgtatgcagctagctagatcactttcttatcataaaattgccgcttcaatagctatcatttggatccg

SEQ ID NO: 35395 - DNA, 169 bp, Oryza sativa
  unsure (1)..(169): unsure at all n locations
aattcgagctcggtcccatcatgtcttccatgcgtcgcgatactggaaagttcccctatatagaggctgtgacagtaccttctgctcaacacaactcaccacagtgcaccattggtggatcataatcannnnnnnnnnnnnnnnnnnnnnnnnnnnnnnnnnnnnnnnn

SEQ ID NO: 35396 - DNA, 331 bp, Oryza sativa
tcttggtatggagttagatttgtgcagccgggtttggttgttcagaatggttgggcttgagcagcatgggtgtgctgttcagtgttgattaaaattgatgattactctactgttttactattcttaaatatttgctaaatactgcttttgcaaatgagcttatattatgcaatcctttggtatccttgtgcacttgcatatttgctgtgtggcttgcggagtatgtcatatgttcaccttgcaataatcaatcaacctcagttgaagaaaaggatccagaaggagaagacgtttggcttataccccagttgagctgcctgtgggagtggag

SEQ ID NO: 35397 - DNA, 2237 bp, Oryza sativa
  unsure (1)..(2237): unsure at all n locations
gatgcgacacctcgccgtcgtcctcctcctcctcctcctcctcgccgccctcgccgcctcccgggaattcacctactccggcttccgcaacggcggcggcggcggcggcgccgggaacagcccgaacctgacgctgaacggcgtgacggagctccggccggacggcatcctgcggctcaccaacgagacgtcgcggctcatcggccacgcgttctacccgtcccccctccgcctcctcgccggcggcgcggcggtgtcgttctcgacggagttcgcgttcgcggtggtgccggagtatccgaagctgggcggccatggcctcgcgttcgtcgtcgcgcccgacccgcgcctccccggcgcgctgccgagccagtacctggggctgctcagcgccgccgacgtcggcaacgccaccaaccacgtcctcgcggtggagttcgacaccgtgcaggacttcgagttcggcgacatcaatgacaaccacgtcggcgtcgacctcaacagcctcgtctccaacgcctccgcctccgccgcgccggtcaacctcaagtccggcgacaccatcgtcgcctgggtcgactacgacggcggcgcgaagctactgaacgtctccatcgccgccgcgtcggcgtcgaagccggcgtcgccgctcatctcgttccacgtcgacctgtccccgatcttcctcgaccagatgttcgtcggcttctcggcgtccacgggccttctcgcgagctcccactacctcatgggctggagcttcaagctcggcggcggcgccgcgccgccgctcgacgtcccctccctcccgtcgctgccccgccccgccgccggcggcaagaaccgcacgtcggcgatcctcgccgcggcgttctcggcgttcgtcgcgctcgtcgccctcgccggggccgccgcctacgccgcccaccggtacaagaaccgcgacgtggtcgagccatgggagctcgactacgggcgcaccgctacagctacgccgagctgcggcgcgccacgcgcgggttccgcgaccgcgagctcctcggcgccggcgggttcggcaaggtgtaccgcggtgtgctcccggggaagccgccgcgcacggtggtcgccgtgaagcgcgtctcccacgagtcccggcagggcctccgcgagttcgtcgccgagatcgcgtccatcgggaggctccgccaccgcaacctcgtccagctccaggggtggtgccgccgccgcggcgacctcctcctcgtctacgactacatgcccaacggctccctcgacaagcacctgttcggcgacggcctcgcggccgcgcggctgacgtggggcgcccgcgtgaaggtcctccgcgacgtggcggcggcgctgctctacctccacgaggggtgggagcgcgttgtgctccaccgcgacgtgaaggcgagcaacgtgctcctcgacggcgacatgtccgggcggctcggcgacttcgggctcgcgaagctgcacgagcacggcgcgaacccgagcacgacgagggtggtggggacgctgggttacctggcgccggagctgacgaggacggggaaggcgacggcggcggcggacgtgttcgcgttcggggcgctggcgctcgaggtggtggcggggcggcggccgatcgagccgcgggcgccgccggaggagctcgtgctggcggagtgggcgtgggagaggtaccccgccggcgaggtgggggcggtggtggacgcgaggctgcgcggggagttcgacgccggcgaggcggagcgggcggtgaaggtcgcgttctggtgctcgcacccggcgccggcggtgcggccgacgatgagggaggtggcgaggtacctcgacgccggcggcgcggcggaggtgcnggagcngccgccgccgccgcctcccccgccggtgagctccggcgaggtcggctactacgacttcgtgcactcgtacccgacgtcgtcgtacgagagggcggcggcggcggcggacggcgtgacgcagacgtcggtggccacgttcccctactcgccgctgtcgatgaggtcatcccacgtcagcgtatgactccacagcctgggcccgcctgtcagtataacgataggtgggacccactgcccgcaaccttggttcaagtgggaccagagaacccattgtgatactctgttcttgccaccaaggtcgttagcgttgggatacatattgtaggatactgtggtggatagaaccgcacatatcgattt

SEQ ID NO: 35398 - DNA, 464 bp, Oryza sativa
tacaatgcaaattgccaatcataatttgtcaatttgtgactgaaagttaaaacgtccctaacccgatcactatttcagcttatacgtcaacagctcggttcatatatagaacagccgtgaagaagctcaggctgccatcggtttgccaactgctgataatacatcaaacgatcgtattagcactaaaaaaaataatttccctcttatataggctaatcgcctgcttattagacttgctattaggaaccctctttccccgttacactctaaacgaagtggatgtttaatgtatgattaattaagtattagcttaaaaaagctttaaaaatgaattaatatgattttttaaaacaaattttctatataactttttataaaaaatatacaatttagcagtttgggaaacatatgtgaagaaaatgattaaggagaagttagagcatgaccaacagctatattattat

SEQ ID NO: 35399 - DNA, 977 bp, Oryza sativa
aaatcttgtgcttcgtggtggatggcgtcgctgtccaaataaccggccaactcttcggccacaacatgcgaagaggcgtctccacttgtagccgacgaactgccacccacttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcaga

SEQ ID NO: 35400 - DNA, 1124 bp, Oryza sativa
gggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgtttaatattaattaattgttacaactgtttaaatctttcaatttccgtttataaatgctcgctttatgcaaatgagccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaagtttagtcaaggcttagctccagttatcttttgttttccgctgcatttttgtaagacttttatgatgtttgtaagacgtggatctgtatgtcaacattgtcgcttgtgtaccccggctggtcctggacggggatttttatgcacattctgcttggaattctattcgggaatttctgggcgtgacagtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaaataattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggat

SEQ ID NO: 35401 - DNA, 220 bp, Oryza sativa
gtgatccctgcctctccctttttgatttcttcagctcaggtagaggagccattcccaattacactttccaccatttctgagctgtttcgacgcccttccttctcaaatccaatatgaaatggtacaggcactggttgataacgtgacttactaatgactctccttccatctgttacgatgaacggcctagcagaagcgggggagggagctggcccaaacg

SEQ ID NO: 35402 - DNA, 1853 bp, Oryza sativa
  unsure (1)..(1853): unsure at all n locations
agtaaaaattgcaatataaataccaagtaactacaatgtaattgatacgcaagtataatgcaactgagatgtaagtacagcgtgtaattggtatgtaggtacaacggaactaggatgtaattactttgtaatgaatattaatataattttggctatggagacatggagtcagcacaactactgtgctcttttttttttaaacttaaacatccaataatataaaacgacagagttcatatgaataaatcccagtacattgccaaaaggataaagagaaagcataagaccatccgtttcgaaagaacggaaaactgcactaaggccacaatcttcatatagaaaccacacagcagagaaggtgcacatcgacagggagctgcagtgatgaaactgcactaaggcaatccgcgacgattgcgaccttgggcctccttcagcgtgcacaacgcttgacaatccggtaatccccatccggttgcctccacgaaacgacacaaaacggaggtctgctactgagccgtagattttggagtaagcatccccgggctcagcaagagatgtccacggagtccgtcgtcaaatctgaggagcgagagctcaacccgaacaacaaaccctgcatggaacaagccgataggaaacacataggaagaaagagcctaaatccaaatcccaatatccactaaagaactcgaatggtggcaaacgaattgctgtcttcgtggattgacgtacgtggatggggaagtgaanatctgcaaagcatgattgatagaaccatggcattggaagcacatgttcaggcaccagagaaaccgccgccacaacgctgacggggtgtcgcccgcaccacgagcggcgagctccgggcgacaacagaacagccagcaagggacacaggaagccgccgcagccgacgcaagaagcagggcggcggcctcccagctgaagacggcgacgcagccgacgccaccacaagaagccagctccatccatcaaatcgcccactgatcttcggatctcgcacttccaccgccaccaaccaacacctccgccgaccactccggcacctgtcacgccccgaactagtaccggtcggtactagcccgtgacgctccaaattaacctgttaatcgataccagtcccaggaaacagtgctggtatcacaggaagatagattatcacagcaacagaggtctctttattatagagtagaggtacagtcatgttgggctgcggacagatcccgagctcacaactgcattacaaaagggaagcggaagccaagacttggaccaaacatacaggcgcgacttgggaactaggccgaaaccctaaaactcatcgtagccggcttgctcctggaagaactcctcatcagtaggatccgcctcatcttcttcagcaactgggggggattatttatatagagcaagggtgagtacgggagtactcagcaagccatgggaaataagtgtttaatgcaggcttcaaggaaggctgttgtttttgcaattgattttatttgaactcgtttctgaaaacaactaagtgagtgcttctcaaacgacacggatgagacagtgcgtctcgtccggtcggagtatgtgcaatgtatcagtctttagaattgatcaagattggcacccagccagcgactttcaaacggccacccgggccaaccactttcaaacggccacccgggcctagctgatcccatcagctgcagattttccaaacatcgatcccctttccacaacagcaatttcacaagacaatagtcaaacaaagctacgctaggaatcacctcacatccgcccatgaccgtgggcacggctgttctaacagtttg

SEQ ID NO: 35403 - DNA, 585 bp, Oryza sativa
ctttttccggcgaaccctacctaatccgtcgccgattccatccgttcccgagtcgatctctccctcttctggctataaatagcatcccctcggcctcctcttccgtttgcctcaagtcccaagccgagccgtcgcttgtagcgccgccgccgccttgccctagccgccgccgacgccggtgaccctccagccgcgtcgcgccgcctcctcggtcgaccccaacctgcgccgtcgcctccctcggcttcgcaagggtgagagctaccccggccacccgttcccttgcgccgaatctcgccggaatcgctctccccgcgctcgccttctctctccacctccggccgccgctccagcagccccgcgccgtcgctgtggtcgtcgccttcggtcgccgctgccgccattgggttcgcgaggaggagaagaagaccgacctccacttccccgtcgtcgaagaccctgggaagcccgtcgtcaccgtgaagccgatccgttccatcttcagccgcgccgttcgtcgccgtccatcgccgccttcattcaccgtcaccaccctcgggatcgcaggagcgaggtgaagaccgt

SEQ ID NO: 35404 - DNA, 446 bp, Oryza sativa
acaagagaagaaagacaccaatttctccatagacgatcaaggcacagtttggtgcggtccacgcatctgtgtaccggccaagaaggaattaagagatctcatgctaaaggaagctcatgagtcagcctactccattcatccaggaagtacgaagatgtaccaagatatcaggcatacttctggtgggctggaatgaagcgagatgtcgcagaatacgtagccctgtgtgacatttgccaaagagtcaaggcagaacatcagaggccagctggtctgttgcaacccctaccgattcccgagtggaaatgggaagagatcggaatggatttcatcaccggttcgccaagaacccctagcgggtacgactccatctgggtaatcgtggaccgactcacgaaatcacgtcatttcgtgccagtaaaaaccacctttgatagaaagaaact

SEQ ID NO: 35405 - DNA, 1051 bp, Oryza sativa
ggctcccctgataagctagttactcagccaggggtgtcccattccacccatgtggtcgtacttgtcttatctttggatgaaattccaaggaaacggtccttaagtgcaagagtggaaaaccgtacacccggtacgttccccggtccgcggttttgggaatttcatttagttcgcaagcaccgacccaggtgtcgggttttccaagtcttttgtaaaacccaagttttatccaagttgtttttcagatttttaagtttgaaggcgaccgtcgatactcgcacagggtgcacgaatatcgaggcacaactagatggttacaaggggacatgatatatcaattaacaaaggaaggatcaaatgcaacaaactaggtaggtccgccaatctgccttgcagacgggacaaacagattaagtgcgatcctatcaatgcataatattttgcaagcaacataattaaattcaaatataggctcaagatgttcaaaggtggcttgcctttctcgagatctggagcttgatcctcgaaatcctcgcactgcgggtcttcgggcttcgaaactacacgcaaaacgggatgactcaacaaacggtgaaaataaagccctattaatgacctataagcttgccattagatagatctcgagatttgaggaattttggaagttgaacggagtcaaacggatttacggttgggaagatattgaattttaagattattggatttttggtctaaaggaaaaaggatttaattaaatccttttttggaaaagaaaagaaaagaaaagaaaagaaaagagggagggaaatcagacttttcctcgggcggctagggcgcggcccgagagaaatggagcggtccggccgagctaaatgggccggccggcccaaggcggcccaaggcgcgcgtgcgcgggagggaggagagagagagccggtggaccgggctcaccacgcgtggtcccgggtgggacccgcttgttggtgacacggttcaccgtgcggagcgagcacgcggcgcacgcgcgcgggcgggggagggacgcggtgca

SEQ ID NO: 35406 - DNA, 619 bp, Oryza sativa
catgctttgtcaccatcttgcgagccacacaccaccaggtagcgaagccagatgtcggagttgcgcatgcgagtccttaggtgcatccggactcaatcccacacttgttgtgagaagacgcaagcttagaagatgtgggtacatcgttggcagaaagatgacatcggggggctagggatcaggatcctctgcagtcgaagtcacgtgactttgtcactaacatatgagcctgatgatccctaggcccacatgtaagtgacaaaagtatcgtgcatttgactgtagaggatctcaatccgggggctaggtgccaacctcagcgctgcaaatcgttcgttgtgaggcaagcgccccgcatcacacaaaatattggagaacttgcatctcgccggaattttttttattttgtttcgatcaaattttcaacggtgcgatcttctcccgtgaatgtatgaatgcaggcatgtagtggcacccttagcccgttcaattccaaaatcttggttcacattttaggctgtgttttgttgggccggccctgtttataagtaaacaaggtaacaattgtggcccttgtctattttagcaaactgctatagtatcatatgttctttccttg

SEQ ID NO: 35407 - DNA, 744 bp, Oryza sativa
ataagtataaaccaaaagatgaggcccattagtatttacatgtacttcctccggtacggtaaaatctctctacactaatttttaaagattaagatccctctttacttaaagactacggaagagtgcatgacagatggagtagtgatgatggctgtggccatgtgggtcccatcgcgagctcactacaaaagctgccctgatgctctgaggcctctccaatctccgtagccagttacccactgtcccccccccccactctctctctgtctctctctctctcttgccgcgagatgaagaggaacgaggtaaaggagaaggagaagacggacaagccttcgacccgccgccgcatcctcggcgtcaccgccttcatcgccgccgccgccgccggcaccttgttcctgctgtcggcgatcggggagagcagtggagacccggacaagacggcagatgatgatccgccgacgacccggacaatgaaggcgccgggctttgacggcaaggtgatgatctcccgcgacaagttcgagggtaacccgaaggagtacttcagggccagccggaagggagacgaggaagacgttggcgctttcaagtaacggatcggaggacgccggcaactaaacacagcctatatgtgatctgaaaactctgcatgtaccagctggcctggatgttagcttaaatacgtacgtatagtacgatgtactatgtcagtatatgtgtgtgatcgaggcgatgagt

SEQ ID NO: 35408 - DNA, 732 bp, Oryza sativa
gatcaaattatcagcccattagaagtaacgggccattcaacgtgtgactgagctaacttaactgatttcagcccagtttaacgtcgtcaggtgtaaacattgaggacacatcatatggcaagcaaatgggaaataaacgattctcaaactacaaaatctcaatcagtactcgcttcagcatcgaccatctcaatctgacttctacacatttcatcaggaaactgccttgagggaggaactcgctaagtaaaatgtcgatccatcctagtcagcatagtcaggttttgtacatcagtcgttctttctactacgagtaggcacgggaaagaggattgattaccaaaaggggagcaggagcgtcattctttggatgaagactggccatggctttgagggggctaagaagcacgaccttccaaaatcagctccttttgaatcaaccatagagggaaacagcatggtggtcatagttacaacaaatccagcttacagttgtctggttgggtgcaggttgggtgttctttggaacaggatcgcgtcataccaccctgcacaattcacaactgatctggtcagaaattaacacagttcagagtattaattaaaaagttaatttgctacatgagttctgaagcaaactgggaaggtccctaagggcagtcccaacccataacactagacatggtttccataaactccacatcatcaagaaactagtactagacactactc

SEQ ID NO: 35409 - DNA, 2696 bp, Oryza sativa
  unsure (1)..(2696): unsure at all n locations
tacaacatttgccacaaattaatagatgatattatagcagcataaacaataacatatatgcttatggcagcaatattgaggtattgtttaaagggaaattaaattaacaaagtcaactcacttgtatgagccgacggattggcatctccaaccagattgatttttttcatcacttgggtgtgaaagcatactttggacccaaacctacaggtaaaacagtaaaaattaagaaatagatacgcagagcatcatctcaataaccaatagatatgcacaccttaaagttgccaccaaatgaagagctcacagccatgttttttccagggcggaaagcaatagcagaaattccagcatcgctgtatgaaagaatggtaagagaacatatgcaaccatttataattgaccttatatagtcatgttggtacctgtgcggctcataaatgacagtggacaaaaaatattgtccagcacgagacccttggttccaaaatttcaatgtaacaagcccacctaattcttcttcaggaagcttgacatcaatggtgcacataaacttaccatcaattgacaatgaaactaaggaaatgtacatctgtggaaaggaaagcattctcatcagagcaaacttctggatactaaaataaatgtgaaaaacaaagaaaaattttaagccacaagaacctaacaaaagaaatctacggtacaagcaaaaggaagttgttatctcactgtgatatcatcaacagggtgaaagttcctctcacaaacttgcacctgtagaaagtaaaaatattgggatgggatattcttgcacaaaaccagaacaggaagacaagtaccgattcaatatactgagaaccacagaactggataaaatatgatgaaatgctctcatatgcttactgttttacctctgaaacttcagtattctcaaataaatcgtagaactgtatgcaataatcttctgttggcacagcaacaagtttgttactgtaatcaaatccatacacatctcgataacaaccacccaggtttggtgaagatataggtagctgaagagataaacaaataaaagacatccattagcacataatataatcaccaaaaagtgaaacagcagagatcatcaatacaatttatttggattagagtgggctcttaaagggcatatttatgctattacaaaccttaattccagcaatagatttcatgacctccatgttgggcatttttagaagatggacttggttattcatacatgacacctgaaatacaaagaacattaagctctacttcaaaaatgaattgcaaacaaatgaaacagaaacagacaaaaagaaacggtagtttgaaacaatcatagagccaaaaaaaagtctaatacaaaaatgctacctgctacactttatgagcccccatcatcagtacagcccattaggaagtaaatgtgttaccataaaaagatgctgaagtgctgaaccattctagttttctcatatggttctaataacatcatgtaacctaatgtggacatgtatgattatgatatataattatgctcactctggccacaaaaaaacaagtcaatttaaaatgcatgcagtcaacacgagttctttgaccataaatatcagttaaaatatagtattccggtatgcaaatgaaactgataaattcaattttgtcataacaagagctttcataatattacagttatataaacttttttaaaatttatgctaaagaactaggcagtaaaaagttgtataatgtggacttagataagtccaaaacaacttgtttttgtgactggaggctactatgtggcaacatcatattcaaataactcttaaatcaacaaaaatagtgtgtttttcactcttcagattactatatcaggtgcaacgaagttcaatgggagatgtaaaatatggggatacttacacaggcaatggaagaatccggagaatctacaaaggacaaaagaggagaccctagacgtggtttatatcttctcttcccagtatctagttgccatacaacaataactccctccataccacctataagataaggaacttgtcattgaaaagcataaaaccctagaatcacaactgaatgaacacaaatcagcaagcaaaacctgagaacaagtaagctccatcagtagaaaatttgagaaacctcactccgcttgaatgccaatgccatgtagtgcaagtatctgcatcaccattacccctcacatcacccctgtcttcatctagttcagattttgtgccatctgatccagaaaactttgcatttccaaaacctctccagatcagtattcgccccgttgcatcaccactagcaacaattctctcacttggatggaaggccagtgtgttcaagttttttgtgtggctaagctttatcttccttatcttgtcgggcttgaaattttttgttggtatcctccatacatggagctttctcttatttgtaatacccaaaaattcaccagagctacttgcaacaatcatttccggtttacgggtctgtttaaatcgaagcaaacaacacattgatgtaagttttaatagaaaaccttaccacagatactacagcacaatattattgttatatttctaattgcaatnnnnnnnnnnnnnnnnnnnnnnnnnnnnnnnnnnnnnnnnnnnnnnnnnnnnnnn

SEQ ID NO: 35410 - DNA, 2570 bp, Oryza sativa
  unsure (1)..(2570): unsure at all n locations
cggcgccaccaccaccgccgtgacgtccccctcgtgcccctccagctccgacacctgcaaacacactcccccatcggtaaccaaaaaaaaaaaaccacagcgagccacaaaatctctctctctctccatggcgcgtaccagcatgccggtggaggcgctgaagacggagacggtgcggccggtgcaggcgaggaggagacgcccgtcggccgagaaggccggcggcgcggagacgtagctctggccgccggtgatcatggcggcggcggcgaggggtttgggagctagggttttgcggcggaggggagaatggtggcggcgaggcggcggcagaggcagcgtagggttttgggatttttggcaatggcagaggcgggttaacgggtagcgacccggtccgctttgtttgggctcttgatgggctccatgggccaggttgatgggctgtccttgtttaggttaaacgtgggccgggtcgaatttgtagtgatttaggcctggtttgataggtccaggttttagttcgagcttccgcagcccatctagatttctttggaattgaggcccgtctatgtgtttgcttaagattttaggaaaaagtacaccgaaagtccctcaacttgtcatcgggataaaaaacgtcctcgaaccgcaaaaccagatatgcggggtcccttaactatacaaaaccgttcacccgaggtccttcgatggttttgaccccggttttggcctacgtggcacgtgggacccacgtggtccccacatgtcagcgtgccacgtcatcaccatctctctctttcccttcgtcctctctctctcacttttcctctctctaggctggcgacaggcgacgtggtggtggcggcgacgcgggaacaggcctcccatcccgacagccaacgcctcgctcttcttcacctacgacgaggccacgcaccggctcacgccgccggcctcctctgtttgtgtttggtgagtggtgtttgatcggcgtcggtgtttggtggatgccgtgcaagccgagcggatgcgcgtggggctggaggaagcgcagcgacagcacgtccgggcgttggtggcggccgtggcgcgcgccacgacggggagggtgcgtgcggcggaggccaagctggatcgcgcacgctgccgcaacgcggagctagaggagaagctccgccagatgagcgcagaggggcaggcttggataggcgttgctaagagccacgaggccgtcgccgccggcctccgcgccacgctcgactagctcctctagtccccctgtgccgtcgccaccgcagcgggggaaggcgacgccgaggacgcgcagtcgtgctgcttcgagaccccaggcggcgccgccgccgccactgccgccgacgcggtgtccagggcgacgtcgtgcaaggcctaccgtgtcacggaggcgtctgtgccgctgctctcgttccgccgcctgtgcctgtgcggcgcctacgaggccgccgttgacgcttgccccgtctgcgccgccaccaagatcgcctccgtccatgtcctcctctcctgaagtcactcacatgtgccacaccagccactgcatggagtaggagatttcgatagcgcaacagctatggccagaccgaaaccgggcatccatcagccaactccgatgacaagcaagctaacaacaatcatcctgtcccaagttacatggaaattcatgctagggaagccatggttctgtcatcagtgatctccaggccatgcgagttttgtcggtggaaacaacagtgttcagtgcgatgaattaatggttgattgccgatctcatctgtcgcaggtaccattgcttcaaatatttggcagcccaggtcggcacgcacgccgccccgtctccccgtcggccgctgctcgtcagttgtcctccccatcggccgccgcctgtcccggcaccccttctccccgccgatccccgcctgtcgacgaagtcccggcgctgcttcccatccaccagccaccgcagctccgtgcctccgcttcgccggccgccgcgcgctcacacgccgcctccgccgttcgccgctcaacccccctcgctgcccggtcgtctgctccctacccgtcggccggcctgagaagagtgcgagagagagagagaggggaggaagggagagaagaagaggggaatggacgtggcacgctgacatgtggagcccacgtgggtcccacgcgccacgtaggctaaaactggggtcaaaaccactcaaggaccttgggtgactggttttgtatagttaagggaccttgcatatctggttttgcggtttgaggacattttttatcccggtgacaagttgagggaccttcggtgtactttttccaagattttagcccaaatccccgggttgaggaaaccatgatcaggctctcaccagccatagctaaatttaaattttagaaataattagaggtcttttttttataaaaaacacacagtacaaatgtagacacccacaacatacgcacactcactnnnnnnnnnnnnnnnnnnnnnnnnnnnnnnnnnnnnnnnnnnnnnnnnnnnnnnn

SEQ ID NO: 35411 - DNA, 5906 bp, Oryza sativa
  unsure (1)..(5906): unsure at all n locations
ctccgcgtcgatctttactcccgggtggtttaccaaccgggactataaatagatctttaggcgtatggcgatcttttttcccggttgatgttatcaaccgggactacaaatagatctttagtcctggttggtaacaccaaccggtactaaagattgaaaagtatcatgtagcttttaaaccgggactaaagatatttttagtcccggtttttaatacaaccgggactattgtaaaatctggtcgaccgaccaaagatggtttcttcaccagtgtagcaacaccatcttttatgtaaaattaactgtaccgtacagatcaaccaaccaagaagcataatatatacaaacttgatcctacaagatcaaattcctatcaattcaaggacctacaggatcaaagcatatcggtataatctaatcttgctacacaggcctcaaattaatttgttcagtttcagaggtgcttggtttgaagcctaatcttggtctagtgtttaaaacttatgaagataaagattaaattggcgtacgacgtacgtaaaacgcgaaagatattaacacatgattagttaagttttaagtattacaaacttgacgaatggatatattagatattttaaaacaacttctatataacaagttttcgcacgaaaatgtaagtttgaaaaacgtgctaacgaaaaccgaggtaaaatctatatcttcatccgaaaagaacatgattcagccgcacttatggccttatcggttctgacaaattagtgtacaagagtacttatacttcactatataaaaaaaaactacatagaaatatgtcttttttactgtacagatggtgtacataagaaaatccacttatgcctgcagtgcgggctgtgcggcccacagttagtattgcacgcctcatttctattctagagacggttatgcgaacatctagaaattgatttttagatatagttgtcttaagcgattgtctttaaaagtagattttcatatgtggtcgtctaagttgtccgtatgatttagaaatgtcactactcgtatgtgcccccaccccccctccctttttttccatattacgaaggtggtattttttaacctggagttcttttgtgccagtacttattaattaattaatacttcgtaaaaaaacaattgaatagtccttacatgtctaaagggtttttttttgcataaaacctatggcttttccacgttttcaaaccgtgtgtacatgccacatgtgcaacgattactctagattgctgtcttttctaacatattaatctctatggtctaaatatcaataaataattgtgaatctaacacgtgatattacatgtaagcaaaagattaaaatgtgaagtaccatatcaatgctgaatatggtccagagagaggacggacgaatcaacggtgtatgttgtaccaccaattattatatcaagatttgtgcaggactggatgatggttgtttagacattgcaatcttataaaagctaggtcatgtcctcatgtgcagttgtcggcctatacataactactccctccgtttcaaaaagaatctaacatattctaggacaacaaatttggacaaaaacttattcagatttgttgtcttggatgctgactccaaccaatcaaccaccgccacttgtggcactgacaagcaggcctgcctgttggctagataagacaaactttgtgtctctgtttggtacagctttagatcacaaatccatggtagatttgtattttgtatgttaaataataatggtttaaaattttaaattatatataaaatatgaaaaaaatgattaatcaaaatgttatcaatgtaatctagatccgctgattttgtacccagcttcaaaaaatttttgatccagagttgtgccaaaaaggatttgtatatatatgtttatgatctttttttttgttctgattaattcctcctcctttttcatacatggtccatagcttgcatcctgtactaattaagtactaacagcctaacaggtaggcacaggcaggtccgaatataatgctgaagtgagaccctgaaaaccatgaaagctctccttgctaatcttgtccctgttgtttgttaatttagttgaaagtctatgatggttgcattagaggagattaattagttggaacttggaacagctctttcaagaaaattctttgccctcaattaatccacttgctatcatgagccaatgctctttgcatacaattgatcgagattggttcgagtttgcaatatcacgctgttacctcacagttatcatagttaccccctcagtaactaccttagtttttaaccttatagcttttatggtaaccacatggatactagggtaaccacgataccgtcaggtagaggtaaccatcactaaaatggtaagggaaaccatggggtgggctacgcttgcaatgctcaatttctgacgaaagactttttttttctctacgaaacacagtacaagaaattcacgtatatatacgctacacactcacacctatgaatacgtataggtacgcaacaaaccacatttataaaagccaaacttttgctatgtgtatctctattgtaggtgaagatcattagatcaagaccagagttatatatgttccatcatcctaaaacgtacttccaaaagctctaatcatgagcactactcaagaccaaagtggatcatgcatgtaacaaatgaaataagataagagtcactggcaaacaaaaatgtggcatatatgcctctgggccccaatcaagcaaataggccaacctggtgccctaattaagctagcttgcaaaaattcaatggacaggtagatcgatcagtgtgtgactacctatagctatatagctttagctagctagcgtcctcacttgtctacaacgacgtgccacccacttctcctcctcactaacacacatccacttatatatacacacatttgtaatttgtatctatatatatttgcaatgcttaagcttgaaacctagcttgaagctagcttaatttgctagccattatagcctctcatcgatatatataccccaatgcatatgtaattaagcttgaatcctatttttcttccttgtttgggttttgtgtttgtgacttgggtcgaattagtttgagagaatttggagggtttttggttttgattttgattttgattttgatttagtttttgagttacatgaacaggttcagaaatgtgttgctacgaaagtgcaagagcctgtcacgctctctctcgaggtcgagctcctacaggaacctccgatccatgtccacccgggagcacgtcgtcgccggcggcgatggcggcattgtcggcggcggcgacagcaaggcggtgtcgccggcggcgacggggcggtggtgttcgtcgggagctcgcggcggcgctacgtgatcagcaacaagcacctcagccacccgctgatcgccgcgctcatcgacgacgacgtcccggcggcggccgccggagacggaaaagaaagcggcggcngcngtggggtggtttaaaagaggaggtcnacttcngcagcgacgacgacgtcgtcgttgaccaagccgatcgccgtcaactgcgaggtcgtgctgttcgaccacctactgtggatgctggacnacgccgtcgacctccgcgcgggcggcgacgtcgtcgacgacgacgccgccatgagagagctcgcccagctctacgcctactagctgctgctgctgctgctgctgatcatggagagagatcagcttaatcaacaccatcaatgttagttaagtactcgatcggtacatgcgtgcatgcatgttgttagtaattgttttgattagttcttaaaattaactgccttgattgatttcatttttaattttgatgttcatttggttcttgcgcgagatctaaaagattattcggcgcgatgaagaagatgatttgatgcatgtacatgcaaaatgtatggaacatggtgtagttattatggtttatgatgtttttcacaaaagaagaacagatgaatgaatttatggatagagttgtttgttatggttttaatctggtctggttaattatgctcttgatgatatgaataagtatagttggccatgcatcatcatcatcatcatgcatgcatgcagcttaattaaggtggttgttgatatgatgatgctggagttaatgtaggtacattagtaggtgctaatttgatgaatgatgcattcttgtgtaccacaagctagctcaataaatttggttgccttcactttgtgcaattagttgacttgtgatcaaagtgaagatgcaatttgtgcatgcaatttgatgagtgcttgttagcttgctgcaagttgctgtctatacagctcatacttatatactacactagcaaattgcccattgtttactatgggtaaaagaaaatatataatgctttatcgtagataaaatatatttttatgaaatatgctattattattattatttacttattttagcttgtgttattcatttgatttaaataaatattaaactattgcatatactattataaaatattaaggagtaatttgtaagactgcaaaattagtggtttcgacggcgtattgtattttatagtagtatagatatgagcagaaatttgtcgaccggaaatgatatttggtactcactttaaaatcagtatacatttattaccttttctaacattatctaaaaatgcctttccaaacatgtatttcgggaagaaaataattattgggggaaaaaggagccctggagtcttgagacagattagacgttaacatctgaaattcaagtaaaaaaataatatctgaaattaaaaatggaggcagtgctagcaaggtttagaagcgaatttgaagttaaaaaaaggcaaaaagaaaaaattaaagagagcgcaatcaagtagttagcaaaggcaatcagatacagctagcagaagtaattaacacagctaacatttgtatcagacagcaagcaggcacagaacagctgaactgaacagatataacggcagttcagagcagacaggccaccaaatacagcacacccgttagttccaacccaattttagctcaacagtccacatctcataatatatgcacaaaatctagcttttgattatcttggattttatgctcttctaaaaaaaatacttcttcaatttcaaattataagtagttttgatttttatcaaagacaaactatttcaagtttagctaaattaatagataaatataataatatttataatattaaattagttttgttaaatctataattaaatatattttcataacatatttgtcttgcattgaaaatgttactgttttttctacaaacttagttaaacttgaagcaaatttgactttgactgaagttaaaatgacttataatttgaaacgaataaactacaaagatagaatgcttcattgtcagtttgatatcatgatgagttcaggtttgaacgtgtgtttgaatcttaacaatcaataatataatctcgaaagcagcaacattatcatcttaaatggagtacataatactacaaacattggagccattagctgtatgtttcccttttgtctagaacaaaacacatttgagttttataagagacatcatgcgcatctgcaaaattttaaagctgtactagctgtcagtcacctgaaattcccatgtatatatatctgttccattcttaaagaagaaatattcaagtaagtattatatgtagctttgaagttactacatgtaattcagtttggtccagattgtttttggcagctggannnnnnnnnnnnnnnnnnnnnnnnnnnnnnnnnnnnnnnnnnnnnnnnnnnnnnnnnnnnnnn

SEQ ID NO: 35412 - DNA, 1276 bp, Oryza sativa
  unsure (1)..(1276): unsure at all n locations
gtcagtcacctgaaattcccatgtatatatatctgttccattcttaaagaagaaatattcaagtaagtattatatgtagctttgaagttactacatgtaattcagtttggtccagattgtttttggcagctggaaatcaatgtgccaatttggacagcctgcaaaggattgggcagagtgaagaataggtccatatggaatggacgcataattttgcgcccaaaggcctgtccccttgtaaattttgctgaatttttgcaggaagcatggatgcttgtttgcgaattgagattcatgtaggagttgggctattcacctgttcaaactcggagattagaaacttggagcaaattttactttgccatggagttcatgaaaaagccggtgtttgctttgacaatataccttcactttccaagctgattcggcgcctaggattcaaaattgaggatttatcctctagtgccaatgacatataaggtcagaaggctataaatgcttaatttctatctaaaaggagtgcatctgatcaaattttaccatgaagctcggcacaaaatctcaattgaactagaggactttgtatgcatatgacagatttaggctgatttcaaacctcgtgttttcaacatttctatatggcacagaaaataaaatagagtggctcattaacaggtgattaattaaatatcagttgtaaaaaaacttaaaaataaattaatatgatattttaaagtaatttttctatagatattttttacaaatataccgtgtagcagtttggaaaacatgtgcgcggaaaacgggaggcaaaagttaggaaaatggagtagagaactttggaactttgggggtggttagatatagggatataaagttttggcgtgtcacatcgatattatatagggtgttgcacgaggtgtttgggcactaataaaaaaattaattatataatccgccaataaacctcaagaagaatttattaagtctaattaatctatcattagcaaatgtttaatgtagcactacattgtcaattaggcttaaaagattcctcttataaattagtcataatttgtacaattagttattttttagtctatatttaatacttcattcggtgttcaaacgtttgatgtgacatggtaaaaaattttaggtgataactaaacagcgcctttgcaaagaagaaggggaaaagtacgtaaacgaaaagagagagaaaaaacgagagannnnnnnnnnnnnnnnnnnnnnnnnnnnnnnnnnnnnnnnn

SEQ ID NO: 35413 - DNA, 3099 bp, Oryza sativa
tgtctatattcatataaatgttaatgaatctacctgtctaagaaaatataggcaatactagaaagtcttataatatgaaactgagaaaatagtagatattactattttttctataaatctaatcaaactataaacaattttactttaactagagtcaaaacctctttacctaaaacggagggaatactttccatattcatttcgcgcttggccccctcattcgccgaaagaatccatcgggcccacctgtcagccactcatacggctcaccgagttcgtgctggtgtgcagtgtgtagctgctctgatcatgcgcgttgccggcgatttcttctacgagctctgaatctctcgtgcgcatgcgatgcaggtgaggcagctgctgaagaggagcgacgagggccgcgtcgtcgcgacgtgtcgcgcgccggattcagccgtggagcttcagaagctgaggcaggagcacgagcagcgcctcgccgtgctcccgctcgacgtcaccgacgagagcaccatagaggtatagatatactgtgcactatatgcagagattgataggtagtactccctccgtattgtaatgtataacgctgttgactttccgaccaacgtttgaccatttgttttattcaaaatttttgtgtaaatataaaaatatttatgtcatgcttaaagaacatttgataacgaatcaagccatagtaaaataaataataattacataaattttttgaataaaacgaatagtcaaacgttagacaaaaagttaacggcgtcatacattaataacggcgtcgtacattaaaatatagaggtagtagtagtagattagattattctttgcttggattgctagtcgtacccggatagacaatgttgtgttgtgagcagagttacttgatattcagattcagaaggatgatatgaggttttgttttttctagtctgcacagcttgtttcttggtaggaactactagattatgatgctagtgaaggcatgctgaattgagacttgagagttcttaggccattcacagtgggatgatctgtcattcagcccaacgctgccacatctgcgagattcttcaatccagtgccacgtttactcctgggcccactaaattagtccgcgtgaccaactttggtcacacgttcttcggctcaaaaagcgagataggaagcagaaaagcgagagagagagagagagaggagctcccaagccagaaaagtagggaaaagcattacttggtgggcccactttagatacccatgctgccaatctgccatgcattgtgagccgagtagctttgagcgtggtttgcttacgtggaggtagaaagcccctgctgattccgcggcgcagtgtgaatggccttatgtaaaattttgagtcttccggtgacaggcagctgcggcctcgataggagagacccatggatctctgaacctgctgatcaatgcaactgggatcctttcaattccgaatgtgatacatccaggtttatagttgaaatttgagcatagcttttcaggttgcatttgattggttggttggttgttgcttgctgaatttgggatattttcatgttgtgttacagagactacatttagcaaagttcagaagtcatccctgctactggcatatgaagtgaacgctgttggccctattttagtgatcaaggtataaataataactcactgtttcacttccgttttcatattcttgtcgtgatgtggtcggatatcatctgttatatagacatgcttactctaaattgatttgttctatcagcatatgtggccattcctgaaggctggaggttgctctgagaccgggagaggattttcattggttgcaaacatgagtgccagagtcggttcaataggtgacaatggcctaggaggctggcattcatatagggcttctaaaacagcactgaatcaatgtatgcaaatactaacatgttccatcttgtctgcactagcctgcttttggcactaatcttaattttacagataatttgtttccatcagatttacaaaatgttttgctaattttgtgcagtgacaaagactgtatcagttgagctggggaaaaaggacaacattgcctgcatcctgctgcatccaggaaccgtggacactgacctctcacgcccttttcagaagaatgttcccaaggataagctcttcacaagggagttctctgttcagaagctactgtccatcatcgacaatgtcaagaagagcgacaacggcaagttcttcgcttgggatggacaagaaatcccatggtgatatcaatcagcacttcagcagagcaagtgagcaacagtgtccaaaatttgtgctcaatattttctcagcctttattgtgttgttggcaccaaatagatcgtgtcaatgctcgatttgaattctatttggatctacgatgatctgaacataacaaaccaaaatccattttcttttcgcttcctttttagatgcatacaaatgatcgatgtaactttcttttgccactggtggcacaacagttaacccagtgtaattagctgcaacgtattctgatggatgtatatgttgaaaaacttccagccaatttctcaactactgcatcatgtccatatcatatcctgcgacgaccattgacttgtaaagtacttcaaatctcctccatagtactagaaattatagaacattatatgctaccacaggagactcctggtagtctatcattgatgccggattgactacggccatggccggctggggtacgtccaggaaagaagtcgccaatgccagatgcatggaagcttctgtcgataagttgacagtgacgtggtctcccttgcacgatacttgaatcttatgtgcactaatcaacgaagaaaaatatatagtgcaaaccccatatgtactaaaaatctaaaaactactactagatctaaaaataacgtctgataccaatagtaaaagtttgagttaatttgatccataccattgtaaatgtgtatattcagaaaaatatcattacaattcatctatttcgaaccgtgccattgaaatttatgtaaaattagaagtgtgccactg

SEQ ID NO: 35414 - DNA, 13057 bp, Oryza sativa
  unsure (1)..(13057): unsure at all n locations
tggcactgctccctgccaccgccgccgcaaaagtggacgtcgcggcagctgggcaccgctgcctccttgaacatggctctcagcgcctggacattggccacaagcgcatagaacctctccatctgctgctgatcttcctctcctcgctcgtcgccgtcgcgtgggaggccgagaaggagtccttgagcgcgtcggcgtcgcgcgaggagggagcggtccagagcgaggcgagcagcggctcggggcgcccgcacgcgaacgtgcgccgcacgaacgggcccaggtcctccccagcggcgatggcgatggagagctgggcgaggtcggcctccgacgctgccgccgacgccggcgcgtcgccgggctgcttccgtcgcatcaagatctggtcatccctgtcgagctcttcgtcgtgttctcgtcgttcagcagcaaggtggcgccggcagggcctcctctcccagctcgccgtcgacgccaccctcacccagttcgccatcgacgccgccctcgctaggaagtccaccgcggtggtcgggatgaggacggtaacggagatggatggaaacgtgatgacagtgggagacttctaatctatctatctatctatctatctattatctatctatctatctatctatctatctatctatctatctatctatcgattttctagaaacgctctcataccgccatgtagcaccctacaaacactcctatgccgccacgtggcgctctaataaatttagaattctaaaataaatctggtgaacccattattttttaccattggatctataataaaaataaccaatccgatttatcttaaaaaggcccacgtaacccccataggtggataggtgcatgtacgtacgtacgtacgtcatgcacggccccacgttcatcttttctccttttttcttttttcgatcataagaataaaaaccgaattaattatttcagcccatagatattaaatccagcctatatatatgcaaaaatatatgtacatgccaataatatattatttttttcatatattatatatattatttagtacgttgggccccacgtccctccttttcttttttttttctttttgactcgcatcacataaaactcaaattaataaataataattattaatctatctatcttctattatatactaaaagtccattagactttctagaaacgctctcataccaccatgtggcactctacaaacactccaatgccgccacgtggcgctctaataaatttagaattctaaaataaatctaaccgttagtattcatttaatctggtgaacccattattttttaccattggatctataataaaaataaccaatccgatttatcttaaaaggccataaaccgtcgtgtggcatctacaaacgctcctaagccgccacgtggcactctaataaatttaaaaaaaaatactataaatccggagaaaagaacatctaactatccactttcacttaaattgatgggcccattattattttaaccgtcagatttaatctcatacaaacagagagatggaaagaaagaccacgtaccttccccacctctcccctcagtcgttgcatttgccctctccccccgtacacccctctctctccctcccctctacgtataattcttttttcctatattagctaacggcggaaattcgattgaaaaatttcaacatttgtaacatctaaatcatatatcctgaaaaataaacatctaccctttaatttttattaaaattagtggacataacacttcaagccattaaatcagatttatgttttctcatccttaaaaaaaaaacgtacatcctcctctctgttttcttttaggaaatcctctatttttttccctcacattctctctttatgaaagcttttgcaacaataaattttaaataagcatacttctaaatacataatatttgcaacagtaaattttaaattatactaactttttaacttttaaattataagttcaatttttttatctatttgtaccattgtgttatttatgattaaaatcacaattagaatttatgacacatgttgactatattttaaattgtaaaattatattcatttaagttttgttgagaacctttacatgttattcaaacatatatgaacaattattaaaagaaagtgacattatatactatttcatcatatatcacttcaccagcatgcataactaaaacagatttatgaacttcaaaaagttctaaaaattctgaattatgagaaaaacaaaatatagattataccataatttgatgcatcacaaaacatgcataactaaataagatttacttaaaaaataatgagtcatatcctagctgtttgtccacctatatatcattcagagcttaagatagaaatgacctattatgtaccaaattctacttgataaggccatagaaattatatggaagtaaagataaagctaaattttatttctatataacatgataatatgttcagttttagaacaagcaagcaaaagctgcatgtgtattgtcctgtgtatctatctattatatatgaaaaatccattaaacttcctaaaaaaaactctcaagccgccacgtggcattctaataaattagagaaaaccttacaaattttgagaaaaaagaaaaacatacagccctcgatttttatttaattcggcggacccactatttttaaaccattagatttatttaaaatacatctcaaataataatatatatgcgtacttccgtactatactactcacggcaaaaaaaagaaaaaaacgtaattaccattgtaagaagaaggattaaccctgccacagtcccacctaattggtacgagagaaatgtatatacgtactgttcacctaaaaaacccaaaaaactataaaaaagttctcacatgtacaatacgtactactatccaccggattgagaacaaaaaaaatatcctgggcatgtacatactacgcaccgtcaacccgtccctaataaagttatcaataatgttggatattttcttgagaaacaaagtacaaatgtgggcgctcacaacgcacgtacacttacccctacgaacacacacacgcacactctacccctatgagtacctctgagagattgggccgatatattttgagatcgacaaagtcaccataaatgcctcgctgtcgatggatacgtcgtctgaaagaatttgtcaagtccgggacttgaatatgagtaggaaatttccaccacaaggaacctaaccagttgaactatgttcaattcaaaataatgttggatattaaaacaaccatttaaaccagtgaaaccattatttttaatcgttagatctatcttatataagaaaaacaatcgtttattcatggtacatcacatttcaaaaatattattgtgcaattatattcacgttaggttgcgtagaacctcttacccactctacatgaaatgtttatagatggattgtctctcaaactatatcaatcatattatgctatataaaatttagtggagtttcatgtgccaccaaattcatcctctaataaaccatgataatatatatgcaataaaagaatgaaaaacacactacttttgctttacacttacttttactttcgttgaaatattttctaaagaaaataagtctacctttttttcaaatgacgaagaagattagaaataattgcttatagatattacttaaatatgatataatataaagctaataggttaaaaattataaaaccaactaatgttaaaaaaaattacggagaaatcggggtagatgttctctggttaatatatcgcttttagtgtctcaaacttagtgtacgacacatgcccgcgcatagtttctcaaaaatgtcaaaaaaaaaaaaagaagaaaaagacgattgactgaccagtgcctgactgcctgtagtttgtatttaagtgatcttattttattattactctctcagtccctaaatatttgatgtcgttgacttttttaagcatgcttgaccgttcgtcttattcaaaaacttttatgaaatatataaaactatatgcatacataaaagtatatttaacaatgaatcaaatgatatgaaaaaaattaataattatttaaattttttgaataagacaaacggtcaaacatgtttgaaaaagttaacggcgtcaaatatttaagtacggaaaaagtatatcacattatcacatatcatcgtcggtaagggactgtttagatccatttggaatggcaaatggcaaatggtaaaagttttggtggcaaaagttttgacattgcaaaagtactagttggtgtttagatgcatgttaaatttttgtcattctaacactaaagtgtgagagagaaagagagatggagtggtcccaaagcactttttggcacaatttgctactatggcgtagcaaatgccaaatgccaaattgtcaacttttgctactagtgtttagatccaaaatgacaaaaagtgctacaaaatggtaaaacttttaccattttggaggatctaaacagggcctaatataattgtacaaaatgaaaatctcatccgtgacggagaggaaattggaccaagcagacgcggcaggggcgcaagacagaatacgagtcaagcaggcaggagccatatatcatttggtgcacccaaacgagagcccgtggtcgtctactcgtccatgagattgcgtcaaaccgacctattcggtggttgcgtcacccgttcgatgacttcaatctacccgtatccgatgggctacgcaattagccgatctgatacggccgatttttgttgataaaattttggactttgttagggattcctgtgcccgataattttctctatgtacaattgcttatttgatgaagcataactatcaattttattttcatttttagtttgtttatttgaccctatattttaaaatcgaagttttcgtctgaccctgttttcactccactattagatcctccattagatcgtctgaccctaagacatcatttagaaaaagtaaaaaaaaatcactaccctgatgtgactaaaatactccattactagtcaaccctatccccgtcccaacccccacggcccacctcatacattcccgactcccatcgctggcggcggaggttagccagggtcgagggagtggtggcagtggccgtgtgccgagggagggagaggtggtggcgacgacggtgtgtggaggaagggagtggtggcatcggcgcgcatagggacggagcggcgacggcggttgctgcgttcggagaggaggaagggagcggcgtcagctgctatcgtgctcagagcggatggagggagcgacggctgctgctgcgctcggagcagaggaagggagcggcatcggcggctgttgctgcgcttgactgcatcacggcggcgctgggtcgcatcctgacccatcattgatatcatctctttgaccgctaccgtgtttttgtttcattgtatgtaatttgggatggacaaaataggacaaacgctatgtcaattctttaaaaattaagtcaaatttgtcaaaatgaagctaattaaattatgaaaatgaagccaaatctataaaatctatatcaaattctttacaaatattttaaaggtccaaacaaacaaaatgttttcatacaatagggtgaaataagcaaggacagaaaaaacaaatcattactcagttaacatcgttatcttacctagacggaataaagtcaacctttatcttcaattttaaaaaacagggttaaatgagtaaacctgaaaaaaatgatcacattagtagttaaattttagaacatgatcaaataagcatgcaattaccccttttctctatgtatagttcgaatttagatttgcatttgttttgaagagatttatatcactataaactatcttctcaggtttttataaattatttggagaacaatcatgaacgtgtaaaaaatgctttatgctggaggtctagttttgtccacatatatgcgactatgcaagaggattgaccggttgagaagagtaacaacaaaataaggttcagagatggagggggataatatatgtaggtatctgaaggatgttattatctagctgatcagctcagtgattactcagtagcagcgaggcagtgacttgacagagttctgaaagtaggtctataggtgtaacagagagtatacaaatatacaatacgccaagctagctagagatgatggcatgatgcagctactcttcttctccttcctctttttgctgctagctcgtgaaacctccgccgtcgccgccgatgggtgtagccgccggtgcggcggcttggtcgtcccctaccctttcggcttctccggcagctgccccatcatgctgtcctgcaacgtcgacggcggcagcaactccaccgcggcgctgatcctccaaggcaacgacgctacgacgacggatcgatcgtacaccgtcgtcgacggctcgttcaactcgaccgcctccaccttcaccgtctccgtcccgccgtcgtgcaaccgcaccgtctccgacgccaggcggtggctctccggcgccaactacggcgtgtcgtcgcgcaccggcctgttcctccgcggctgccggaacgcgacgagcagcgactgcagcgtccccgtcgaaaccatgcttcgcacgacgaggtgcagcggtggaggaggcaacgaaaccgcgtcctcctccctgacgtgcatcgcctcgctctcgccggcgacgccggcggagaggggtttgggcggcctgttcgcgcagtgggagaaggtggaggagcctaggtgcgagaacctgctcacatccgtgtatggcgatacacgggaaggggtgttctcgctggagttcgcggcggcggagatggggtggtgggtcaacgggagctgcggcggcggcgtcgacgacctcgggcggtgcgcggcgaacgccacgtgcatccctatgcagaccccgagcggcaactggggccaccggtgcgagtgcctgccatggatggccggcgacgggttcgccgccggcgagggatgctatgctggtatcaattgtgaatttttaatctctccaattcttttattttccctttaaaatgttcgatacaaaaaggtcaagattgagacatcaaggtgcgtacgaccacgtagactagcatagtcacccaacttccatttagtgaataagaactttgattgaaattgcgctgcaaaacttgcttgaatttactagtttgttaggaatcagttcatgataaaaagttactttacatttaggagaaaattctttttcaacttcagtccaccatgtgcagttatcccttgcatattatgtaaaggggctagctatatttaagacaccatattccatgtattctaataaaaactagtgaaaatgtcttcacattataaattaaactatgtttataatatagctatctataaatttttaaacttataatataattatgctgtaaatttcaataattacactataatgtttctcctttttcgagaaacacggtacaaaagcgggcgttcacaaacgcgcgcacactcatccctatgaatacacacatacctacactaaaagaaaatagccgtaaatacgagcaactgtgctaagtctagaacttgatttcaggtgagttggttccaccacaagaaacctaaccaatttagctatactcacttcacacattataatatttatatatacaccttgtaagaaaaatataataaagagtaaattacactagcggtccttaaacttgtaacgaggtttcatttaggtccatgaacttgcaaaacgcacatcgagatccttaaacttggtttaatacatcatcccggtctaaagtctcgttttaccgtggttttgcttacgtggcatgcactggatgatggcacgtatcatcccggtctgacgaggcaatcggtgagcttcttggcgccgtcgacctccacggcgaggagaccctgcaggaagccgcacgcgccgacggccaccatctgcttccggcaccgccgagacggcgagcagcacgaacactgggaaccgctcgtcgacgctgccgcggagggtgctcgggttcgcctggctgaactgcacggcgtggcgcggcgacggcgatgggaaatggtgcggcgccgcgacgccgtaggagtccacgccctgctcacggtggccgtgctgctcggcggctgcgtactgctgccggccgtcgaatccaaactgccgctgcagacatctcagaccattagcatctagcatctcgacgggaagaacacgatggcagggacggggaggtcggaagcgaggcgaacctgcttcatggtggaggcggcggcggcgccgtcgaaggcgtcaccgggcgagacaggcgcggcggtgggcggaaccccaagagggagaagcggtcgaacaccgccgcctccttggaatcctcctccctcgccgccgccaacgacgacgatgacctgaaggacatgaacgcttaccttggacgccggaaactgccactgcatcgctgccgacgggcctcctcctcctccgaggtaatctgcatcacgagaaactacgaattcactcacaaatcacgacgcacagaaaaaaaaaacaatctgaaatcgatatcatcccaaatccatagctgcacgcatccatctctgctctggcagataacatgcccaaaatccgagctcgcacacacccccgcatgagagagagagagattaaaaacaccggtaggatctcgcccgagtcgagcatcacggccacggcggacaccgccgccgccgacagcggcgacccgacggagtcaacgagcgcgtccagcgccgtggcgcgggaatccgccgaccaaggcagagtcgcgggatcagcacatccgcccccgccacaaccccttcacccccaccgttccggggcgatacgagcagccgcgcgtcggcggcgagctaggacagctcggcagccgaggacgacaacagcgacacggtgtggagattcccggcgatggacatgagcgcggaggcgagggggcggaggaggagcagcgcggagtggtgggagagcgactgcgagagcaaggtgagcgacgccacgccaggtgaggaaggagagaaaagatggggagaaaaaaaaaagagaaaaagaaaatttagctatattatcgtccacgtagccaaaaccacggtaaaacgagactttggaccggaatgatacattaaaccaagtttaaggatcttgatacacgttttacaagtttatgaacttaagtgaaacctcgttataagtttaaagaccgctagtgtaaattactctataataaatggccagctgtgaaggatgttgactagttagtactccggcctgatatggttagagcaatgacttggactagtgagtcttccatgtgccgagtactacaacaagtttggtgttatagaaatcgctaaaaaattttctataaatctagtttaatttttttttctataaatctagttaaacttaaaagaagtttgacttaaaaaattcaaaactgacttataatatgaaacacaggggtagtgtattatcaattaatacatcagttttgataaccattcagattttcaatcgctcgaattatttaatatatcattgaaaaaaataaatctgttcaatgcaaaaagggacaagactgagacattgctaacgactacgtagtcttttccacagccgcctaccttgctccaatatataagaacttgaaatataaaagcaagatttgtatgtgaaatatgattgtttgtactttcagataagagaattgctctggtccttctttttgtaccgcaaggtactagtaccgcgaggtactgaaatcccaaccgttgatgatgacagatcgaatggtcaggattagttggtacctcggggtaccgacttggtcgtggtgtggcctgcgcgattgagcaagggtggaagggtagaatcgtagtttcgcgtttggaatgaagtttggatcggtggatggtttggggaagtgcggcatatccttccagactagcatatccttcctgactagcaaaaccctaccctttcacccgatctgaacggcgcggcggcggcggccacgctgaaggcacggcggcgacggccacgctgaaggcacgacggcgacggtggcccctgcacgccggcggtgccggcggcgacggcggcccctgcacggcggcgacgacggcggcccctgcgcggcattcgagaagctttggcttgcgctggaccatgctagcacaacaaatccaaccaggcggcagtacgaatggtccagatagagcgaaagttgaggaagacaaaatgaaacttgaatttgaaatggccgccaagattttggcttgtaaagcaacatataagaaaaaaattacaaagctaaacaaagaggcagaccatgttaaaagttggttcatgggttccctacttgttattgcaattcttatgtacaagatcttggagtatatgtacgaactgtattgttatgaatgcaattttttttttctgaaatctcaaataaattagaaccatccggctgtcagtctcaagcatatcaagcaatattggctcaatgttaccaaatttgctagcacaacttcatactcacatacagtaaacaattcagcgcaccaaattgcaatacatcaaacatatcttcatttccagaacgcaccagcaccaaaacacataattttcagattcgcatacaccatgttcacatacagttaaacacatcaaaattcaaccatgcgagcacaactcaaaatagcagtacatccatcatactacaggaaagcacatcaaagattcattacagtccaatgtattcattacgaccaagagaatgacaaaactatgtaaagtgcatagcaaagggctgcttctacttcttatccatctcacacatcttcttctactttcctgaaattgtaggaatgacaaaacaactttgagacatgattgcaaaatgtaatagcctataacttgaagccgtcatcctcagtcttgaatctcatagcagtaatcgtacgatactcctcttcctcctcaagggtcctgaaattgtcagccatatcttcactcataaagagtttgcctataaagaaaatttcacaattcattctcagtactcaaatctggtcaaacaaaaatcggcacaattaaatcacaaccgtctacctctacgacagcgatgaaatcacaggagtcggcggcaggggcaacaagcacctgcaacggcggcgacgactccagcagcggccgcgacgggcgcggggggcggcgttggtgacgtgtccccacggcggcaggggcgacgtgctcctgcggcagcggttgactcctgcggcggcggcgacgactccagcggcggccgcggagggcggcgttggcgacgtgcccctactacggcggcggcgacgtccaccggcagtagcccgtgcacctgccgcggcggcacttccggtcaagcgggtgggtagcccttgctgcctgcttggtcgtggcctcgtgggatgggatggctatggcgcttcaggatgaggtcgcccaaaacctgagatggatagcgcacgcgatacagcctcatgcccatcgtacccctttagcaatggacggccggataaaaactggtacctcatggtaccagtaccgtgtggtaccgaaaggaggacgggagaaaatctcttcagataaacttgcgggggagatttatttttacaactggagtgcccatttccttctcatttctcaaacagtcaaatatcaatcaaatagttatatttttttttaaaaatgataatattgatacaacatgtatgcacaatcttgcacaattatatttcaggtcgacataagagatctacaaagcaaaaaaaattaaattcgatcattaatactattctctctatttcaaattacttgttgttctatatggtccaaagtcaaatattttaatctcaatcatcaacttttataaactcatagtaatatcataagatctatttttttagttatatcatgataaatactttcataatatataatattcacatgttattaaaccatacgattttttagaaattaatagttgagatagacatatttgacttaaaataaatataaaacaacaaataatttgaaatggaggaaatactaatattgtttaaagccaaatttgttttttttgaaatgaactgtacgatacagtgcgaggttgcacgtactatatgagtttagttcggtatgttcatgtagcgatatataggaaactattctaactatttagataacatgtaaggatgaacgccttcatatttaagttgtaaatagactaattcgtgcgcctttttgtttttttattgcaaaagtgtactattttctagaagtggattttttcccttgaggggacatcccctcgttttatacgtgtcgttcaaaaagttataaaaaattaaaaaaaattatcaagatagatcaatatatcttttctcaaacatgcgagctaaaaatcgatttatacaattcaaaacaaaaataaaaaatttgtcattttttttctacttgtataagttgaatttgaatttgtgtatttgtgaagtgacatatcacatatttatctgtcctacttttttttttcaattttttgatgattttttaagtaacatgtaaaaataaaggaatatcccttatgatttgagttttccctctcttctctcacgatcgactgtctcttcttcctcaatttccaatgcaggaaaacgtcgtcgaatgcgggtagtagagtttgccaccgccggttcggtggcgttcttgctctgcctcgctctctctgtttggtgcctcttacgccgccgacaatggcggcggaataatgccaagctcacggtgaagatggcgcggaaacatctnnnnnnnnnnnnnnnnnnnnnnnnnnnnnnnnnnnnnnnnnnnnnnnnnnnnnnnnn

SEQ ID NO: 35415 - DNA, 4692 bp, Oryza sativa
  unsure (1)..(4692): unsure at all n locations
nnnnnnnnnnnnnnnnnnnnnnnnnnnnnnnnnnnnnnnnnnnnnnnnnnnnnnnnnnnnnnttctgtcatcaagtgccgcgcctaggatccttttacttgcagttgagtcactgatatatgggtcatagtaaagtgaaaccaacatgtcagtgactcagctacacgtacagttaagtcagaggatccgcttccaccgcgcctatatgcgcggcaaggccagctagattcgcatcttttcccgctcgccttcatcgaaccacccttcgtcgagcaccttgcgtgcatgcccatcgagctcgccatcgccatctgcctcgcccttcacctcgttcgccgacgagcacctcccgcctgtgcatgccatccccttgccgtgctcgccttcctctcgccctggagacctagcgcctagagtgccgagaccgccggccgaacacttggcgtgcgtacgcggcaactcatccagctgctgggcatggatcagccgctgactgggttcctatgccacgcgcgcgcgtcaaagccattgcttgcaagcaggcaacaacctcatctagttcgtcacatgctgagtcacgcacgcacgcacgctacactacgacagatccgggcgccactcgtggtgtattacctacgtgttcaggtattattcatacttcaatgcatcgagagaagcacaagaaccagaaggtcgtccaagtgcacgaggaaacacagagaagaaatcatgcatgtatgaccagagaaagtattctaaactattaaaagacctcgttcggttaatctctcccataaagaaatcgcggtggattcagagaagatttattctacatctattgtagtactgtgtaatataattattctctctcaatcccttccaatctctctctttgggattaaattaacatgctttaaaagggaatgtcctctcgtgtgctgcatattaccttaaaaaatgtttgtaagatagattaatatgtgatatatcattttataagcatacaagtttaaatatgtcttctacaagttataataaaaaaaatataactgtatatacgcatacaagtcaaaatttaatttaattttttacaacttgtagaagttgtatttgaatatgtttgtggagcgatataccatattttaaaatatatcttgctattttttcagttcttttacatctatttaaatggtaaaagggggcattcctattagaatcttttctgttcattagctggtcgatcgtagtgataatagagaggggggggggaactattttttgtccattaggggatattcttttgcatgccacttaagtatctattaaaaagtttgaaaaatatgggtatgataaatcaatataaaacatgtcatttcacaaacataaaacatactattcgctgtgaaatttgttatgttttctattcgtataaagtttaaatttgtatatttgtgaaataatatatcctactttgcataggttcaatacgtaagaattcacatttggccagtaaacccaagcatgtgcatgcatgcatgtccaagagggaaaaaaaattggtccaacacatgtgagtagctagaaacggcccaagtacgcgtaagagtagaattgtccccgcttaaaagagacgaactgcatatgcgtacgtccagtcatccacacaaactcaaatttgccatcaattctttcataagtctctgttataaaaccagccctaaaatcgacatcggtagctaaacgcgaagaaaacatcacaggagatccacacaaactctaacagtctccatccctaattcgtcatcgaaaaagccttcctgttcctaggaactagtggcgtcgctggctggccatggcctcggaccttgtcatcttcctcctcttcctcgccgtcgtcgtcggctcgctatgcgagacggcaatcggtcatcacaacctgaacctcccgtatcagccgtcgtgctcgaccaccggcaactacaccggcgacagccagtacaagaagaacctcgaccagctgttcaccagcctctccggcggcgccatcgccggggactggttcaacaccagctcggtcgggacgggcgccgaccaggtgttcggcctcatcatgtgctacgccgacagcaacgcgacggagtgccagaaatgcctcgccatggcgcccgctgtggtccagcatccgtgccgcggaagccggtcggtgaacgccaactacgacgcctgcctcctccgctactccgacgagcccttcttctccgagctcaccacctatggcggcaacaccaacgtttccttggacgtcgacgacacgaacctctacgtcgagaatatgaccgccatgaacgacacgcggtggcagctgatgagccagctcgccgagagggccggcgacaccaagctcaggctggacaacggcagcttgccgtacgtcgactcgaagctcggcacgtcggcgttgtacgggctggcgcagtgcacgagggacctggcggcgagcgagtgccggaggtgcctgagcggctatgtcaatgacctcagcaacaccttccccaacaacagcggcggcgccattaaggggtacagctgctacctcaggtaccagctttggccgatagacatcacgctgcccccgccgccgtcgccgcctccggcaccgcctgcacctcctcctccctcggtgtcgataggactcgtggccggattgaccgtcggcgccgtctcgttcgtggtggttcttggtgtctcaatctggctcctcttgcaccgccggcggaagcacgccggcctaacgatggagcaggagatggacgagggtgacttcttcgacgatgaggccggtgactttgagaaggggactggacccaaacggttccgctacggcgagctcgccatcgccaccgacgacttctccgacgagcacaagctcggggaaggcgggttcgggtcagtttacagagggttcttgaaagaattgaaccttgacgtcgccattaaaagagtgtccaagagctcgaagcaggggaggaaggagtacgcgtcggaggtgcggatcatcagccgcctccgccaccgcaacctggtgcagctcatcggctggtgccacggcggcggcgagctcctcctcgtctacgagctcatgcccaacgccagcctcgacacccacctatacagcgccaacgccggcgcgctcccatggccactcaggcacgagatcgtgctcgggatcggctcggcgctgctgtacctgcacgaggggtgggagcagtgtgtggtgcaccgcgacatcaagccgagcaacatcatgcttgacgccgccttcaacgccaagcttggcgacttcggcctcgcgaggctcgtcgaccatggccggggctcccacaccacggtgatcgccggcacgatggggtacatggatccggagtgcatgatcaccggtagggccaacactgagtccgacatatacagcttcggtatcgtcctcctcgagattgcctgcggccgaccgccggtaatggcaccggaacaccaagctgagaaaggacaagacatgatccaccttgttcaatgggtctgggatctgtacggcaaggggagaattcttgacgccgccgatcaccggctcgatggcgagttcaacggcgggagatggagcgtgtcatgatcgtcgggctctggtgcgcgcaccctgacaggagcgtgaggccggtgatcaggcaggccgtcagcgtactgcgaggtgaggcgccgccgcgagccctcccggcgagaatgccggtggcgacgttcctgccaccgattgatgctttcggctacacatcttcggttgtaacagggagcagcaccagcagcggcaacataggcgttcctaacactcagacatcgtccttgctaagatgacatatttgacatctcagcaatgcattttgtgtataagatcaactgcacattggattaatttttttattaatttttttagtgtatctttggttgaatgtggcccgttgaagatatgggatctaagggtgaaaattcgttgctactacacctctatactaggtgtagtagctagtgtagtagaagggtagttatgaaaagaattaatatttcttgtataattattaattttttttcctatcatttgattcagtgttaaatatacctactatattattaaaggaatagaaaaaggagcctccacgttcgctctcatggcctagaaattctcacattaatcggagaaaaagaaaaagcagagtccatatagaaatacaatttagaaatagctgaaattcgaaattaaaaaaataaggaatattagaagaggagactagagtccatatagaaatacaatttagaaatagttgaaattcggaattaaaaataaagaatattagaagaggatactggagtccatatagaaatacaattaggaaataactgaaattcggaattaaaaataaggaatattagaagtagagtatagggtccatatagaaatacaattaggaaacaactgaaattcggaattaaaaataagaaatattagaagtagagtatagagtccatatagaaataaaattaggaaacaactgaaattcagaattaaaaataaggaatattagaagtagagtatagagtccatatagaaatacatgaaataatataaatttggaattaaaaataagaaat

SEQ ID NO: 35416 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnnnaatgagaaattgcgcgggcagttgcgaatttatgacttaaccaaagggcgtcaagtgggtagtcttctggctgaggtacaaattttacctgtcccagttcgttttctaaccattttcctgcgacaatatgtttttagatattttattattgatcatgctatgaatagtgagcttccatttggaaatgtagtttgctgctaatgttgctattgcaattagaaatataacaataatattgtgctgtagtatctgtggtaaggttttctattaaaacttacatcaatgtgttgtttgcttcgatttaaacagacccgtaaaccggaaatgattgttgcaagtagctctggtgaatttttgggtattacaaataagagaaagctccatgtatggaggataccaacaaaaaatttcaagcccgacaagataaggaagataaagcttagccacacaaaaaacttgaacacactggccttccatccaagtgagagaattggtgctagtggtgatgcaacggggcgaatactgatcttgagagttttggaaatgcaaaagtttcttgatcagatggcacaaaatctgaactagattaggaacagggtgatgtgaagggtaatggtgatgcacatacttgcacttcatggcattggca

SEQ ID NO: 35417 - DNA, 1234 bp, Oryza sativa
gctcacgagtttatgcaaattttaacattttaaaaggaaaaaaaatatgttttctatttaaaagatccaaaagtttgcacccgcaacaaaagattgcacaagttaaagaataggacaatcgctaccgtagcctgttggagtcacctaccgtctagaaggatgcttttttatgaagagaaaaacatgccgctcctcctcaaacccaatcggatccagaattgcagattcatgtgacaagcatcaatcatcatgcctgacgtctgatcttcacaatggtaaaaaaaatgttgaacaattatttggtcagtgggaggaccgactggacagtaaccttgggtaatctgaccatccgaaggataggcagtaaaagaaactccattatgttcagacactataagcaatagaaatgttccatgagatgatcgcgatcttccgtgaaatgcaattctgaaagtctcagattttcaatgtgttccgtttccagcaggctggtagatcagagaaccctatgactgtcactgattcactgattttcaatgtgttcttaaaccggtagaatggatatgtagcctgaaaacaggacagttaacaaatcaatccaatttgggagcttcggaagcgtgtacgtgataatccatagtctacaagaaaaggaacagggcctaaacaggggtaaaaatcaatccaattttgcaattgatctgatacataaaatgcatgtcaaattatcaatactcaatatgtcatcttagcaaggacgatgtctcagtgtgaggagcgccagtgctgccgctgctgctccctgtcacagccaaagatgacgtgtagccaaaagcatcaatcggtggcaggaacgtcgccaccggcatcctcgccgggaggctcggcggcggcgcctcacccctcagcacgctgatggcctgcctgatcaccggcctcacgctccggtcagggtgcgcgcaccagagcccgacaaccatgacacgctccatctcgccaccgtcgaactcgccggtgagccgccggtcagcagcgtcaagaatcctcccattgccgtacaaatcccagacccattgagcaaggtggatccggtcttcgtctacctcggattggtggtccgccattatcggtcgccggccacaggcgatctcaaggaggaggacgccaaagctgtacgcgtcggactcggcgttggccctgccggtgatcatgcacttcgggtccatgtacccca

SEQ ID NO: 35418 - DNA, 825 bp, Oryza sativa
agagaggaagagagcataagtagatgacaggtgggtcccacaaatttttttataatatagtgctgattggactgccacgcgcacgtcacgtggaccaaaaccaccgcggattggatcgaggggggtaatttgtccggtttacatagttgggggtgaagaatacccagttttgtggttcgggggtaattcggacaaccgcgatagttcgggaggggggtaattcgtactttttccaataataaatatggtcaattatcaactgattgagtgtcgttttttaaagagatgctatcgattccaactgttttcatcccttgggccgtagcaacaccgggctgaaattgtcacagcgaggggaaaaaatggaaaaagaaaaaaaagaggaaaaggagaggtcgacgtcgatgtcaattgtcaagctcgatttgcggcggtggccggcggcgaggaaacaacgggccggagatgttggtcgtcggcgccgatgagtggcacggcagctggattgattgggccggagcccactggatcattaattacgcgtgcggtttggcccgaaccaactgcagggttgggtgcacgtactaaaattcttactaaacctttagctttagtaacagtcatattatggtggtttcatgttgctgaattcggtggttgtctaatacacattttgtcctgtaataaaacaatctaataggatgaaacataactgagtacaataaatcctgatagcatctaatttgttttataaaacggagagataatatatgaatttatagtggacatgtcacatgtgtatagggtaccgagctcgaattcgcc

SEQ ID NO: 35419 - DNA, 664 bp, Oryza sativa
  unsure (1)..(664): unsure at all n locations
ttacgcnnnnnnnnnnnnnnnnnnnnnnnnnnnnnnnnnnnnnnnnnnnnnnnnnnnnnnnaatggcatggctggggttggtaaatgcaaatgttgagctggtccctgtcgacatccccatgcccgacatttttcccatgcacaacccaacaccgtcggggcccaaggatggatgtttgtccccggtgattattcacctggacaccttggaggacctccagccttatccaatggtgtacaaacaatacaagtggtcctacggaaactatgatgattgtatctcgttcccaaataggctataaggctatgccatgcagactacatccgaatgctgtgcggggaccaaatgaagacccagatgtggatggtggtggaggttatacgtgctaccaaaaacgatccaagtcactgtggggccgcatcacggggagatcccacagcattgatcgtgggggagatggggaaagattctacaatgaacacactaggggatgccatcgcaacagagacacatacattatctttaacacattctccgatctatggacgacactgaagttagggccaccattctacttttaaccctgcataaccacatagccaagaagggggggggatccctcgcttttgatctgtcttcttccccaactgaggtgttttcctt

SEQ ID NO: 35420 - DNA, 959 bp, Oryza sativa
  unsure (1)..(959): unsure at all n locations
nnnnnnnnnnnnnnnnnnnnnnnnnnnnnnnnnnnnnnnnnnnnnnnnnnnnnnnnnnnnnnctcagcatagagcgaaacaatccttgaatagattggggtgcatttgatgttgccgctttcatccttcattacaatgccagggcggacttcaatgttctggttcaccctcaaaactccctataaaagaagcatcacaatttaagtcatacctaataacccaaaagtagtgataaaaaatctaattacatgacacacgagggaatacatactctgaggatgctgccaccagctacaccacccctaatttcatcaacctctgaaccaggcttgttgacatcaaaggagcgaatgacaatcatgtttggaggggaagtgaagttcctttcaggaatggggattttcttcacaatgtattcacatatcacatcaatgttatacttaagctgagcagatattggcaccaccggagcaccttcagctatggtaccctatagagaaataaaataacccataaacaaatagacagacagatgtacccatctacaagataataatggacagtagcaacctggatgaatttctggatcgcttcatgttgattcattgctgcactttcctggataagatcaatcttgttctgaagaataatgatatgttggagacgcatgatttcaaccgcagcaagatgctcagatgtttggggttgtgggcagctttcattggctgctatcaaaagcaatgctccatccatgatagcagctccattaagcattgtagccatgagaatgtcatgcccctgttaagaagaaataggtatgtattacatatgtaatattttctcattattgacttcgagagatcaaaaaataaaaaacaatatgcagtgacccataaaaatatttgagatgacatcagtttatacttcttatcgggtaccgagctcgaattcgccctata

SEQ ID NO: 35421 - DNA, 554 bp, Oryza sativa
  unsure (1)..(554): unsure at all n locations
nnnnnnnnnnnnnnnnnnnnnnnnnnnnnnnnnnnnnnnnnnnnnnnnnnnnnnnntgctggagggattcgctcctatccagaagtaacgaacacaggtgatctccatatcccagctggaacggtaacgcacggcaaacagagtagtccattatcgcgtgattaattaaatattagctaatttttttaaaaaatagattaatttgatttttttaagcaactttcgtataaaaacttttttaaaaaacataccatttaacagtttaaaaagcgtgcacgtggaaagcgatgatgaggggatgagaaaaggggcatccgaacacacccactcggtcacggtacggtacgatacacacaccaaataattaggagtatcttgccaagtgttcaactagacatggtccagcgcgtatcatcgagaactggtgcttgaccgctactagttgtcttaaaaaaaaacatgcatacatatgcacctcatcccttcaattgaatccaagaaaaatgggatcaaagcctcatgtcatagcanatcaagagcgtcgcagctagccg

SEQ ID NO: 35422 - DNA, 701 bp, Oryza sativa
agagtatatttatctataaatgtagttaaatttaaaacaatttgtctttttaccaaaatccaaacatgttataacttgaaatggagtaagtagtaaatatggagaagcgaaggaattgatgtgaaaaaaaggtgaaaatgagatgggagatgggagaggaggaggaggaaggagatgatgagtgctcacgaactcgagcccgatgccgcgggacgcgccctgcaccatggacacgccgccgccggatgtcgccgtcaacgagaacgccctcgccgccgccgccgcagccgccagcgtcctcgccgtcgccattgctcctcctctcgcctcgattcgattctcttcctccgggtgctcgcggcggttcggtggcgaggcgaggcgcacaggggcagtaatggcgggtcgttgttgtgggggaaattttgggggagaattgcgtggctagatgaaggcacacgtatgccgcgcgctggccgggaacggcctctttaattcctctctcgttttttctctctcttttcgtttacgtacttttccccttcttctttgcaaaggcgctgtttagttatcacctaaaattttttaccatgtcacatcaaacgtttgaaccaccgaatgaagtattaaatatagactaaaaaataactaattgtacaaattatgactaatttataagaggaatcttttaagcctaattg

SEQ ID NO: 35423 - DNA, 1377 bp, Oryza sativa
  unsure (1)..(1377): unsure at all n locations
nnnnnnnnnnnnnnnnnnnnnnnnnnnnnnnnnnnnnnnnnnnnnnnnnnnnnnnnnnnnnnnagtgcttcttatccatataccctgttctccaaaccctagcccaaactccatccactccatccactgtgtcgccgccaccagcatccactccgccgtcaccaccgtccccttcctcctcctcccacccgccgctgcgggcgccgctgctcatcaccatctccttcaccttctctttccccaccctcacgccgccgcccaccacgccgtcgtcctcctcctcctcggtcgcgcttcgatccccatcgccatggccttgggtggcgtgtccatggccatcatcgccatggccttgggcggcggcggcggcggcggaggcgggagcgtgaaggggagggacatggcggggagcggatgggcggccgacgcctgctgcacggcggcgacctcctcgacgcggcgctcgaggcggccaatgcgcgcatcggcctcgtcgcggaggcggcgcacgccgtcgagcacgtggtagggtcgtggcgggacagccaccgcgcgatggcggtgtcggcggcctccatacggcgggccagctgggcggtgcgttacatgttccaccgccggcgccaacagccgagcggctagcagatcaggtggcgatggaaggccagcgccgccgccgccaggaggaaggcgatggagggcgcggaggtggaaggggagggcaaggggaagcactggatggaggatgacaaagtgggccacgtaagctattccccgagttctctcactaaacgccactctgctctttgctcttcctccaggaccccaaggccatcaagatacggcggcacgccttccatctccaccagtgcgtcgccgcctgccctcccctcctccgaattccttggctttgcttgcgagaatttgaatcggattgacgaatcgtgtgcttggttggtttctcctccaggtcggggtcaaccacgctttccgcgtcggcgctacgtactcctgccgccgggatcactggcggagtcgccgccgcttctcgatcgcatctgcttggctcacggccactcagggggagttgcgcttacctccgcgtcgctcgtcgagccgttcttggtcgaggagcagcacaatagccccagccaggttggatttagcttccgcaccagtgtgatttgaggtgtttctactttctaatgataatttttttttggttgcttgcaggatatgcaaccgaggttggtaccagaggctcatcttgatgtgctcgttgaggtgaggatagtaaactgatgcatatcttcgggagcattaagactcgatatcaatgtttgttaaattaaggatacataggatcatgtgtgtagg

SEQ ID NO: 35424 - DNA, 966 bp, Oryza sativa
  unsure (1)..(966): unsure at all n locations
nnnnnnnnnnnnnnnnnnnnnnnnnnnnnnnnttttaaattatgacaacttcaaacaatattttcaaatactaaatgatttgaaatgaaaaagtcatcaacaacaaagttgtataacttatcaatatctataatttttactttggtcatttttctatatgactttgtttcaataatttgaatttgaatttcaaattatgacaacttcaaacaacattttcaaatactaaatgatttgaactgaaaaaatcaacaaaaacaaagttgtataactcatcaatatctataacttttattttggtcgtttattcatctgacaaagtgatagtaacattgttcacaaaatttacatatctctcttatagtttataaaccatatggagatatgtaaaatttatgaacaatgttaaaatcactttgtcgaatgaacaaatgaccaaaatgaaaattgtagatctagatgaattgtacaactttcttgttgatgactttttcagttgaagtcgttcactaataaaaaattctatttgaagttctcaaactttgaatttcaaatttcaaattatttaaatagagtcagatagagaaatgaccaaaataaaatttttgcatctcgatgagttctacaactttgattttggtgacttttccatttgaaatcatttattaatcccaaattttgttcgaagttgttaaattttgaaaattcaaattttgaaatgttcaaatgaacttattcgtaaaatggaccaatacaatagttgtagatctcgatgagctctacaattttgttgtttatgatttttacatttgatacacaaaacatagcctaaaattaaatttaaagttatcataaattgaaattaaaaagtacaacatattattgtattttttttttgccaaaaacaaagaaagggctgcagaggcgccccgaatttttggtgcgaaccaaagttttagcgccaaa

SEQ ID NO: 35425 - DNA, 565 bp, Oryza sativa
  unsure (1)..(565): unsure at all n locations
nnnnnnnnnnnnnnnnnnnnnnnnnnnnnnnnnnnnnatcttgtcgggcttgaaattttttgttggtatcctccatacatggagctttctcttatttgtaatacccaaaaattcaccagagctacttgcaacaatcatttccggtttacgggtctgtgttaaatcgaagcacacaacacattgatgtaagtgttaatagaaaaccttaccacagatactacagcacaatattattgatatatttctaattgcaatagcaacattagcagcaaactacatttccaaatggaagctcactattcatagcatgatcaataataaaatatgtaaaaacatattgtcgcaggaaaatggttagaaaacgaactgggacaggtaaaatttgtacctcagccagaagactacccacttgacgccctttggctaagtcataaattcgcaactgcccgcgcaatttctcattagatggcttactggtgtctttaacagagacgaatgcaaacggcgtgtaaatttcagctcctctcgatattctggctatgttaggaatgacctgcgcccaaaa

SEQ ID NO: 35426 - DNA, 280 bp, Oryza sativa
ttatgatgtcataatacgacttacaagttacaatcaatttgaaacgcgtgaattttactgaagccgaatcaagtagaattcctgcgtttcaaatggacccaaccgcaacaaccgaaatgtcaaagcaaatttttacatccaggcaaactggcgacacagacagcgagatcacatgacgtccacgtaggacgacgtgtcatcatccaggccgtccacgtcacgctggtcaaacttgtcgaccaatctcgaccctccaacctcgagcctcccgatcatggcg

SEQ ID NO: 35427 - DNA, 710 bp, Oryza sativa
  unsure (1)..(710): unsure at all n locations
tagtgagtctatggatatattatccaaatcaatgtactaggcctaggaaggaacatggtctgtagccagtgacgacagggtctgctgccgtgtagaatttagttcattacttgaatatcgaatgattcctgcaaaattttgccattgtctccaaaattggaagtgccttttataaaatccaccataacccaatggatccttaagcataaaggtaaaggctttatatacatgtaatcgtgtatggtatataatctggacttttccagaattaaaatagcagatttacctaggctttcctcgagcatctataagttgatgtgtcttggcatcaatgttctcttttacctgagaaaaaaaatcatgaactagttataccaaacatgcgactgagtttaataaatggtgaagaaatgtatgggcaagattttcagcctgaagacctctaacctggtcaagattccaaataagatgaggctgcaactttgcttcaaatgtggagggaccaacctacaaagataataaaaagttatgtgtgactgaaggtcaagctaagcaccattcacagcagctactagcatgagtatcacgattcaggggttgacaagtacataacaggagtaaggtccaaatgttagaaaacaaaatagaggttannnnnnnnnnnnnnnnnnnnnnnnnnnnnnnnnnnnnnnnnnnnnnnnnnnnnnnnn

SEQ ID NO: 35428 - DNA, 869 bp, Oryza sativa
  unsure (1)..(869): unsure at all n locations
tgcaagcttggttatgctaatgcgaaaatctacaaatgtgaagacgagaaatgcccacgaccaatgtgctacaagtatgcaataaaccactaaatggcatgatttgttctatgcaatgaacttccatttgtattaccatgttaaaaacacttatctatataaaattagttttccagttaatatctggtagaagttatgattaaaatctcatgattgattctccagaaaagtaacttataattatctgccattcacctacttaggactgctgctttgatgtcaagctaatgcatgtgagctctgcactatatgttgactttttttcctgttatataaagggcttatggaagtggaaaagaagatagccctcactgtgatgtgcctgggtttgaaaacactaggatgaagctactgagacatgtttcttttgttgattgtccggtatgatataaacctcttaccctttgttgcatatatgaatgttctttttctcaagacatttctctgagcatttattgtcttcctgaatgtttcatgatattactttatgtggcttttcactagcctgtatatttgttttaaaacattttgttccgtcaattatgatcatggggtttcacttgcattggtttttatatgcaaatattttttccactagaaggcacatggccatacaggagtgaaggatgtagataagaagtataaactgatgtcatctcaaatatttttatgggtcactgcatattgttttttattttttgatctctcgaagtcaataatgagaaaatattacatatgtaatacatacctatttcttcttaacaggggcatnnnnnnnnnnnnnnnnnnnnnnnnnnnnnnnnnnnnnn

SEQ ID NO: 35429 - DNA, 1408 bp, Oryza sativa
ctgagattgttgtgtgaatgtatttgattggatctgagattgttgtgtgatgtatttgatttgtgtgtgatgtgaatatgtgatgaattttgtagaagttgtgatgtaattttttttttaagattttgtgatgtatttgaatatttgagatgatcgatttgtggatttcaaggcaatttgaggatgattgatttgggattttggggatggaatggggtgaaatcaatatatttaaaaataatgaagaaaaaaaaataataaagaggaaccggaaagagcaaccggattagcctctttagtcccggttggtatgctttatctttagtcccggttggtgttaccaaccgggactaaaaatagatttttactcccgatttttttacccgggactaaagatagcgatctttagtcccggattcgtagttccggtttgaaaaccaggactataggggggttacgaaccggtagtaataaccctttcttcaccagtgctactagctttggatcagagtgtagatattggatccaacacaaaaggtaataagaattattacatcttgtgtcctgcctaattggtaattagtgtggcactcaacctaagcttagttggtaattatgaaaaccaagggtacgtagttcaggaggtttatgttctaagcaaccaaaattagttacactacactactcataccaatttccactcgctcgatcaagaacataacattctttgaattggaagtgtacacatcaacgacctgtccaggctagaaactgtagcaaattttataagtaggcctaccaatctagctagcagcttaattagttcacgcgtcataaaataaagtgagcatatagatcaccaagttgtcccctaagggtctctttgagaagcctaaattcccactttatttttgtagggtctcgtttgaaaaataaaaagcgacagcaaaaaactctaaattgcgaagtgagtatagttcaattggttagatttctcatggtgaaaacaacccacccaggtggacgggtttaagttctaaacttaacacggatgcttctatttacggctaatttttctttcaatggtaggcgtcgggtacgtactcatgacagcaagacgcccgtggtgacttcgttaattttaagataagttggcccagttttttttggagatgctcatatggttattttagtggtaggcacgagtgtccatcgatagcaaggtgtccatgatgactttgtcaatctcaagacatgtcgacccaatcttttaaaggtgctcgtaggagtgagtgtgcgtatgttgtgggtgtctacatttgtactgtgtgttttttataaaaaaaagacctctaattatttctaaaatttaaatttagctatggctggtgagagcctgatcatggtt

SEQ ID NO: 35430 - DNA, 1616 bp, Oryza sativa
cgagctcggtacccctctttggatgcaaacagaaaagacaggatagatggagaggcatcatcgctggtttatgtcaacggttctcatgagtatgttatatttgatccccgaagcaatgaagaattgcatattggcaagagtgcacacaaaaatattcaaactgaggagcctggtgagttatggtttgctgcatttattctaatcagcttctgtatacttgtatttttcattgtgttaacctgctcttctctacggctatatttgctggtggcaagattatatagtactccctccgttttaaaatgtttgacaccgttgactttttagtatgtgtttgaccatttgtcttattcaaaaaatttaagtaattatttattcttttcatatcatttgattcattgttaaatatactttcatgtacacatatagttttacatatttcacaaatttttttgaataagacgaacggtcaaacatgtaataaaaagtcaacagtgtcaaacattttgaaacggagggagtatatgaacatcatatcccaacattttctcatgctaaatgttttacgctccagaaaccattctcttttttaatgctagccttccagaaaccctttctgaatattgttgcattgtgcctggcaaaaccatttatttgcccctttttcttttgtactctaaaacatgttgaaaaaggctctgaagctcctttttgttattccaggaccaattggttatgcttctatttttggagaacttccgaaactggagtcaaagaaagatgttccagaaattctatttataccgtcagagagaccttgggagactatattcagtggatcaactcatgttcttccgcctctcacaaagttatgtcctgcattcttggcatcattgcttgagaagagaccagttgcaaatgagtgagaaagtgccgaagttttgtcccgtcatacaatgcaacaaggaaccctgctagttacaaatggcattgcacatgaaatccttatgactagtgctgcccgaagctcgtccaatactgctgaagctggttgtgggcattgattatctgtcagctcagctcacaagagaacacatgcgatgatggctacagcaacgctgttgggtgaatgagccaccctacctctttttgtaggtgatatctagtgatctatcttcagatcctagcaaattttgtttccataggctaatctgtaattctgatagcaaaaactagctctttttggtgaaaatgtaacgcgctaagatatccagtaacacggtgagtgaatgatgctgttttactgactctgaatgaagtgtgtgttgatctggtaaactgaaaactcgatgcttctttcagagtttcagttgtctgttgcttgcatacatgatggaatacttttttcttctagaactctataacaaccaggcaaataatttgtcttcctggaaaaaaggcaatcttgtcgattatgtactgatatctggcaggctaaacttagcaattgcattagatgccaaatattgccatataagtcttccagattcagaaattgatggctaagctgcactgacaagtacgaaatgcatgcaggcttgtgaacagtttcagtc

SEQ ID NO: 35431 - DNA, 678 bp, Oryza sativa
  unsure (1)..(678): unsure at all n locations
taatctgtaattctgatagcaaaactagctctttttggtgaaaatgtaacgcgttaagatatccagtaacacggtgagtgaatgatgctgttttactgactctgaataaagtgtgtgttgatctggtaaactgaaaactcgatgcttctttcagagtttcagttgtctgttgcttgcatacatgatggaatacttttttcttctagaactctataacaaccaggcaaataatttgtcttcctggaaaaaaggcaatcttgtcgattatgtactgatatctggcaggctaaacttagcaattgcattagatgccaaatattgccatataagtcttccagattcagaaattgatggctaagctgcactgacaagtacgaaatgcatgcaggcttgtgaacagtttcagtctgtatcgatggcaatagatgttgacccgtgccatatctccaaatatgatactccagtaatttgtatgatattcacatgaatcaagctcagttctcgtacaaatcctatgaaattcgtttgttccaaacaagccctaaacaaaaaaaaattatgatgtcataatacgacttacaagttacaatcaatttgaaacgcgtgaattttactgnnnnnnnnnnnnnnnnnnnnnnnnnnnnnnnnnnnnnnnnnnnnnnnnnnnnnnnnnnnnnn

SEQ ID NO: 35432 - DNA, 883 bp, Oryza sativa
  unsure (1)..(883): unsure at all n locations
tgaaaacaaactgctgatatctccttggataagtccgcagaaaaatgcatctgatataattctcattttatatatgtacttttgacagctgcgtgttgctcgtcaagtagaagtgagttgcagttcttgctcttctaagctgtcctgatggagaaacactggcagagcaagatggggtgatactacttttcgatgcagaaaatccaaagcctgtttcttcctggtcagtaaagaaggtatgtttggctgagttgttatactctgaacagtccatagagcacattatatattttctgggactaaattttctggttagtgattgtaggcagtgcgcattgttagctacttattgctttggttctcaagtgaaatgtttatattttgtttctttcctctgcttgtgtcaatctgttgaatgcatcagtggcccattaatgtattacaagaattaatttcacttttcttttgtaggcaaggggaggcagcgttgcttttttgaagggtgattcctctttggatgcaaacagaaaagacaggatagatggagaggcatcatcgctggtttatgtcaacggttctcatgagtatgttatatttgatccccgaagcaatgaagaattgcatattggcaagagtgcacacaaaaatattcaaactgaggagcctggtgagttatggtttgctgcatttattctaatcagcttctgtatacttgtatttttcattgtgttaacctgctcttctctacggctatatttgctggtggcaagattatatagtactccctccgttttaaaatgtttgacaccgttgactttttagttgtnnnnnnnnnnnnnnnnnnnnnnnnnnnnnnnnnnnnnnnnnnnnnnnnnnnnnnnnn

SEQ ID NO: 35433 - DNA, 3374 bp, Oryza sativa
  unsure (1)..(3374): unsure at all n locations
gattgctagtagtcatcctcgtcgtcgtcctcctcaacctcccgcccgccaccgcgttctccccggcgctccggcaccgttaccgcccgccgccacgttctcccggcgctccgccaccacccgcacgccgccgacgcgttctcccccgcacaccgcgccggaaccgtttgagagagagaggaagagtgagagggagaagagagaggaagagaggatggggagatgataggtaggtcccacaatttttttttataaatagagtgctgactgccatgcgtacgccacgtggatcaaaaccactgcgaattgggtcgagggggtaatttgtccgggttgcatggctgggggtgaaaaatacccggctttggggtttaggggggtaattcagacgaccgcgatagttcgagagggtaattcgnactctttcctttattatttattaaattacttaacgttgacactaatacgatgtaaaaaaaattagaaaaaataaaatttataaatagtgagaaaggtacgggtggaaacgatacctcttatacagaaacggagcttgatcgattgggaatttctgtgaccgttttcacccatatacggcccaataaccatttattggttattgggtctgcgggctgcaggcccaattaaatctcgatctcttcgcttaaaccaggttaattagcaggggattaggattgacacgagcgcagcgtggcctaactaaaccgaaccatcaactaaaccacccctggccttttctggtcaacggtcaacgctcagcatgcaaaccccgacctaaacctcgccatggattcgcctacaaaagcttcgcgcggcgcagccaccgagctgcacgacggcggccggcggcgaggagagagaaaccagcagcagttgcgacggcgatgggctgccaccaccaccaccaccagctgcgacgcctcgccgtgctcgccgcggcgctctgcgtcgtcgtcgtcgcgacggcggcgaggccgctgcaggcgaggagacacggcgaggcggtggagatggacgtgtcggcggcggcgccctccggcgatggggcggttcgagaggggaagtggctgccgctgctgccggcgggtggggggctgatgcacttcccggtggtcggcggcgtgtcgatgccgtggatggccggggcgcccgccggcgatggccgggccgggggtgcagctggtgcccccgtacgtcggcgcgacgcggcaggagcagctaagcctgtgggcgtcgctgttcaacccgttccaggtcaggcccaggctgcccgccgccgccgcagagacgacgtcgccggcggtgcccgtggacatcccggccattgccggcgtgtcgccagagaagacgacggtggacgagccggccgccggcgagcccaagtggggcgtcttcttcggcaacaacaactagcctatgatgaatattatgatccattagcttttaagtatagaaatgaattaatcgaccttctttttggattaaagtttagtgagtataattcaagtaatacatatgtaagtctgcatgtttaggtgtcaaacttattacaaaagaaaatatggagagttgtaatatttgtagtgatgaaaacacatgaaaattcttcacttatatcctgtcccaccgtttaaaatatatatatagtcacttgaatatttttgtttttttctcaacactgacaaagatagttggatatatattaatttaacaatgcctagctggataaaaatgatcatcctgaagggatggatgatcattttagttgtccaatgcctttttttttggaggtttcttaagtcataaattttcaggcccatttgtgctatatgggccgggaattccagcccaatttgcttgagatgcacttgattttgtatagccaacctctggccggcctatttagaatttggtagataaatgtaatttagcatttgatactttcgcaagaggaagattaaacattagcctctagtgaaaattgcctaactccatctctgcattaaaccatacaacatactaattatttgctcaatttgtcctccctttcttatccacacaaattgggtactgagactaatctgatagaaaatgaaattgcataattgccaatcatgtgatagctaaaagaaacataagacttgaaccaagtgctcacatgctctaatattgcacagcaataaatgggtagagactcctagatttcagggaaaatgttccaaatttgttaatctccaatgtcttgagtttaatgcagcagcctccaagcttgtcataaacctgatggaaaaggctagctgttggcacctgtatttatgtacgagttaatcaagctaatgatgatgatagaaaaaaatggtggttagctatggatggatgtgagccacaagctcagccatggctgctctctccttacatctgaatgacttctctgcctcacaatctcatggggcagaggagaatggacgatgcaatgcaaaatgcaaggccccagaaggagaataaaatatgtggctagggttccaaggatctgttttgaggccacaagtccaccaaagttttatagtgatgtggatcaaattcaaagcaggttggaggatgagaaattcatagaacccttttttttctctctttggttttggtctttggaatattttttttcttttctttttccaaggagtgtgatggtgactatcaattatccatggctttttggcaaggaaggttcacctttttttcctataaagaggctgtgagaatatgattggatcactgtgtgtattatcatgtgaaagataactggttatagatgtataggtacttgtccaattggaatatgagtgacacttatgggttgtttggagggtttttttttactccttttcctctaagaatttaacctttttatcccatttttgccactaagctgaaaaccaatttcacttttgttagtcagctgtaccagccccagtggcaaaaatagcaacagtgagatatgatcattgcttagtgacaaaaaacataaagccatcccataatgtattattccgattaccccctccgtctcagaatatagcaacctagaaccggatgggatgtatcctagtactacgaatatgggcatgccccctgtctagattcgtagtactatcatatgtcacatccgatcctaaggttgctatattctaggatggaggaagtactaaattttcataattcgattccatgccctctagtatgaaatccgtaaatacatcgaaccggagggtttcattaccaaaagtaaaagggtagcaacttttttattatgaaaagaaaaacagtaacaaagtaacaaaaagggtaccgagctc

SEQ ID NO: 35434 - DNA, 2003 bp, Oryza sativa
agtgagatggacgtgacactaatctggtgctggatttgggcgccatactgactgacagacaggatcgcttggagctcagatctcccaaatcttccgtaaccacgaccctgcacgatgacaagttttcatattcaagtcgatgacttaactctgtgttagagaatatggtagttagagttatattagaataggattgatttatgtggactccttccatatctgtaatcctttcttatctccttctcgtgtactcctatatataccgctccccctgagactcaatacaagtcatcccacattacacagtatatctctcttcatatactatccaacactctgaatttaaattgaatcaaccggtgttataattagtagtcaaacgtgggagagtgtttttattcctcaaggggatatctcattgtttcttacatgtcctgtacatagttagtataaaatattttcaaattttgataagatagattaatacaagatatatcacttcacaaacatagaaattcaaatttaacttctacatgtagtaacaaaaataacaaatataaatacgaatgtacattaattagtttcagtttaattggtttttttacaacttggagcagtcaagtttgaacttgcagatttgtatataatatatctcatattaatatatcttatcattttttaagtgttttatgactatcttaggtgttatggtgttatgtaagaaacgagggatgtccttcgagggatgaaaaatctatctccgtcaaaggtggtaattattcagaatgctttcgtaagttcagagtttttgcagttaatttaaatcttgtgtgagatgaaccggaggagattaattgtgatgctatgttggcaaggcaagttggggggtgtataatgctatgttgataaccattccctgtcggtctccggcgagtcctcttcttgcctggccatgccctgccctgcattctttctttctccaccaggggaatccagttcacccccagtgctgcttctgctgctgcttctgcatcatcttgccctgttaaaaagacacagtgcctttgttctttcgcagttgcaactagcatctcctcctctacttgtactcacttcacacctcagctcagctcagctcatctcctgtcatctcagctcaaagagaaagagctgaaggtgtaagctgatcaccaggaagcagaggctttttttcagattacagttatctgaaacaaccaacttcagaatcaatcagcaaaggtagagggagtttcttgtttcttttgtgtactactacatgactatatccatatctcctttttcttctacttctttttcttttgtttggttgtgagtgttgttgctgtgtgtttcaacaagtcaactggatagatagattcatagatatgatagtttttatctgaggttggaggtttcccctctcatccaccacacacattttggcaccccaatcctgaatttactgttcaattctcttctttttattcttcctctgttgattgatcatccatgcatgcatactggtatatagtactagtgctcaagtgctcatccttcctgatggtgaatctcttttgagaaaagaaaagaaaaagatctctctcatcttggctttttttcctgttgatctgagcactgctcttctccaggttgtttcattctgcaggtctacagcttttgtcatcaaagtggtagggtttgtactttgtagtagattgcagtgatggcccttctctgcttttttttcattctctgtttgttcttgttgctcttattctgtttcattctactttttttaaacaaatccatccttagagttcagttttcccttaaaatttttccaaacctacaaattttgttctctgtgaattcatttttgcatgattcttgcagaatctgaaatgatcattggctttgcaggtagaaacaagacagagctgctgtgcttctgtgattaattagggttgttaatgccatgaacc

SEQ ID NO: 35435 - DNA, 2064 bp, Oryza sativa
gccctccgtcgccgtcgccagccaacgccgccaccgcgacagcctcgtcgccgtcaccagccgccgtgaccgccagcagccaccggacgccaagcactaggagctcccgctccagatccgcccacgggggggctggatccgcctccggcgtgcctggatccgcccacgagggggcccgacctacctccggcgcgcctggatccagtccgccgtcgccagcctcgccgccatctccatccccgccgccatcttcatccccgtcgccgacggcccatctccgacgccgtcgtcacccccgccgccgtcaccttccccgccgccagccgccaccccgccagatccggccggagcggcgtggatctggcgggctccaccgccgccgccttcagtcgctcgagaaccgccggtgccccagcgtgctccttgagagaggaaaaggaggccccgccgccaccgtccttgccgccgcgcggctttgccggcggctgctctggcggcggcgaggcgggagggaggaggaggaagctggctcgcggcacgtggtgtcgccgcccgtgtcgcctggggcgagcgacgcgggcggagttgtctcaacttatggaccaaggaattaattgtagggatcgaaatattaagtgatgtcctaatcgagtttgatatgaggataaagacaggagcagaccaagaagatgatcgacagctgattgatggtgtattagtcattggttgtgagacaccaacagatgtaacattgagaaaacgcatccatggcgattgcggtgcggtcgagataaaattttcacatctgcatcatgcagtggaggcgacggtacaggttgccgtattgaaagtgcagagtcatttcaatctgtctatctgttcttatgtgggttcgttacctgacgaaatgcagctattttgtggccacatagccgagccatgtggcctaaagaagtttgttcttgctgcaatgatgcgtaatttgctgcgattgaagttgaaggtaagccaagaagggtcttacgctgaacatttttgctcgttcgaaccaaatcaccatgggcattcatgtcagcagataaatactgagtttgcatccttcctggtgaagattacttggtcgactttggactttggaaatccacagaattatctgtaattcacaaccgaggctacggtaataagttagtgtattcaattatttttctcattgagttaattaagatgaggcctttctgagtatgactcaaatttaaaaaggatcctaatgtcactaattctttctaattcttcctaaacatgaggcatttttttagcctgcgagaaggtcaatataataatatgtttcgcatgtcacgagtcccttcttgttttttatatagttggaacccactgcaagcatgacatcactcgcctgttagctcgtgacatcactgagccaaccgtgaaataaagatggtaacatgaagaatttttaaaaaaggaatgtgaacgaggcctaagatgtaagatagcccacctccttacgggctcccagcctcctgcagtcctgcttctctcctggcccagtcctgcttctctcctggccctcctctatgaagtaagaagtaataagttcactttacatttctcaactatgagtcaaattctatttgcatcccttacccatgaaatcgggtataaaacgtcatctaattatcaaaaccagtgcaaatagagtcccttagcggtttagatggcaattttatcctacagttacccacgtggcatgttggcatgatctttattcctatgtggcgcttgcgcttatttgggattagaaaaaaaatagaaaaataaaaaaaaactcaatggacccatatgtcattaggaaaacaaagactcaaatgtggccccacctctccctctcctctgttcctctctctctctcacttagcgctggggtgcggttcaactgaggacggcatggcgccgacacagctcgtcgcacaacctcgcgcgcagaagccgatggcccgaacggcgattgggaggcccgcggtggccgatgctgcctccttcccg

SEQ ID NO: 35436 - DNA, 2437 bp, Oryza sativa
  unsure (1)..(2437): unsure at all n locations
nnnnnnnnnnnnnnnnnnnnnnnnnnnnnnnnnnnnnnnnnnnnnnnnnnnnnnnnnnnnnnnnnnnnnnnnnnttaacttgttcacgtacaggatcctagcatgtccctaattatatgggtttaacttattaacgtacgaactctcaatatataatagtgaacgagtgataggaagttaggaacacatatatcatttgcattacttttgacatgatccgaaatctaaggccaacaaattatggcacgcataattttctaaatcactattgtcggagaaaactgcaactttacaagttaaactgtcttccaatactcttcatcatgcatgatctcatcatgcactggaaaatactcaatttttcaccaaatattcagtgctgactggagtactggacacgcatatatagacctctgaattgtatcctggaccttgaatgaccatcagactttactagtactcgataggaacatcagaactaatatttcagcagtaatcaactgactctgtccaggctggtaacatcagaactaataattcagcagtaagcaattgactctatccaagctgatagtacatcatactcctatctaactaaacagcagacagaatctaggtacaacacttgtatggagtggagatctaatctttttataaaaaaaatgaggagaattttttttaaaaaaaaaatgtgcttctagcttccaacatgctgagttgctgactctgtgacgccaatattttttttgagaacaatgtgacgccaattcagagaggccatgttcagtccttgtcacaaaacatatggtcaactcaggcaaaacgcggcagagaccttttgtcacagtaattcgcacataaaaaatgaaagtatacaagataaatgcagagttgacagagtcacaggccacactcctacaccacaaaggcttccagaccaagaaaccttcctctcaatttactgaaaaaaatcaggggcaatttgtgcttctgatactcacgtatatttcatacacacgtgaatgcttttaatagaattcagagaattagagaatagaaagttgtcgttgactccatctctttaacatattttaggagcatgcttatagattcacacaagtatgaacacatatagtgatttgtatatgcgttctccacatgattcagaaaaaaaaaagaacaatgacaacttgatttcattgaatttattgtggcgcatttacagatatatagtgatggaagcagtttggtgcaagacaaaagtaggcaggcgaagttacatcatgtacacttttgacttggtcaaacgcaaattatatactgacagtgacaggacctaattacagcagtatagtattaattaattgttaaaagagagtttctaatcaattctacttgcaattctccaagaagatagcctttgccatcatctattgctctgatttagaattatatgtgaaaagagtctctctctattaggggagcgagaggagatgtctactcatatatttttcttccaaattcgattcaaatagttgtaaaaaattatagaaaaaaattgataatattgagtattgttatacctatctgtgcaaaaaaaaaatcaagttcaatgctgtatcagcgttgtcaattttttttagaatttttcataatcgtttcaatgctttttaaataaacaaggaaatatcatctcttgaggataacacacaattagattagacatgcttggactgatgacttagtcaaaagagaagtccgatcacttattaatttcttgtgcatgtgcatccaacaaccttcgtcagctagccaagaacaataagcaacttcatagtgtcctagcaacggcgtcaccggccatggcttccggccatctcgtcgccgtcgccgtcgtcatcggctcgctctgcgtcgcggcagtcggtcaggggaacaatatcgtgctcccgttcgcgccgtcgtgctcgaccgccggcaactacaccggcgacagccagtacaagaagaacctcgaccagctattcaccaccctctccgccggcgccatcgccggcgactggttcaacaccagctcggtcgggacgggcgccgaccaggtgttcggcctcatcatgtgctacgccgaccgcaactcgacgcagtgccaggaatgcctcgccggcgctccggccgggatcgtgcaggtgtgcccgggaagccgaacggcggacgccaactacgacgcctgcctcctccgctactccgacaagtccttcttctccgagctcacctacggcgccgaccccaccatcgcctggaacgtctacttcacccccttcgtcgacaacatgaccaccatgaacgacacgcggcggcggctgatgagccagctcgccgagagggccggcgacaccaagctcaggctggacaacggcagcttgccgtacgccgactc

SEQ ID NO: 35437 - DNA, 6986 bp, Oryza sativa
tatagggcgaattcgagctcggtacccgagatcgcctgcggccggcgaccgataatggcggaccaccaatccgaggtagacgaagaccggatccacattgctcagtgggtctgggatttatacggcaatgggaggattcttgacgccactgaccggcggctcaacggcgagttcgacggcggggagatggaggctgtcatggtcgtcgggctctggtgcgcgcaccctgaccggagcctgcggccaacgatcaggcaggccgtcggcgtgctgaggggcgaggcgccgccgccgagcctcccggcgaggatgccggtggcgacgttcctgccgccggttgatgctttcaaccacacatcatcttcagttgcgacaggaagcagcagcgccagcacagacactactcggtcgtccaggacgaccgagacatcttccttgctgaaatgacacttgagcaatgacgttttttatcagattaattaactgcaaaaatgaattgattttgacaggagcatcatacctgtttttgactagagtatgcagctgattttggactggtaatatgatgaacattagttacataacacaagaacacaatggcacaaacataaaagggatacagctattgacactttcagcataataattagtgttctcatttattattgccccaagccatcatataaaagggacttcagaaaggtagatcaacagctcataataattcacagtgtatgtctattttcaaaaccatttacaacgaaaaggccggtctaatggcgtcccttccccccaacctacgcccagccgacctctccaatctcctttgctttcttccttccattggaccattcacggtacaggggaagtataatcaagagttctccaatagattgtaactggtactaattaagcagcagtggcaactggagtgtcaggatgggctccccattcagtccatgatccatcatatacaggaacgtcggttttgccaaggcggtggaggccctaagaagaaagcataggttatgcgacgtaatgtaacaattgcaaagtaaatcttgtgaacttccaagtcacaggtagtcttaccagagctaatatacatgctgtcacaccagtaccacatgaggacaccaggggttgatcaagcgatatacctgacgaatatcacaacaaagtagtaaagttattgccaatattaccaaagatgttgccataattttatatttcataattcatacttgctaccacagatctacatcaaaataccacagaaaaatgatgctagtaacaaccactaccaataaacaaagcactgcaagaagtcatgcctggtcattacaatcatataagcgacaacacctggcactagttggttaattaactcaaccatcaacttatacaaaaatataaataagaggctcttaatgtttcaaaagacccagaaggccaaaacattaggttcatggttaagatataggcatgtttcagaatggggaataggattgcaaacatggctaagcagggcattgtcagcagacagaaagaatttgaaactttatctggataaaaatattaccttcttgttcaaatcgtttacggagctcttctggaggtaatagcttttgcgaactgtcaagcaactgcagaagaacaaacaaagattcagcaaaaagaattggtaatacacaaagattaaaaatacaaaaatatggtcacaaatgaacccgaataaataattaatccaatgagaccaaagacaaccaaagatcaggtaaaagtaattatccaaaatttatgtccaaaagagtacaagttgattggataattgcaagtctccacctgagggaaaggaacacatttgctcccaggcacatgcccacttcttattcctttccgtggctctggaactgcaccatcaaatctgaagtgaaagcttcatgttagtattcaagaccaatgaccaacattacaaagacacaacccaatgaagcttgaagcattcacatttttatgaggtaatatggcaaatctaccgcaattactgacacaaaaaaaaacaagtcagaagagtcgaaaagataaaacaccataagagtctggaatgcctactatgttggtgaggtgttacatggaatcatggttgaactggaaaaagattacttaaaaaggcaaaagccaaacagccgactttattggcaatgaagatcttgacagatactagtgagtctatggatatattatccaaatcaatgtactaggcctagggaggaacatggtctgtagccagtgacgacagggtctgctgccgtgtagaatttagttcattacttgaatatcgaatgattcctgcaaaattttgccattgtctccaaaattggaagtgccttttataaaatccaccataacccaatggatccttaagcataaaggtaaaggctttatatacatgtaatcgtgtatggtatataatctggacttttccagaattaaaatagcagatttacctaggctttcctcgagcatctataagttgatgtgtcttggcatcaatgttctcttttacctgagaaaaaaaatcatgaactagttataccaaacatgcgactgagtttaataaatggtgaagaaatgtatgggcaagattttcagcctgaagacctctaacctggtcaagattccaaataagatgaggctgcaactttgcttcaaatgtggagggaccaacctacaaagataataaaaagttatgtgtgactgaaggtcaagctaagcaccattcacagcagctactagcatgagtatcacgattcaggggttgacaagtacataacaggagtaaggtccaaatgttagaacaaacaaaatagaggtttaattcaacttaccaactgcccctgataaactttctcaattgcttcacgagcagcactggcttttaagatggcatcactagaggcacttgattcaacatcatacccagaagcacgccattggggcaaaccaccatccaacacccaaactttatcatgtccgaaaacacgaaacatcctgatatcaaggaagcaggcatcgcacatgaaatttaattcaattatcaaaattaacaacaaaggaacatattgcaaatgcactagtaagaacggcttatgatcatttaaggggaaaaaagattgtctgtcgtttctgcctgaattctactcttgatgtttactttggtttcaagaagaagcagcttaccaccaaacacgagcagcgctaaatagtccctttccatcataaactactatcccatctttgttgtatattccaagcgaagatacagcagcagaaaatgccttttcagatggcagcatgtgcggcaactgactcaaaagataatacattcaatgatatcaagcatgccgaaaaacaattaatcagctcaacaataaccaacacaaagaaatcaagaatgatgccatgttttgcaattcatattcctatcataataagggcattatgttgaattgttgatctacttaaccaaacaggattaaaaaaacatgttaatttattagtgttacttttttatcatgaagattgacagtagtagatgaaaaatacagtcaaggagaaagggaaagaaaatttaagtgccattacaccagctagtacaatataaaagcttgacgtgatctgaaagaaatcaaacttgagtaacttattatcactttttttacaccaatcaggggattgggacagaccaccagatcacaacacacacaaatgttatcaaccgtgttgtgatctgtcagtccctgttttacttcaccagcttcaaccttttaccttctggtgttgcctaaagctatttttgttgacctgtatgagtggaacttaaatgtattgacatactgaactaaatgctttcgcttcatgtatttaaggaattgggtttaccagcccctaaatttgcatagcacaagcccatattctggcaatttataatgttatattaataaaaaataacatcagaaaagcaggatgatgtggcacataaagaaagttcatatgattagctagtagtaaatgaaaaaacaagctagtgagttgaacttacgcttgatgttctgtctgatattccatcaacatcaaagaatagcgccccaggaatatgagccacctggaaacaagattaaaatgcatatgaaagcatcagaacttctgctactataatttcaaatgaactgataaaaacagaaaattaaggtaacaaggaaccagtgaaaataagagcatataaacaatcagataagaaaaatggcgtcacagcaggtggtaagaattccaaaactgcaaaacctcagtatggcatgtaatcgctacctggtactcctgaagaggattcctttgttcggcaggcatataccaagaggcatcaagtaccttgacagaaacaagaggatgattcaatgagatatagtggattcaaggaagacaaacatttttaacagggaaaagaaaactatccagtgactactgttatagtgttattattatactagactcatttatcctactgagagtatatcataatgcatatgaaaaagaactttaatacaaatgcagcttctgttgtaaaagcgaaagtagccaatggaaagccagtgccatcctgaatgtgctgtagtctgtagtacaaagacctcatgcttttcctcaaccatcaatccgcacagctaacgcgacaaactcagcaataataagtcactagccatcctcctacgatttatatctctcttccatcatcaatcaaactgccagcatggtagaacgccagcaactagcaattcactatcagtttattagctgtagcacggtatatgcaacaattcacaaaaattatcttccagtttattagttgtagcacagtatatgcaacaatttcacaggtcaaccgcagatcgctacagtcccatcactgcgcacactaccttacatcggggtccttgaggttggcgtgcagccactcggccgaaaccacgggctccgtcctcggcagcgcgttggtagcctccgaaacggccgacgacgaggtggcgttgcagcgcgccgcgatcccgaacgaaccgacgccccccagcgccgccggcaccgacgccctgcacccgaacccggcgccctcctcggcggcgcgcgcccatccgactcttcccccctgcacccgcacaaaacacacaaaccaccgtcaggccggagagatcagggagaaggcggagcggcgtcggagtacgaccgcgaggagcgaggcgatggtggtggcgaggaggatgaggaggggaggaggaaggagggtttccttggggagggaggaggacagtatgtggtgcgagcgggcgccgcggagggagacggcggcggcggcagcggcccgggagaggagggtggccgccatggatagggttttggggggttctagaaggttcgcgaaggggttggtggcggaagcgagaggaagaaggggaagaggtggatgggttggtactacttcgttgctcgacgagtgtttattaatccgcggggaaaggaaccaactggtttcgcgggaatccgcggcgcctacggttgggcagaagagccagtgtagcttcgcaggcctctcctgaaacgcacaaagtttatctagaaaatcagcagtgagtattcctgtaaaggctttttttttttcgagatgtaaaggtagaaaagtgtaaaaactaaattttttatcgtatcaaatctcgttgagattcatagcaaattattttttaatgatactagcaaaataaactaaaaatatttgtttttaaccgaagttattttcacactacttttgctcgctagaaaaagtcttaaatgatagagagaaatgtagtagctcataataaattattattcaagaataatttcaaaaaaaggagataaaaaagacaaagccggtttgatttccaactttacacggtgcgagtcaatatggactctgaagatataggcagatctacgaggtggcttagcaacacgatcgacctgtgaatcagcaagcaacctcagaccaatcgatggtcgattgacgaccgcagctgcgtctggccgtccgtttcccttccgcgacagtggtgaccatgactatgtgatgttattattttagtatttcttacttttaattctggatttttgttatttctaattatatttttatgtgaactctaaacttatttttcaatattctttattttttaattcagaattttagttatgtataagttataattctatatggattctagactcttttttcaatatattttttaaaattttaaaatttatttatttataaattgtatttctatatggactctaatctctacctttaatttttcttattttttaattctggattttaattagctctaaattgtatacctctagtttcatgcttgttaatgaaccatcaatttatagcatgtggattttgagcgacaactatactatatgttggtttttaagaaaccggtacctataatatagtgtcggttcttataaaaaaacaacaaaaaaaaccgtgctgagccaagccgaggcaacatccttatccagtccccctcccactctctctcgctctcctctagtcctctcactctctcactctcactctctctttcttggtcctcgatccgcggcggcggcggctccatccgccgcctctcttttccctcccgcggcggtggtggcgtcaacggcaggcggatctggcggcaggtgttcttggatgtgatgtgatgtatgttgttgttcttggatgattattttatgattttgtgatgattgtggttgatttttgggggtaaagagtggttgaattttattttttttatccgattctaagagcgattgggattcgggggagctgcaaaggtggccttcgtccatcttgtgacgaatggaaaattaccaatctttta

SEQ ID NO: 35438 - DNA, 2208 bp, Oryza sativa
ctccttcctcccctgctttgagctcttggacacccttttaatggcgacgtcaaggttcaactctttcaagaatcctctgtacactgatccgaacccgccttccccgagcttgtgctcgtcggagaagtcgtcggtggcgatggcgagctcgccaaagcggaatctcttcggccctgtccccttctcgaagtcgtcttccatggccgtctcatcatcgaagatgcccccctcttccatctcctgctccttcgtcaacccagcatgcttccgccgccggcgcaagacaaaccggactgagaaaccaagaaccaccaagaacgagatagcgctgacagtcaggcctgccacaagccccgctgacactgagggaggaggtactggcgtcgccggaatcggcggcggcggcgacgacgacaatggtgacggcgccggcggcagagtgatgttgaatggccaaaggtcgaacctcaggtagcagctgtaccccttaatgttgccagcgctttggttggtgtagtactggccgaggtcgtcaacgtacctcttcaggcacttctggcactcgctcccgctaggtccctcgtgcactgcgccagcccgtacaaccgcgacgtgccgagcttcgagtcgacgtacggcatgctgtcgttgaacagtctcagcttgttgtcaccggccctgtccgcgagtttgttcatcagctcccgcctcgtgtcgttcatggccgtcatgttctcgacgtaaagcccgttgaacgtgtaggtggagcgattgacttcgaccttgccgtaggtgagctcggagaaaaaggacgcatcggagtagcggaggaggcaggcgtcgtagttggccttgaccgtccggcttccggggcacacctgcttgatcccggcgggcgctccggcgaggcatttcttgcactccgtcgcgttgtagtcggcgtggcacatgataaggccgaatacctggtaggcagtacccgtcccgaccgagctggtgttaaaccaaccatcgtcggtggcggccgtggcgagcgtggagaggagctggtcgaggttcttctcgaactggttgcccacggtgtagttgccggtggtcgagcagtctggccagagcggctcttcgtagttgctccgagcaactgccgccgaggcaaccacggcgaggaggaagaggatgatgacaaggcgaggagccatagctggcgacgccttgaatttgctaggaacatgaatgctttggtcccaatttatcttggatgacaattgaagggacggggttcatgtgcagttttttcaaagagaactagtgttcgattacgcgttggatcatatagtatacactactggttggccacttggccagatcactgtttggtgtttgcaccgtatatatgtaccgtgaccgagtctgtctcgcggttaactaaaaggggtcgttagctgattggaatgaatgggtctatctctctagtaaggggtaatttttttggacaccattggcgataatgcataggaaccagtcagctttgcaattgcatagtaaggattacgtacgaaaatgattcggtccaccgcaaaagaaaaaaagaagaagaagaagacgactcggtccgtgcgcccgatccaacgaaaagtaatcggctgtgtttccactgctggagtgctggtactgctccctgtcacagccgaagatgtgtagccgaaagcatcaatcggcgctaggaacgttccctactaccgaacacgcttttcgcatacagttgagcggactgcatgaaagaaacggaaaggctaaaaaactgtcgacacatttttctctagaaatatgtcgatttctgatccattagatcaactgtaggattcgggctattttggttgacgaaaataaaattgtactgtaaagaatcgaactaggatctccagtggcttgtccagcggccctgaccaactgatcgagcaaagattttggcttgaattaaaattacatactaattacacttaaattgcatattatttacatatgtaatttagagacttacattgtaaatacactaaaattacatatgtaatttatagacttacatatgtaattttagcacttacattgtaaatatactaagattacatatgtaatttatgaacttacaatgtatgtacataccgactattttttttgtgaaaaatatggcgctataaatatagctgc

SEQ ID NO: 35439 - DNA, 2893 bp, Oryza sativa
  unsure (1)..(2893): unsure at all n locations
ctatgggcgaattcgagctcggtaccctattttttttgtgaaaaatatggcgctataaatatagctgcacccgaaagaaaatgtctacgaaaatcatgattttcacgtgcggctagcgcaaccgttgtgaaaacgaaaaatcacgaaaaaagataaaaattccaaaaatcaaaaaataaactgccgccacgtacggctcgctacggttgtctatcctcagcgtgttgtcaccggccctctccgctagcttgttcagaaactgccatcgcgtgttgttcatggtggtcacgttctggacgacgatttggtcaccggctaattttgtgtagctgatgttggtgctggcgtcgtaggcggagaaaaaaggcttgtcggagtagcggaggaggcaggcgtcgttgctggcggtcaccgcccggcttccggggcactcctgtctgaccccagcgggcgcccgggcaaggcattccttacacctcgtcgcatcgccggcgtcggcgtagcacatgatgaggccgaacgcctggtcgggacccgtcccgaccgagctggtgttgaaccagtcgccggcgatggcgccggcagagaggctggagaggagctggttgaggttcttctcgaactggctgcccctggtatagttaccggtggtcgagcagtctgtcctgaaccactgatctactatctcgttgctctgagcaactgccgccgaggcaaccatggcgaggaggaggaggatgacaagccgcgatcagaaagtattttctacacctaggtaccatggcacctaggtgtatgcatataatttaaataattatataaaaaatacataaaatttaataagatagtccatgataatataagacactatgcaaatatgtaagtctaaattcgatcgatatatgaagaaacaaaaataacaaattttatcggcactgtacgggtactattgactgtctgattttattatttttgtttctctagttgtagattaaatttagtcatgcatgtttgtatatagacttgtatcatcacaaacgatgttactaattttttttaattttttctataactatttgagtcgtatgcaaatgatacaagtcacgatgccatgcccatgaccggctagctggcgacgctcttgatttgctatgaacatgaaggggttgatcccaattagtcgtggattacaattgaagggatggagtgcatatgtatgcatgtttttttttaagacaactagtagcggtcaagcaccagttctcgatgatacgcgctggaccatgtctagttggacacttggcaagatactcctaattatttggtgtgtgtatcgtaccgtaccgtgaccgagtgggtgtgttcggatgccccttttctcatcccctcatcatcgctttccacgtgcacgctttttaaactgttaaatggtatgttttttaaaaaagtttttatacgaaagttgcttaaaaaaatcaaattaatctattttttaaaaaaattagctaatatttaattaatcacgcgctaatggactactctgtttgccgtgcgttaccgttccagctgggatatggagatcacctgtgttcgttacttctggataggagcgaatccctccagcacgaaaaatggggtgatccattaacacgtgattaattaagtattagcaaattattttttaaaaaatggatcaatataattttttaagcaattttcgtatagaaactttttataaaaaacacaccgtttagtagtttaaaaagcgtgcttatgaaatacaagagagagaggttaggaacctgggttgccgaacacatgaggtcgttacgtgattggaatgaatgggtctctctctctctggtggtaatttttttggacgccattggtaatattgcataggaaccagccagcttgcaattgcacgcctggctggatgagtcagtacttgaggattattgggctgtcccatcctatagatcgaataaagtgggtgaagtacggatattttgctgttttcgcatgccacggccttcctcattctctctcaactcactgtagtcaccgccctaagggcatccataatatacatctaaagtggatagtaaggaataaaataccactactacccggttgtatacattgtgagagcagtaagtagctaatactaagtaatatgcttactacctagtaataaggaataaacaaatgatttctctcatttttctctcatggctaatgattgtggggtccagcttactacccatttttgttctttcaccattgtggctacaacaacaactaatacccactgacacagggctcacccttattcacaaagtagggagtaaacattggtgatgccttaaccaacgagaccgtaacagtgagcatattggacttggaccaagatcagccccaaataattttaggccttcttcttttctagacacttttctaataagttatcgtgatatgctttttttttttaggaaaggcattgcgcccagctttcactagaaagcgtaagagttcattacaaaagctaaaagaaaacgaaagcaatatcatgctggggattccagctgactatgaaaggtcctgagcacgcaggggcattcaaaagccgctggcacaggcacaaccagccagagagaaaacactactgcaaacagagaactaatcagtgatcgaaggactgcagcgaagatctcctgtctcgtggaagctggcaagcaacaagccccttagcgtatccaagtctcccctcattttcaccggcgccaaacgtctccactgtaccagaaaagacacaatcttataagataatannnnnnnnnnnnnnnnnnnnnnnnnnnnnnnnnnnnnnnnnnnnnnnnnnnnnnnnnnnnnn

SEQ ID NO: 35440 - DNA, 724 bp, Oryza sativa
  unsure (1)..(724): unsure at all n locations
ccnnnnnnnnnnnnnnnnnnnnnnnnnnnnnnnnnnnnnnnnnnnnnnnnnnnctgcagaagttatcgagatgctaagctaaagcgttctggatgccttgctgtattgtctgtgaactctgtggctttagacctccaccaaactaggcacaactcactgaagaactctcaggaggtatgtttatgaatgatgctctatcttttgctgcagcaaaacaacggtctatgtggcctcttcctttctttcttggttctacttatctgcagtgtttaaacttagctttatgtttcaataacattgcaagattgtaagctggaatgttagaggtctgaatgcaccagcaaaaagggaggcggtcagaaatctccttcaacagcagaatgcaactctggtttgcctgcaagagacaaagctgcaagatgtaaataaggcctgcataattgaaacaaatggagtaaattttcagaacaatttctttttcctgcctgcagagggatctaggggtggtataatcctggcagctgatgagaactattttaccttgtcacattgtgatctccgtatgttttccctaacagccaaggtgactatgaaagaaacaaatgcctactggacaataacaggggcttatggtccatagaaagatgctgccaaacttctcttccttcaagaattacaggatgtggctccaacaaccctaccttcatggttaatcttggagatt

SEQ ID NO: 35441 - DNA, 198 bp, Oryza sativa
  unsure (1)..(198): unsure at all n locations
tcagcataacagatttcaggccaatatccttgctacacagtctgccaaagcttatcagcaaagtgctagcaaaccgggttcaaggggaaattcatgagttaattgatccaatgcaatctgcattcatcaacggaagatcaatcacggnnnnnnnnnnnnnnnnnnnnnnnnnnnnnnnnnnnnnnnnnnnnnnnnnnn

SEQ ID NO: 35442 - DNA, 3897 bp, Oryza sativa
  unsure (1)..(3897): unsure at all n locations
nnnnnnnnnnnnnnnnnnnnnnnnnnnnnnnnnnnnnnnnnnnnnnnnnnnnnnnnnaccggcttggcgcagagaagcgcagccgatggcaacggaggccggctcggcgcgagagacgcgggcggcagagatggaggccggcttggcgcgggaggcgcggccgatggagggaggccggattggcgcgagagacgcgtccggtagaggaggccggcttggcgcagagtggcgcggccggcagtggaggaggcgacctaggtgtgaggaggagctgctggtgggtgtggcgcggtcttcggcgcgcgaaggctggccggcgggggacgccggtgtaggggtcccacatgtcggcaaagcttgtgtggtggtggagcatcggtgcgtcagccgtggattcgcaggtggtgagtggcgggtgaaaacccagttcgaccttggtcggaccgacaacgatggttatcccccctcctgagggcgttgttgtgctgtctcacccctcaggcgatctcgtctgtgtccctttgttggtctagtggcggtcggtcacgcttagcggcggccggtccggtgttagccttctcctgggctagtgtgttggcgatgtcgccgtgtgggtggtggtattttttttcctttttcctggttataaccctccagggttgtaatcttgtaattttttcctgctctatcaatagaagttcgcaccgtctcgtgcgagtcgttaaaaaaaatatttcgatccctcgtttaggaccagatatttcgatgagggaaccctacagaaatattattatttattagctcatcaaagaaaataggacaacgaaatgggtcgttatgttatttttactatatatatatatatatatatattatataaagctgagtgaaaagtgaaacgaacattacacaaataataaagaacctagtatattaaacacatcaaacattgaatggctgccaagtgtataagattgacagagatagcaaaactaccagatagaataattcaattttatctagagttgtcaaatattaaattatggatgtttgtggacttattatgagtgaaaaaaatgatagtttgtgttgtgtatcttctattcctacaaattaatgaaaaaaatgtattatctgatagctactaaaggtccaaactattctgtttgattttctttgtaacacataaaacgtcatgcttaatttaattatataggtttatttgatagtataattaccacaaccaaaatcttggttagcattgtaatggcttacacaatcaactgtttctattctgctacttttgggtacgttgaccactttgaagcatgtttttgcagccataacaccgaaatattactataatagaaatattcacaaaaagtaaatatctaagcatttgtttctagccgaatgaggccacggacatttacctaattagaaaaatatagagttatgaaataggggataactggagatagcttttcatggccgtgctcccaaaaccacaataagttgtgctatgaagtaaaacactttataaatgtcacagcaacataaactaaccatatgtcttaaaatcaagaaaattgtgagtgcaaattgagcctatgtctaaacatcatgagcacagttattacaacatttccgttgattggatgatgtagaacagattaacttgcttttagaataccatcaaaattatctcctcttgttgtatgcatgtgatgatgacttcatattatgaaataaaacaaagtaatttaaaaaaaatgcagagtagggatgtgcaccttctccactatgatgggatcatccctgctagtatggaatatatagttgcgcaatggatccaaaaggtcccgtgctgctaagtatccatacagctctactgggccaccggtgacagcaatttcagccagttttagtgagaaaaagtgcaacataggacatggtccatgccttatacatgtttcaccatgcataacgcaatatttaggacctgataatatcatcgcctccaatcgagcttccccaatgatcacatgtcatattacaatcaatgcaacaattaatacggtcagcaaatacttggtacaaagaaagaaaactatacttttgcacatcaattgggttgcagaaaatcctgggtcaaaccgctttatattttttgagtaattctataaaaagaactacacatatttttgtcaaaattatcagtttgttgcaattttagttaggggtttcagaatactgcaacttgagcccaaacctgtaggtatttacagtagcaaatataatgattgatttatagcttgataaaatttgtaagaccaaaatagattttttttaaagaaaaacagtaaggatatctggatcacttactctcctcaagatctgcaatacgataagtccttttccactcgctattgcccttgtatatagaaccatcacggtgactgctatcttccaatataaacgcagtatttgcaattttagggggattgtaagaggagtcatcttcgctatcagatgacatccctgcctcttcttcactatccgatgcatcttcatcgctactggttgccatctcgggatattctatggtcttgtcgtgttcttcgctatctgttgtggtccttacattttctttacaatcacccaaatggtctttagttgccccatcatttttttcatcatctgtgggacgatcaacaccataacgatcatgatgactgctaatgcccatcttctgagatccaaaaaaaaaatctatcatcaaagggcatatttaaaagggctcgtcttagcatccatccatcacggttgaatcgtaattgtaatattgtccagtgactccagtctgaaatctatttttatatttcgttccaaaaaaaaagatgatcagaagaacttcaatttcaacaaacatcttaccttgttacacctccaaaaatcgatagaactgccagtcttctccaccatatagagaattaaaaagaaaagagaattggttacaatccagaactctaagactgtagctaaaggatatgctccctctgtaacaagtcaaacatttttaactttgactattaatagcaaaaaaaagatcaatcacgtaaaattgatgttactagatttatcgctgaacaaactatcataatatacaatttttttatttaaactattttaattttatagatattattggtcaaagtaacatctcgaagaccgtgtcggagtccaaaaatgtttatattttggaacggaggtagtattaactaacatgagaaggagaaaacacacacctgaggataggatggacaaatcgatcttgatcgggatcggtagaggacaatgctgctgccgtcagaagaatcgagcaaacattcagttggagatcagtctcaccggcggcggcgacggcggcggccgggggatctgccgatcttgggctcaaaattggctgcacttgcatggatcgatccaatctgcgtgattacctagtccgagggttggaaatttcggtaattttggtgaccctgatacgatattaattcggccgaaatttttgaatttttgaattttttcacaaatttggataatatttgttcaaattcaactaaatttctttgaaattttgggatttcggtgacccctgatagaaaaccctgaaccgatatagtgaacctctccgattggtatagcacggtacagttagttactgactcggaatcatgactaaccaaccttaacctcttcatgtcatatcttacgttgccacgcactaagccgtcaagcttgctagcccaagccgcgcgcgctttgcgtgatggacctatcgaccggcgccggctggtcgccggtgagctggtcggacatggtgttcgacctcct

SEQ ID NO: 35443 - DNA, 3506 bp, Oryza sativa
  unsure (1)..(3506): unsure at all n locations
atatatataggacttatgaaatgacttagttaactgatttatcattttaaaaatgattgcaagactccaattaaaatcatggaacaaactgtttaaattggcaaattatgatctataggttctcattctctcttctagctaatcgctataacatgtatgatgtcgagttagtgatcatacatcaacgctacaatgtcactgttcaccgaaccttaagtgagttaccacgtctcgtagatggcaccccccgtctctaaatcctggcttcgccactgatcggacagcggcggcggcggcggctgcatcgttgtcctgctccaccggccaaagtaccagctctcgttcgcgcgggtgggcgtcgacgagcgctgggcttgggtcaacctgcccgactcggacttctacaccgacgtcgtctacaacgacgacgacggcatgttctacgctatcacgtacctggccgccatccacgcctacgacttctccggcgggccctccgccgtgcgccagacgatcgtcctagccgaccagttacacggcgtcatcgacagcgagaccaagtacctggtccgcgcccccgacggcgacgggtggcttcaggtgtggaggatgatgaagcccgtgcgcgcggccgcggcgcacgacgccggcggcgacacgacgcggacgacggcagtgtataggaagacgacgatctggatcaaggtgttccgcgtggacctcgccgcgcagaggctggaggagacggcgacgctgggcgacggcagcgacagcctcgcgctgttcatcgggtgcaacagccgttctgggtgccggccggtggcggcgacggcgagtgcccggcgggcggtgtgctgcccaaccacatctactacacggacaacgaggaggactacgcgctgctcttcccggagtcgcccagagacatcggcgtctacagcgtcgcagacggcagcttctcgccgttccggccaactcaaccatggctgacttggccattgccgacttggcttgttcccaatttcgaatactaccatcagtgttaagttaattaacacagagcagctaatttgtttgtttgattgattgattaatgttgcgtttcattgtttaaagctaggttttcttctctgatgtttttgttgttctataattctatttattgttcaatccacaatcgggctgaacgcgtagactaaaattaacagtttttttttcataaattttgtgctgatatgattagactttttttttacctgtatggatttgaccaatttagctacattttttaaagctagaatatttcttttaagggtccatgccattgaaaatgtggctattcagaaaaatgttattacaattcgtctattcatagccgtgctactccaattttataaaattagaaccatgctactgccgtcaccttttctatatatctatcctcttcctttccgtcttcttccttccttctccatcttcttcgcggccatcgcatgccgtcggcgtcgatgctggcgtcgagcacctcctagtccctctcgggaggcacagggagcgccacccgtgccagggctgcacctgacgacgacgacgactcccacgccgccgagggaggatcgatgtcaacggactgcaggaagcggagcgcacgggggaggtccctagagaaggcggaggagggggaggcgagaggagggaagggggcggtggtcgccattggcagaggtgggagagttgccacctgtggcggatttgcgctttctcaccgacgaggtcatcgacgaggtcacgagacgacaccggcagatttgcgctttctcactgccctccctctcctccgtctcctcggcgcagcacggtcgagtcatcctcccgagacacgccagccgcagtgccagtggccgctgccgacgcccaggtgtccgccacgccttcgctcgatccgagcctcgggatgtcggccatgggggccgtggagctcgagcgcgcgaggaggcttgcggcaggggggtggtagcaaggatcgcaagcaatgaacaagaaaaatcacggtagaccttccttctacaagatacgaaggctacaatggcaacagtacttcgccagcagtgtgcacgcaccatagtaaaaagagaaattttatagtccttgaaaaaataactggaggagtacctagtacccagaggtttgctaaacggataactcattgcatggtttgacatgatcaagccctgtcttttgttcaacagatagtcagtaagagtgtaataatttacttaatcaaaatttgctgctcgataaaccagattagccagagttaacttggcggtagtaaccaaagctaggaacaagccaagttggtactggccttgtcaaccatggttgcattggccggaatgacgagaagctgcagtctgcgacgctgtagacgccaatgtctctcggtgccgcggctctctggatcaaggtgttccgcgtggatctttccgcgcagaggctagaggagatggcgacactgggcgacggcggcgacagccacgcgctgttcatcgggtgcaaccagccgttctgggtgccggccggcggcgacggcgagtgctccagcggcattctgcccaaccacatctactacacggataaggaggatggcaacacggaggcgccgagaaacattggcgtctacagcatcgcagatggcagcttctcgccgtttcaggcaactcaaccatggctgacatggccattgccgacttggcttgctcccaatttcagttactatcgtcaagactaagctaggaagaactaaatcgacacggggcagctaagtttgtttggtgattactctctgtttcatattataagtcgattgatttctctttcactcaaaattgtttaagtttgaccaaatttataaaatgatatagtaaaattttcaacacaaaacaaatattttattagaatatattcaatattagatttaataaaactaatttgatattatatatgttgctaaacttttctataaaaagacgaacgacttatagtatgaaacgaaatgagtaattttacagtagttgagtaggtaccgtattttcttgtttgatccattgattagttgttgctgctttcattatttaaaactatatcttttgttttctcttattttttattgttctaatcatcgttcaatccaaatgttatctcttatttttgaatttttctaatcatcgttcaatccaaatgcaaggctgaccgcatagattaaaatagagtttttttcttctaaattttttttatgacgataagattggattttttttaacttatatggattgaccaatttaacgacatattttaaagctagaacatttttggttgaggaccctaggctgtgaattttgaacttcatatatatatgaaacaggggaggggctctgagagtactgaaannnnnnnnnnnnnnnnnnnnnnnnnnnnnnnnnnnnnnnnnnnnnnnnnnnnnnnnn

SEQ ID NO: 35444 - DNA, 15068 bp, Oryza sativa
  unsure (1)..(15068): unsure at all n locations
nnnnnnnnnnnnnnnnnnnnnnnnnnnnnnnnnnnnnnnnnnnnnnnnnnnnnnnnnnnnncgggacttgaatatgagtaggaaatttccaccacaaggaacctaaccagttgaactatgttcaattcaaaataatgttggatattaaaacaaccatttaaaccagtgaaaccattattttaatcgttagatctatcttatataagaaaaacaatcgtttattcatggtacatcacatttcaaaaatattattgtgcaattatattcacgttaggttgcgtagaacctcttacccactctacatgaaatgtttatagatggattgtctctcaaactatatcaatcatattatgctatataaaatttagtggagtttcatgtgccaccaaattcatcctctaataaaccatgataatatatatgcaataaaagaatgaaaaacacactacttttgctttacacttacttttactttcgttgaaatattatcatgatgtgatttgatgtttcaatagctgggcaggtcatacagtgtgggttggaatcccattttttaagaaccctgtttgcattggtgttgagcctgtctcggaacgctaaccacaaaaagatcctgcaagtgttggggatagccttgttccagataagtgttgccggctgccaaaggatgccatgataagtcaacaagttgtagtttgctgatgttgtgatatctgtggaaccaagcagcagtgttcttttgtcggggacattctgttgtatgtgttggtccaacaatatatccatgagggactgtaactcggtttgagcccgggaagagagaaccgggtgtagatcaattgtccaggtaccgttagtgtgttgggaggagactgtacagttgatatttgttgcgtacgaagctagtgtcggatatatgaggttgaatcgtcctactgctgtccagtggtctcgccaaaactgcactagctggccgttcccaatcgttaccttagtggaggcaataactggctcgataacggaacagactgtcttccaaatcggtgtttctgttggttttgctttaatagggatctcatttgccatgtgttgcgtgcgcaaccattgaaaacatggttctgatgagtctgataacaacttgcctcctatcttcataagtagagccatgttgtgagctctcaagtcacggattcccaatcctccttgttccttgttgagagtgatagttggccaggccactaaacattgacctccttttactttcttatcccctttccaaaggaatgccctccttaggcgatcaactgcttcgatggttttgtctggccacttgattctggacatgaaatagtttggtattgccgacatgactgagttgatcatgatgagtctttcaccccaactgagaaggcctgggatccatcctgctagccttcgatctattttgtcaatgactggtgcaagcaacttgtgtgagattttggacgtagagagtggaagacctagatagttacaaggaagcgggctgatggggcattgcaaaagctcagcgatggcccttgcctcgggttcattcatgtgtatgggtacaaaggtactcttgctgaaattgatctgtagccctgagaatgcagcaaattcctcaagaatgccgttaattatttcagcctgctcaagcgatccttttaaaataagtagggtatcatcagcgtattgcagcgtgggaggaggagagtgagaatccagtgggtggagtaactactcggagtggaaggcttgctgtatcatttgctgtaggacgtcagcgactaggatgaagagatatggggagagagggtcaccctgacggacccctctcctgtacttaaatgactcgcctgttgatccattgatcaatatgtgtgcttgtctagtttccaaaatctgtttgatccaattgatccatgtgtcgtcgaatcctctgcggtgtaggaccaagtataagcaatcccagttaactgtgtcaaaagcttttttggaagtcaagctttagaataatcgttggttttttccttttgattgcacattgaacaatgtcagaagctagtataaaattctccgtgattgatcttcctttgatgaatgcagattgcattggatcaattaactcatgaatttccccttgaacccggtttgctagcactttgctgataagctttggcagactgtgtagcaaggatattggcctgaaatctgttatgctgagaggggttacttttttcggaattaaagtgatgtaagagatgttaacccctgaaagatcggctgcattggcatggaaggaattgaacagtgcgatcaggtcaggcttaagagtagagatgaagcatttgtagaactcatttgtgtatccatcaggacccgagcttttatttggaggcgagtgcaggatggcgcttgagattatattgagagtggaaagagaaatttaaaaaggttaacaacaaatgttcctcaaatgaggataatcagaactaatgagacatattacaaaagcacaaaacaaagcccctccctgtgtatgtattactatacgatcagatgaagttaactgaagaaacgagttccattttttttttcgcttgaagaggtggtgaactagtgatgactagagaagttcggagcatttacaaaatattctagctttaaaaaaaatatagttaaattggtcaaatccatacaggtagagaaaaaaagaagtctagtcttatcagcacaaaatttaatttagaaggaaaaaagaaaagtcacactctatgcacagcccgacatttggattgaacgatgattaaaaaaaaatcagagacaataaaacgtagatttaaataatgaaagcaacaaaaaacaaccaatcaatgaatcaaacttagctgctctgtgttaatttagttcttcctaacttaaccttgacagtagtaaccgaaattgggaacaagccagatcggcaatggccaagtcagccatggtagagatggccggaacggcgagaagctgccgtcggcgacgctgtagacgccgatgtccctgggcgcctccgggtagagcagcgcgtagtcctcatcgttgtccgtgtagtagatgtggttgggcagcacgccgcccgccgggcactcgccgtcgccgccgccggccggcacccagaacggctggttgcacccgatgaacagcgcgtggctgtcgccgccgtcgcccagcgtcgccgtctcctgcagcctctgcgcggcgaggtccacgcgggacaccttgatccagatcgtcgtcttcctatacaccgccgtcgtcggcgtcgtgtccccgtgggtgtcggcagcgcggcgcacgggcttcagcatcctccacacctgcagccactcgccgccgtcgggggcgcggacaaggtacttggtctcgaggtcgatgacgccgtgcaactggtcggctaggacgatcgtccggcgcacggcgtgttggcccgccggacaagtcgtaggcgtggatggcggcctggtgcctgacagcgtagaacatgccgtcgccgtcgttgtagacgacgtcggtgtagaagtccgagtcgggcaggttgacccaagcccagcgctcgtcgacgcccacccgcgcgaacgagagctggtactttggccggtggagcaggacaacgatgcagccgccgccgccgctgtccgacgatggatcagacgacaggaacgcgcgcatgaggaggtactcggcgagctcaccggccttcgcctgggtcggtggccggtcgtcgcgctgctccatggtccagtcgtactggacgatctcgtagtcgtagtcatcttcgtcgtcgtcgtcggcggcggcggcgctctggctgcggtgcctgacgtgctcgatggtgtcgaccggcgggagcgagtcgatctgctggccggtgacggggttgacgaggcggagctcggcggagtcggcgtcggcggtgacgatccatccatgggagctgcccaaccatgacctgtcgcggatggggggctcagccggcagcgtgacctcgaacgtcctcccgccgccggcgaggggaaagatggtggcggcgcgggtgttgtcgtcgccgtcgcccgaggcagcagccgtgtagactaggcacggcggcggcgggcggcgggagaagagcgggtggcggtcgcggacggaggcggcggcggcgtgccaggagcagcagacggcggcgcagcgaaggaggtcggcggggtcgctgaaggtgtggaagacggtggcgaggaggtcgaacaccatgtccgaccagctcgccgttgccggcgacgtgaccatcgaggacgataggtctatcatgcgaagcgcacagctagctcgacgatgggtgactgtgatttgattgcgatttgcgtgcgtatgcgttagatatgcagttcggccggtcacgcacgattccaactcgatcggtaactgagtgtacggactatgtatatgcacgggatgaaaccggtattgaaaatcccaaccgcatccccttccgttttgtaccgacgacggtttcttccatgaccattgttgcggctggtatgctgttttggtacggaattcccgaacaaattaggagaatattttgtagcaggtgcccaatgcaaacaaaaataagagttaattgcactttagtccaaccttttttctttatattgcaatgttaaaaaaaatatatgtttcaataattaaaagaattgtgtttcatatgtgagaaagggaaagtagtttcaactcaactttgttgcacatttttaggccctgtttagttttcaaaacaaaaaatttaacaatgtcacatcgaatgtttggacatatacatggagtattaaatataggaaaaaaccaattacatatattgtgtgtaaattgcgagtcgaatttttaagactaattgcgtcatgatttgacaatgtggtgctacagtaaacatttgctaattgtcacgcagtttcctggcggaatctgcaatttgttttgttattagactacgtttaatactttaaatgtgtgtccgtatatccgatatgacgaccaaaacaaaaaatcttccccaactaaacaaggtcttagttttcttgttgtaatggatatttctttagtattgcacctggtattattcgaatgtttcgacaagtaatatcgtttgcaaatgttgcatatggtattttctcatgtcaagtccatgattcatggcgaccaccgcctccttcttccctcccctcacctccccctcctccgcctcctccagggacctccccgtgcgctccgcttcccgtagttcgtcgacatcgagcctctctcggcggcgtgggagtcgtcgtcgtcgtcaggtgcagccgtggcgtgggtggcgctccccgtgcctcccgggatggaatgggaggtgctggacgcctgcatcaacgccgatgacatgcgatggccgcgaagaagatggagaaggaaggaagaagacggaaaggaagaggatggatggaaaaggtgacggcagtggcatggttttaattttgtaaaattggagtgacatggttacgaatagacgaattgtaatagcatttttctgaatagccacattttcaatggcatggacccttaaaagaaatattctagctttaaaaaatgtagctaaattggtcaaatccatacaggtaaaaaaaaagtccaatcatatcagcacaaaatttatggaaaaaaaaactgtcaattttagtctacgcgttcagcccgattgtggattgaacaataaaaaactatgcatgccgttattttttggcctattctctgtcagccttacgaagatagatataattaattgactaattgactttgagttagacaatgtaaaaggtaatcttctttttgataatgatgtaaaaagtaatctaaacgatgtacatgctcctgtcactgtcagttaatgaaatcaactgtttgttcaaaattgttatgggttttcttacacagctttcattcaactctcttataatacactattagagaaacgataaaaggactagtaccatagatgccggaaatgtaataactgacacctacagtatttttttcgttcaagcgcgcgcctgtggggaaccattttcaagaaccgacacctatgtaatgacataagtgttggtttaaaaggaaccggtacctatgagtcttgccaaacataggtgtcggttcctattaaaaatcgacacttatatctaagtcatcggtactagttttttataaaatgattgttataattgagtcatcagtactggttttataaaaggtgcctatcgttagatggatgttgatgaatattttcttggattcgatccgatgcaacgagctggattttttttcattcctgaaacctcagtcctcctcattggtgccgcttaagggatgctggccgggaaaagtccggtacgtacccatatgggtttcctggccagctagcaccaaatccctttttaagtagtagcataaagttgggtgtgaagggtaaatgctcattatattgtccttactctgcatttgctttgataattctgcagccgaaatgtttctgatgcgcatttttagcgcagatgatcatgtcttggccagtgaaaacagattctacaacttattgtcctctgattttaaggggctggtatggggacccatatcgtgggctcatatataaatgacacaagtactttaaaaggagcttctttccttggccaatcgatcatctctttgtgcgatttgccggttcagacttcaaacttcaaagtcagcatgctactccttcgtacatccaggtccatttgtttaagaagagctatttagtcagaacatcgagagcttgttcggatcgacaccaatgtaaacttttggttaaagacgagatttggctactgtcaaaattttggcaaattaatctagtcaaaaggcaagagtatgtgattttttttttgaagcaatcaagtgtatgtgctttggttttcttgccgacgtttttggcaatgccaattcttttgcaaattgcaacaaacgaaacatatgtttacttccatttgcattactatttttggtatatggttgaatacggcaatgaattaaccaaacaggcctgttatggctgacgttgcttaaatttgtgctgagattatgtctagaccgtgtcaatcgattctctgtgaagaatgtacgtcctgccgtacatcgactttttcagcggctgtgtttagttccgaaaaaaagttgaaagttcggaaaaagttggaagcttagaaaaaaaagttagaagtttacgtgtgtaggaaagttttggatgtgatgtgatatgatggaaagttggaagtttggggtagttgagggtgaactaaacacggcctaaataaagtctaaggctgtaatctgttaattgatcttattggtgcagtttcgtaaccataccctaatcagattgatcttgtcagcttcgttatgactgtaggaaaggcttgctttatttatttatttttcctcaagagcaagcgacaagacaagatgggtgtttctcccttagagttcttagttatgcaaatagttattgttttttactgaaataattattagaaattttgagaacactatataaacattttagatcaatatataatatttcattctaaaaacggataagtttaaattcacaagaaatagcatactcatatatatgattgtgaacaaaacatgtaatatatcgttgatttctataggccctaagtcataggcaattcaataaatacatgtgtaagtggtttatcacccgcctgtaaaaaatagttgtgtagcagtgtccagacaacttggggggatattggttcaagtgttcaaccaagctcacttcaaaaaggttttggttcatgccctcttcagttcccaaagcaaaattttcacgatgtcacattgaatgtttggacatatgtatgaagtattagatataagcaaaaaaacaattacacagattacgtgtaaattgcaagacgaatcttttaagactaattgcgctattatttgataatgtggtgctacagtaaatatttgctaatgacggattgattaggcttaataaatttgtctcacagtttcctgacggaatatgtaatttgttttgttattagactacgtttaatattttaaatgtgtgtccatatattcgatgtgacaaccaaacccaaaaattttccccaactaaacaaggcctcagttcaatatgctagaacgtagggtaagctcatctttccgtaacggcgtgtttagcaatttaatggaaggggacgggaagtttagagggagatttggtgatggattggtcatgggagtttggtttttaatcctagtcccttgtttagctaaaaaaatagagtaataggaagttttgggaggaatcagattttaagtaatgatggatggcttagatctaattgtttgtacttgctacttagagaaggaactccctaagccatccatcattacttaaaatctaaagtatacacttagagggtgaaggtgagggtgactctgataccaccgccaccccagccattcatgcaagtattgtctatacagggagattggatggtggtatcagaaacaagagagttcaatctccctgtcccaatccatcaaaaacccccacaccaccatccaaagttccagacaaaggaactagagaagttttatggtttttgcgaggtacgtagaggtattgaaaggtgaatcaatgtggattattgattaagagaggggtaaggtatggaataaaattattgtagcttgtctattgtcgcctaaactgttgcatcattcttctatctaatctgctgttatttttatcctccgccttgtaaattagattaaaatctcccaagattaaccatgaaggtaggcttgttggagccacatcctgtaattcttgaaggaagagaagtttggcagcatcttcctatggaccataagcccctgttattgtccagtaggcatttgtttctctcatagtcaccttggctgttagggaaaacatacggagatcacaatgtgacaaggtaaaatagttctcatcagctgccaggattataccacccctagatccctctgcaggcaggaaaaagaaattgttctgaaaatttactccatttgtttcaattatgcaggccttatctacatcttgcagctttgtctcttgcaggcaaaccagagttgcattctgctgttgaaggagatttctgaccgcctccctttttgctggtgcattcagacctctaacattccagcttacaatcttgcaatgttattgaaacataaagctaagtttaaacactgcagataagtagaaccaagaaagaaaggaagaggccacatagaccgttgttttgctgcagcaaaagatagagcatcattcataaacataacctcctgagagttcttcagtgagttgtgcctagtttggtggaggtctaaagccacagagttcacagacaatacagcaaggcatccagcccgctttagcttagcatctcgataacttctgcagggaaccggcacccattttatttatgtaggcgccctccaggactccaacttgatgtcctttaagccggggtcacagctgcctttgctttggcagctttgagcttcagcttcttgcagccgcctttctccaccaaatcagcgatcatcttgagggagcgtggagtgagtttttttttgacattctcatcaaaagaatcaccttcactcataataccaatttttttggaaataatctcttgtgctataagctcaattttgcaaccattccttcttttcttttatagtctctcactgtgtcgttgagtagcgctaagcacaacttttggtttttttagtacgaatgcgaattgggggcgacatgaggggtggtctcaccggagttgtgagggaagcaatcaggtcagcagcactgttgttgttaacgtcttcggcctgcgttacaacagtccctcctgacagagggacatacacaggggagccctgcacgccatgttcgccctctggcgagaagctgatagccgcttcaacccttaggccatttacaatgcaaagacgtagcgttcagcctccacatgccagctcggagattcctctccacctaggcacttttcactccctcaccaggaacggggagccaaagtaagctccgagttctttctcacaattgcaggtctggcccacaacatcgattcccgcgtcatcaagaaacggagagagaacaagggaagacatcacagcgagctcgtcggatagttggctgcgccggcgacgcaacaaccatggatacggacgaagagaagggggggacggaggggagaagccgatgagcccgccatcgccgtgcgcagccgacgagcacgccgtcgccgtccacgccagatccggtgagcccaagctggatctggccgccccgctgccgctccgctcggcgccttccccgctgctccgcccggcttcggtggcctccccttctggccgccgctcgcgtcgccatctctctctctcctcccacccatggccgccgccgcccatcgacgccgccgcggcgcagccgcccgacgccatcgccgcggaggccagaagaggaagggggaggcgcggaggccgaaggaggaaggtggaagccggacgctgcttgccgctcgggccaagtcgtccgcccgccgctgccgcagtcatcgacgcccgccaccgcgcagctgcccgacgctgtcgcccgccgccgcgcacccgcccaacgccgtcgctgctcgggccacggcgcggaggccggacgccgctcgccgctcgcttttggtgagaggggcgccggatgggggagatgggcgatacggatggggagaatggagagagaagagagatgaaaagggaagagagagaggacgggtgggacccactatcatgtgcttgcgaaaataaaataagccacatgcactgtgaatcaagtgtcttctgtgttccttgcctagctggtacctcaggaacggcattttgcgacgacgcactgtgagtgcccttatggggtcctcttgctgttcctggtttccctggtccccgtgatggaaggaaaacaactcagctggagaagaagacagatcaatagcgagggatcccccccccctcttgggcttttgcttctgcgcggctgaaagtgaaattggggccctaacctcagtgtcgtccctagaacggcggatgtggtttatggtgatgtatgtgtctctgttgcgctggcatcccctcgtgtcttcattgtagaatccttgaccatctcccccacgctcactgctgtgggatctccccgtgatgcggccccacagtgacctggagcggctctggtagcgcggatgaggccgaccaccatccccatctgggtcttcatttggtccccgcaccgcactcggctctagcctgcacggaataggccgagagcccgaacgggaacgagatacaatcatcatagaccccgtaggaccactcgtattgcttgtacaacattggatgaggctggaggtcctccaaggtgtccaggtgaataatcaccggggacaaacatccatccttgggccccgacggtggggggttgtgcatggggtcgatgtcgggcatggggatgtcgacagggaccagctcatcatccggatttgccaaccccagccatgccattttggggatggcgccggggtcgtttgtctagatccgaaggtcgaaggtgcggttatagttgtggcgacgtgagtactcttcgatgaagttgatggcgcacctgggcccaatcagcttgactgcagtgacctcagtgcgcgcatgcgttggaatgccctcaatgcacagacgtgcccggaactggtaatgcataccaaatttgttatatgtttatctaaaaaaatgtgtctattccaggaaacaccattcatataatcaaaatagataactttaccaccacacacattagaagacggttttaacctgcttggtaccaatgttatccagagaagcagaagcacccaaatatcggccctattttttttttacatagagaaccacccaaatattgcccctattttttaacatatacttattcttctttgttggactatttgcaatcttctcccgtggtctattcctattgacgcgaaaaacacatactggcctgggagatctgcttagctcaagtgcaggaccaaaagttgatgagatgcaggcgtgccagtcagtttgactctgcaactgacaaggtatacaaatagcatatcaatgagccgatcggctgataagccgatagattaattctagccgatgtcaataccagccgataccgatagggttttgagctatcggctataattccgatgtagattctgacgcttgatgtaaataacaatataaaggcaatcggctgatgataatgtaggaaagcaacaatataatccattagaaaccaatcggctaacaatgatatgatagaacaagtgtccgaatgttaaagcatacatcggctggagatccgatgtcataaaatccacaaattagattaaatggtgaaatctttgttatcatcgactaaatccaacttacatgcaatccttgtaagccgatgcaacgtcgagatatctcatcacctgaaaccccgatgaaacccttattggcagtcaaaaagcaagctagggattatggttctaaacacggcttagtaaatcaaacttaactaatgcagcactaagtatgaaaagaaacacaatatctagacaatcaagctgttgactgatttttagggtggtagatgccttagctaatctaatcttagtaaaacaatttagccgataccggtagaaaccctaaagcgagagacaaccgatagagctaaattgagatactaagactagattaactaaacatatgataaatagccaggcaaatatatcaaccaaactagagcaatccaagaggtcgaatgtactgatatagccttgaatagcgccggcgtggacgatacaattgcctgagccggtgaaacattggacttacccattcatcggagatcgaaaaccaatgcagccccgagtcaagtgccaagccccaccgtcctaattaatagataacttgccatgccgcattctccttgaactcggtcacttctggataagtttcatttaatagattaatttttttaaccaaatatagcagaaatcctactataggcgatgtgataattctcttaggggcttaccaaatttcactgttaataattccaaatgccatcttcatcgaagactttgattatttgctacacgggtccattggaatatttctattttaccacttttaactgtcaacccatcaaatcgggaggtaaatgactatcttgtccttgtcttctttccactttctcatccctatctatggtggccttggacattggacagctcactcatctctcctgctgagttgctggcttgctgctcgatgctgaggatgagggcgcgacacggcgcgtgaatatgaggccgacgacgccaagaggctgcacgcagccggagctcgaaggccatacactgtatggacgttgattctaatgtgctaattaagctatggatgttcttgactatctcattggggggagctcaaaattaagcaaccggcttgaatcccttcatcaatgccactaattttgtgccggcacaaaatccgacaaccgccaaccggtacttgtggctatttctatcactgcaacaaatctggacttctatgacgattacctgatgacagaacacatatctgtcataaatagaggctgtttatgacgactgttcagaggatgacaactgtttatgaccaaaccgtgtatctgtcataaccatcgtcatagtatactctgcatgggctctgtgacgatagcacgatgacaataatggatcgtcataaaacacataactattatattttttaaaaaaaacaaaaaaaatcttgttatactacattgccactagaccataaatcatttgtcctaggtggactcttgttgtctacatcaattatagtctctcattttaggattttaggattttaggattgaagtcatctctagtctcattttatgaataaaaaaatcaaaattgtggcgttttattttatgattgaatgaaaaaacttaaaaaaacaaactaaaatggctataagttggtctaaattattctttgaaattttccgtgaattttcggagctcaataactaattttaataccacaaaattcatttaacctattaaaataaatgaaaaataaattaaaattcctctctctgtccttgggcctttttcggcccaagtattactctctccctccctcagcccgcggcctctctctccctcctcctctctcttcgggccgccggcccacccttttactcatccctcgctgacaagtccatttacctccctcctctcaaatcaaataactttccgggtagtaaataatttcaaataaaacaattgttaacaacaaagttgtatatcttaacaagatctacaacttttattttggtcatttttcaatatgactttgtttcaataatttgaatttgaattttaaattatgacaacttcaaacaatattttcaaatactaaatgatttgaaatgaaaaagtcatcaacaacaaagttgtataacttatcaatatctataatttttactttggtcatttttctatatgactttgtttcaataatttgaatttgaatttcaaattatgacaacttcaaacaacattttcaaatactaaatgatttgaactgaaaaaatcaacaaaaacaaagttgtataactcatcaatatctataacttttattttggtcgtttattcatctgacaaagtgatagtaacattgttcacaaaatttacatatctctcttatagtttataaaccatatggagatatgtaaaatttatgaacaatgttaaaatcactttgtcg

SEQ ID NO: 35445 - DNA, 4504 bp, Oryza sativa
  unsure (1)..(4504): unsure at all n locations
cagctcgattacttgccatagtaagtatttctcctggttataattctgtcatatgcaggacaaatgtgccaaaaaccaactgaaccgtgaaaaagttcagtttcagcagcgtaccggatctcggtcttacattgcacatgcctatgtcgtggtaaggaaaaaatgatgatgtcatctagttggatgtagtttttgtgtttcctgatggaggtgtttagatccagtggagatatatatcttcatattgatagtggctctacataatgctatatgatttaaagctttagtaggctccctcttcatgtgagattatctgcagccctccctacatgtttttctgcagcagcgtgggttggccctctattcagcttttgctgcccttgttttgcattgtataggtatagcaatatgccattctgtagtggcatacctctacagtgcaaaacaaggacaacaagaggtggcaaagctctaacccctgctacagcaaaacatggagggagaatagcaggttatctcacactttgaccatgtaaaaatatgctcatgttttatccataaatttctatcagtttggtttgattgctcttgtcatgcttatgcttatttggggtgacatcaattaagtttatacatggcaaccactgtcaatgtttaacaaaaagaatcaatgtcaaccagaatgcttgttctggaggacatgtttttgtgttatctgtgtactttaacataaccattactcatgccatcatgtttctctcaacattgcagaagcaagaaaaatacaaagacagtgagcccactgcaattgatctctttaaggagttgcattgcagcaaaactaaaggttgcattgctgcttggtggaattttttttgctggctgctggcaagatatacgccgaaacttagtagtggctgctaggtggaattttttggtgcaggaacttggcactacctgtaggaactttgtagtcggctgggacttgtgtagttggatggtggatgaatcattttgtattcatgttttgtgcttttgtatggaaactgtattctggaacttgcttttgtatggggctggaaaattaattatagctagaatgtgattgtaatataattatagaaatggttgtggtttatattctatgattgctttttaattgggctggcccataatataggctagaattgtactattgggctataatgaaaaaaacgtaaaagcaaatttgtagctgggtcaaaaaaaaaaatatttgggccaattgggctgattgtaattgaaaataaaaaagcccatgctatatggcccgaatgtgaattgccacgtcatttgccacatcgcctgcccttgtcatttgcaacatcacatgtcatcatatacgtggcgctattcggttcaatttgttatgacgaatttgtctcgtcattcatcaatgacaggagaattatcgtcactgtatcaatgacgatgtcctctggtggtcacagaagctgattagtgacccaccttctgtgatgacagccatttcgtcactgcaggcagacagtgacaggaaataagctgttatcgtcgtaatgtaatcgtcatagaagcccagaattcctgtagtgtatagtagtgtgatgaacagcgtgggcgcgagatgtttggtgctgcgatgaagcggcagcttttcgttttctcttcgattgcaatatatagaagtaacaagaacaagggtagctaggcacgatgccatcaacctccactaagcataccacggtcaacagaccaaactagaaaacatgaaagataaaaagtaactacacatacatctccacgcatgatatacggattatcgaacttatcaagcaactgtcccagtcgtcctggatgactgagttgtgtttgtgctggtgctggtgttggtgttccctgtcacatatgaagatgtgtagttgaaagcatctactggggacaggaacgttgccaccggcatcctcgtcgggaggctcggcggcggcacctcgcctcgcagcacactgacagcctgcctaatcgttggcctcaggcttcggtcagggtgcgcgcaccagagcccgacaaccatgacagcctccatctcctcgccgttgaactcgccgcccagccggtggtcggcggcgtcaataatcctcccattgccgtacaaatcccagacccattgagcaatgtggatcatgtcctcttcttcatcagcttgccgttgcggcgccattatcggtcaccgaccacaagcgatctcgaggaggacgacaccgaagctgtatacatctgactcggcattcgccctgccagtgatcatgcactctggatccatgtaccccatcgtgccagctagcaccgttcgtgtgggagccccggtcgtggtcgacaagcctagctagcccgaagtcaccgagcttggcattgaaggcggtgtcgagcataatgttgctcggcttgatatcacggtgcgccacacactgttccgactcctcatgttagcacagaagcgctgatccggtcccaagcacgatctcgtgcctacaaattaatggagcaccgcttgttaattagaatgtcaaatatatgtttgatagattataatatagttagacaattaaagctataattgtagtgtgagattgagtccgcgcgtgttgggctatctaaatgtttttacagcaccttctgctgctagaggtagtagtgtagtttgtttagatctgaccattgattcttaaggctattttagacattagattaaagtattaattggagctattttaaccgaactaattctcgctgttctcgccgtcaaattcaatctctctcacggctagtgccaccagctaaacaccgcttgctatcattcttgcagcctgcattgcttaggacgaacatacacgaaacctggatagtgaagaactaatagtgttgatccattgattcagaattcagatcatacatataggtgcatgcaaatcctgtggacatatatatgtagaagcaagaaagctgaaactatttcatggatatagtcaatcatatatgcatgcacgaagaactcggttgatcctaattcctctcctaaaaagtaggcaagtaaactacacggaagaaacaatctttcaagagcattaccaatagattacctataatcttccccaaaaaaatgtttttaggtttctaaactgaaaataggtagtgaaaaaactcctccctccaacagatatcctaaattcaatccccaaaacttaaaaatgggcccttctgttaaactaccaacagaaatgttccgttttttttttctttcacagaaagatcgctatctcccatgcgcgggagccggaggagagaggcgggagtgtgagattgggagcgacgcgtccacatataaacggagcaaggaatcaggagaagggaactccaaaactcgggtaggagagtaggggatttgttggagctatttttttactaaaattcctcaaaatcagttttgggaatcagataaggtagactgttgttgttgctcaaagggaaccaaaaaaataagagatggttgccaaaattcaatcgggacggtcaatgaaatttgcaaaattatttacctgccatatgcatcttcttccaaatatatccctacacgaattctaccgtccatactacagggtatagtataaatgaatatgatccattgatctagatgaatggatggctcatattcatccaagggtactctaaaaaataatacgcctttaaatcggttagtgtgctatgatgattgggaaggaatgttcgatcactactgttagcaactttttgtgacaagttgataactacgatcgcagcacctaacgccttgcggtgattctagagtcgccaaccacctcaatctagcaaaaactagaccaagatgggttttgataactaaagcggctagcagagccgatttctagataactacccgtctcgtaggcaaaacgaaaggttttcaagacaaacctacgaagaggtgttgcactctcgcagctgcggcggacgatttacagcgcaaatagacaaaaatggacaaactaagagaaaactaaaagcaatatgaaaaacaattcgattgaatgattgtagattggttagttacaattgaaccggccatgtcccttatataggggttggtcttgccctctataggccctcctccacgtacaactcgggatagaatccaaaggaaacccgaaacatgccttcccgagcaaggaaacttcgagaccctgcgaaacagacccggactcggactctgccggtcagaccggccacacaccgccggtctgaccggccaacagatggcagtcagactggcccaattagagaaaaccggcagacttccaaactttggcaatttttcctattttatccctaggtacaaaatnnnnnnnnnnnnnnnnnnnnnnnnnnnnnnnnnnnnnnnnnnnnnnnnnnnnnnnnnnnnnnnnnnnnnnnn

SEQ ID NO: 35446 - DNA, 7210 bp, Oryza sativa
  unsure (1)..(7210): unsure at all n locations
nnnnnnnnnnnnnnnnnnnnnnnnnnnnnnnnnnnnnnnnnnnnnnnnnnnnnnnnnnnnnntaaattaagcgccagaacatagtcccacacacctctttttaatcaaaacatttacttgaggtttttataagaaaaaggtgacaatttattcaattccattgtccaacaatttaccttaacatatctcgctggtaagaatcataatcccctccgcccctccgctttctccctcccctccccatcggcggtgacatccctctcccccctccccttcctgtctcgctagcatggcgtgacagctgtacatttcgtggtacggagtgacgacggtgagggtatagcatgaaagacgtttccttggcacggcgcaacgacaacggcgatatggcgcaacgacggcgtgggcacggccgaagctgtttcgtcgaggcggtgcagcgacggcgggggtacagcgttaggacaacgatgacagcatggcaacaacccatctccctctcccactcagcctcttcattttcaccgtcaaatgcgggagatgttggcggcagggaaatgggctcgaggacgacaatggtggatccaggaggatgatggcagtggtggtgtggttggcaagttcggctcgattcgagccagctttctttttttttttctcgtgcaaagctaaaggtgtttgttctattttcctcataggtgtcggttgctggtattaataccgataaattggtgccggattttcatcctacgatacaaatcggcacatatggcatcttctatagtcgtgttaggatgttaggtgacttctaatctaatccattcatcttctttaaaatccatgcggttttttcttaagcgcatttcacatagtaaaactatttttattcggcgaatagtaggagtacacacttacacaagattttttttttggcttttttgcccagtgaacaatactatgtattatacgtacgcgggatattttttttcccagtttgttaagtgttattttcctaatagatctcatctaatggtataaaataactggtctatcgatttaagtgaaaatcaagggtcggatgttttatatttttctcagaatatttaggatctcctattataattacatattttttatactaaagtgaatgattaaatatatgctcaaatatcaatagcataaaaaatcataggtgagaccaatatattgtagggtattcaatataaaactaaataaagaaaaggttaaatggagagtaaaaaaaagtggggcacatatacgttacatgcgtacgaatgggatgagggaggcgtacgtacacgcgggtgagatgagagggaggaatagcttcttttttattctaactaatggtctaaaataatggaaccacctatttaattaaaaatcgacggctaaattttgcctccatatagcggtataggagcatttttagaaatctcacatgacggtttaatagcgtttctaggaattttagtgaatttttaagtatattatagataagtatattgaaactatggttctaacatacatatgaattgaatttataatttaaaagctacaattgttgaaagattgtctattttttttgtaaaacccataaaggtcatgcagcccttgaagtgcacaatgagctgagcttagtctaaccgagttgaaaataagttgggattatatatcattttaattaccatacataaaaagtgagagttcgttagaaatgaaaaaaaaacacacagagagagagagagagagagaaaaggaaagggaggttgggtgtagatccgtacacgtacacgcagaacaaacgattggaaattgggattcgtttttaatttacagatagatctgatggttcaggatattagacccactaatttacttaaaatcaagggagcatgttttttatttttactaatttattgaaatgtcatgtatcaatttatgagtatttgtaggaatgccacgtggcgatacgggagcgtttataggtatttcagttttttcttcacctggcaaaatatatgcaataccgatcttgatgtatttatttaattacaaataaaaatagcacaaatgaatttaatgctttatataaattgagaatcatgattatttagctatttaaaattaaaactattttataatgagtttttagaaaataggagaaaaggggagggcatgtggaatacgttgcacatatgtacgtacttacgtacggtggcaagtactgcaggggaagggaaggttacaaattctgcgagatagatctagagggatctaataggcccataggttggtttgagtatctattcctttaaatcggtctaatggttaaaaataatgggtccactgatttaagtgaaaatcaatggtgagatgtttttcttttttctaggatttttttctaatttattagagcgccacgtggcgacttaggagcgtttgtagagcgctacgtggcggcttgagagcgtttataggaagtttaatggacttttagtatataataatagatagatagatagaagatagatagatagatagatagatagatagatatttgctgttacacgacaatacaaactatctaatcaataactagatatttttggttaatgtaggagctcacttaaatgtgcctgactaactaatattgccgtcacatgccacggacaaaattagaatcttttggagatggttgtacctgagtggccacgggagcacgttggcgttggcgttgtagaggtgggtgtcgaggctggcgttgggcatgagctcgtagacgaggaggagctcgcttccgtcgtggcaccagccgatgagctgcaccagattgcggtggcggaggcgactaatgatacgcacctctgactcgtactccttcctcccctgcttcgagctctaggacacttttttaatggctacttcaagattcagatccttcaagaatcctttgtacactgacccgaacccgccttccccgagcttgcagtcgtcggagaagaagtctgtggcgacggagagctcgtcgtagcggaatcgctttggtctggtccccttttcgaagtcatcttccatctcctgatgctccctcatcagccgggcgtgcttccggcggcggcgcaagaggagccagatcgagacgccaagaatgaccatgaaagagacggcgccggcgacagacaggccggcgacgaatcctgttgaccttgtggacgacggaggaggcacccggagacgatggcggaagagtgatgccaaacggcgagaggtcgtacctgaggtagcagctgtaccccttaatggcggcccagctgttgttggggaagattttgctgagttgcacaatgtagtcagacagacaggtgctgcactcgctcaccgccaggtccctcgtgcactgagccagaccgtacatcatcgatgttgatccgagccgcgtacttccggtgtccagcctgagcttggtttggccggccgtctccgcgagctggctcatcagctgccaccgcgtctcgttcatggcggccatgttctcgacgtaggatttggcgtacacgttgaaggcaacggtcttgtcggcgacggagaagaaggagacgtcggagtagcggaggaggcaggcgtcgtagttggcgttcaccgtccgacttcccgggcacacctgcgtgatccccgcgggtgcgccggcgaggcattccttgcattgcgtcggattgcggtcggcgtagcacatgatgaggccgaacacctggtcgtcgccacccgttccgaccgagctggtgttgaaccagccatcgtcggtggcggccgtggcaagtgtggagaggagctggtcgaggttcttcttgtactggctgtcgccggagtagtttccggtggttgagcaggatgggttaaacggaacgattttgttgccctgaccgatcgccgctacgcagagcgagacgaagatcgcgaggaggaggatgagatgttgggaagccatggcaagagagtctggccagccggcgacacccgttgctaccaagtttttttttttttgagagctctccactttgagtacaagctgtagtatctgaacatacgtgcaaacgcactccaccacgcacacacactccacctatcaactatacacacacgtgctaatgagatacacaaagccacctaaggaccttgtgcgtgacgaggacgtcactctactattgtggcgctggcacgggagagctggaaatttatttgggaataaatcccggtgagacgcgcgggtgacgatcccagggatcgaacccgcgcgggctgctcgctcaccagcgatgctagccaaccgagcacgctcggttctcccgttgctaccaagttgctacggttccttgctactagtacttgctgataaatattttagcactagaatatatattgtagtagaggttaaagaaaacacgatagtatattattgaacttgataaagtgagtggtagattgtagaagctagtgcgataaactcagtggtactgagtggattctctctatttaaaatatggagggaaagtgaattcctccctcgtttcatgcatatcacataaatagtcataaaaaaatatgaaaaaaaattggcaagataaattaatatgaaatactttttctgtttcacaatgtaagtcattctagcattttccacattaatattgatgttaatgaatctagacatatatatctatctagattcattaacgtcaacatgtatgtgagaaatgctagaatgacttacattgtgaaacggagggagtatatcactccacaaacatgcaagtttaaatttaacttctataagttgtaacaaaaataacaaatatagttgtgaatgcacgataactatttttagtttaatttattatttttgttgcaacttatagaagttaaatttaattttgcatgtttgtggaataatatatttcatattaatctatgttgttatttttttaaaaaaatttgataactatttagataacatacaaacaacgaggggatgtctccttaagagatgaaaattcacataattctcactaccatatgtacaattcagaaactagagtcagcatactgcaatttgtgtgagaattattgtgtcagagggtcttttttttccacgttttggctttcgctgaggtgtgtgataaggacggaacacgggtcctctctatgttggcgtcaaaagtcagcattctggatagagaacaacgtcatctttggcccggtttagttcccaaatttttttataggttgacacatcagatatatggacacatatttgaactattaaacatagtctaataacaaaacaaattatagatttcgccagaaaactacgagacaaatttattaaacctaattaatctgtcattagcaaatatttaatgtagcaccacattatcaaatcatgacgcaattagccttaaaagatttgtctcgtaatttacacgcaaactgtgtaatttgttttattttttatccacatttaggttgtgtttagttgagggaaaagtttggattttggttgaaattgaagatgatgtgactgaaaagttgtgtgtgtatgacaggttgatgtgatggaaaaggactgaagtttggatccaaattttggatctaaacacagccttgatagttcatacacatgtctaaacattcgatgtgatgggtgaaaagattttattttgtgaactagacagggtatttgtttaatgcttaggttatatttttatttattttctacttagattttgtatactttgtgcagattgatgcagtttggacacagtcaattgtttattattgaagtacctattggaatgttcctatcgagtaataaaaatctaccgttcgaagtccatgatacaattaattaagaggaaatacacgcgttttcagtcaaccaaaatatttggtaaatattttttgtaaaatgacagatactttagggaattgactcgtattaagaattaatgactccattagtacagcacgaataagaaaatcattttttgccttaaaggataagcagacaaatctcttctttctataaagctaatgtccactaacacctaaaacttaacatgtaaaagggcatctccaagagagggctaaacaggttcctaaaagataaattttacaattttgatgaaaaacaggcctccaacagattcccaaccatggtcccaaaatttacctccgaccaaaatcatggccaatctgagccaagacttgggagcgtggacgcgctcccaatcccactaatcgtgcaacattttctctgcccgcgccatttttttgtccttccgcgcccttttttattttattagtgtcggctattttttctccgtaacttcgatggtgtaatttttataaatgatgactagaaatattcgaaacttatttaaaacatgttcatatgaagtcccataaagtttctaaagaaatatcgctagtttgaggtgtattattgctaaatgttatagttagagaaatctgaatgctttcaagttgaaaatatgtcgcaagatatataaaattaatctcagttgcagtacaacatgcttcaaaacttttacaccgttgtttgagatataaaattgagaaacatagaagaaacaacaatataaaagttttcaaataatttgaaaaggaaactcacaaatagataaggtaatatcagacatctatgcatagttcaaggataatcttatgagatataaaattaagaaatatagaagaaaaatacaaaaacaagaatagtgttatttgttaattttatttcttattaacgaagttgagtttgttcatgtaacttggtacggttgtttatttataaaatatctacaattctacatatgtaattttttaagacttttttagaacttctataaaaaaagtttccaagttttcacctaagatgtggtttccactatatatttccggcatatagaagtgaggctcatcatgaataaatcaagtggttatatctgttataggaatgaaaacggagtggatacaaacaaatatgctcttatcatatttgttttcatttttatctagatatgaaaacggatgtgaataaatcaaatacaaaatcaaatatgnnnnnnnnnnnnnnnnnnnnnnnnnnnnnnnnnnnnnnnnnnnnnnnnnn

SEQ ID NO: 35447 - DNA, 1392 bp, Oryza sativa
  unsure (1)..(1392): unsure at all n locations
nnnnnnnnnnnnnnnnnnnnnnnnnnnnnnnnnnnnnnnnnnnnnnnnnnnnnnnnncagccatgcaggtcagcaggtgctggttgagtggttgtgatactgatgatatgactagatgattaaactatttttgcccctggcttctcatctttttttttttttgcccctggtataagtcataacctttttttttcatctgttctcaggcacaacaccaaccaaaggcttgcctgaccaggcattcctattccatcaaaacctcagggaggtctcaggcactgctcaggccgtccacaaaacatgcccttaacaacatggactagtattactgggatgagacgtggattgaagctcaagttatgaagaaatgaggtatactctgcctttagcaaatatctgtattgcaatattttcaagatatccatattattactaagtgtgttggtcatgtttgttactttcggttgcaacacgtgaatgccatgcacaactgattctcagccatgcataactgattctcgctgagatgtgtaaagatgatcctgatccaaagggtagtaggtttctcgcctacttcaacatggcaaggaaaacgattttcccagcattcagaatgtaaacaaacttagtaatgtaggcaaacttcagtatcgaccgtaggtgaattcacgcaatgacatctcttccaaactcatttgttttctcctccatctcacgaaaatagtgcctaggagctctctgcccttccacatttccttctctcttacctcaaactgttggtagacttctgcctaaacaactgcacttcagagcggacacggtggaacttcgagcgtcgtgccagcctggatctggccccatccgatgagtcgccaatgcttctcaacacgacggctaagggcaaccttctcacctttgcttgtgcagacaggggcagtgagctgaagtttggcaagatcgttcttgacagcaaccacacgagcaccagtcgacatggatccgatgttaagcatgaggatttcacccttggtgagcttggagaccttcccagccttctcagtaccttttgtcctcacacccaacagcctccgaagaaggaagaagttgatctgcatgcatgaaagtccagatttaagcaatgaatgttttattctcactaaatcttgatgcaacgaagagttgacaaacctcaagctccacatagacatcaggaagtgatccaacttcacctagaacctgaccaaccagtctatcagcacgtgtcaaggttggatccatggttgttcccacaccaataagacctccaggcacagcaaattggagctcattctgctcagcatagagcgaaacaatccttgaatagattggggtgcatttgatgttgccgctttc

SEQ ID NO: 35448 - DNA, 648 bp, Oryza sativa
cggcgccgcgctgatgtacctgcaccacgaggcggagcagcgcgtcgtgcaccgcgacatcaagccgagcaacgtcatgctggacgcgtcgttcagcgccaggctcggcgacttcggcctcgcgaggctcatagacgacggccggcgctcgcgcacgacgggcatcgccggcacgatggggtacatcgacgcggagtgcttcctcctcgccgggagggcgagcgtcgagtccgacgtgtacagcttcggcgtcgtccttctcgaggtggcctgcggccggcggcccgcggtggtcatcaacggcggcgaggacgcgatccacctgacgcagtgggtctgggacacgcacggcggcgccgccgggggcggcatcctcgacgccgccgacacgcggctgaacggcgagttcgacgtcgcggagatggagcgcgtgctggccgtcgggctctggtgcgcgcaccccgaccgcggctgcggacgtccatcaggcaggccgtcagcgtgctgcggttcgaggcgccgctgccgagcctcccggtgaggatgccggtggcgacgtacggcccgccggtgtccacagcgtcggcgccccccatcaacgacacctccgcaggacggtaggaactatggtttccatggccgccggac

SEQ ID NO: 35449 - DNA, 507 bp, Oryza sativa
  unsure (1)..(507): unsure at all n locations
nnnnnnnnnnnnnnnnnnnnnnnnnnnnnnnnnnnnnnnnnnnnnnnnnnataagggctaattatctttgggagaagagaggggaggggaggtcacataggggttaggggggtgttggccctccctggcccctacggtggcttcgccactgtgtccgatgatggatcagacgacaggaaggcgcgcatgatgaggtactcggcgagctcgtcggccttcgcctgggtcggtggccggtcgtcgcgctgctccatggtccagtcatactggacgatctcgtagtcgtagtcatcttcgtcgtcgtcggcggcggcggcgctctggctgcggtgcctgacgtgctcgatggtgtcgaccggcgggagcgagtcgatctgctggccggtgacggggttgacgaggcggagctcggcggagtccgcgtcagccgtgacgatccagccgtgggagctgccccactagaacctgttgcggatggggggctcagccggcagggtcacctcgtac

SEQ ID NO: 35450 - DNA, 787 bp, Oryza sativa
tttagccttctctcgcaataaattgatgagctgaacgctttcctctggctgcgaaatatcaatatttttccttccgcatattatttccaggagaacaactccaaagctgtagacgtcaactttttcagtgatctgtgatgttagccattcaggtgccaaatatccaggcgtgcctctcatcacagtcactactttactttgatccctgtctattagcttggaaagtccaaaatcagccagtttggcattgaatttctcgtctaagagaatgttttgtggtttgatatccaaatgagcaatttttcgcctgcattcctcatgaagataacataaacccttggcaatatccataatgatcctacaccttgtgcaccaatcaagaggatcattgttgtagcggtaatatatccacctatcaagtgaccctcttggcatatattcatatacaagaagccgatttgacttctctgcacaaaatcctatcagcctgacaagattgatgtgctcaatgctgccaatagtctcaacctctgccaagaattctttctttccttgtttagcactttctagtcgtttaactgcaactctctcctcacctatttcttcttcaaagactgatccaaatccaccttcaccgagctttttactgaaatctttggtgcattctctcaacttttcatatgaaaacctcactggcattgcaggcaatggctcaaaatcaatttcttcatctatctcttgatacttccttctttgcacataaagggtgataactgtgacagccagt

SEQ ID NO: 35451 - DNA, 720 bp, Oryza sativa
  unsure (1)..(720): unsure at all n locations
tttttgtcaaacttttgtgcttgggagatgtttctagttgtttctttcttttttggttgtgtgcattttatgcagaggccggggttgactcagttcgattgatcatctcgatgtaattaaccgagtctaaataaagcttcttaattacgccacagtgagtgttttctctcaaataattttctgtaatgctaaattgaaatgagaaatcttggatggattgaaatgagacatttttgtgatccatatgctatgcaaaagcataaatacgccgcggtgagtgcttactcttacattgaattatctctaatgttgaattgaaatgataagaaatcttggatggattgtgtgtatggttagacctggagctggtcgatggggaggtagttgacgaggccgctgcagatggtgcgcggctgctcctcgccgacgtcgacctcctccacgtacagcgtgtccgcctccgggtgccgccacgccttcaccacccgccccacccggatgtccagcagcgccgccacctcctccacggggggaacctccgccttcttctccccctcctccccttccccctccgcggccgccgcctgcggggccggcgcgacggtggcgtcggagcagtagcagaggacggaggcggatctcgccgccgccaagaacgagacgggatgcttgccgctggcggcgacgctgccccgggttcttggcagggcggngagggat

SEQ ID NO: 35452 - DNA, 741 bp, Oryza sativa
  unsure (1)..(741): unsure at all n locations
caagcaacattcttttttcaagacatcaatgggccactcatacgttgcatggtactttgaatgtttcgagcatcaagacatttcgacaaagatagtttgtttagtgcatcactgattatctaaataactatatgtgcagagcccccctgaactagatgttcctctgaaactaattggcaaggaaactcaaccaaaagcgaagcctgatgaagatgttcccctaaatcttgatacattttaaggtgaggcaactttgaagtgttctagtccatatagggggagagcttattaccattttatttagatagaacaaggtcgtcctatttaggggtgaaaacggtcgaaaacgatcggaatcggtagcatctcttcagaaacgatgctcgatcggccggtaattgaccatatttatcattttaactactcaatatcgatattaatacgatgcagaaagaaattagaaaaaaaattttaagatagccaaaaacggtacggtcagaaacggtatcccttatacggaaacggcgctcggtcgatcgggaatttctatgaccgttttctctcctgttccttccttcctttctttgcagacgttatgttttaactatgtttgttggcaattggtagactgattgtattgatttttgcagggtagatcaaactggagcagttctttttnnnnnnnnnnnnnnnnnnnnnnnnnnnnnnnnnnnnnnnnnnnnnnnnnnnnnnnnnnnnnnn

SEQ ID NO: 35453 - DNA, 2533 bp, Oryza sativa
tattgactgcacacattcattctagtaaaaataggacagttaggtatcaacaaaatgtgctacaacttgcaaaatgatgtgaataaaaattttcacctacactctttgtctaaaaaacctaatcctatctatattcaaaccaaggattgaattctctttggatagaggaaatatatttatagtattttatagtactttaaaaatagagtagcggtggactggtgacggtggttctacgtaccgccccactaccaactgcctacttctttttgaaaaaaaatgaataggtagggctatagggcccatatatcaactatcccacagactatctaccttttataagaacaaaaaaaagataatgtaggccaaattgtctacatatcagtaataaatatatataaaatgattaggagataatatataaagaaaatgatgataataacgcatttgataattttctttagttaaaatcttgttgcaacgcacggacaatatgctcgtatttgtagaaatcttgtgaaccctattgaaaggaagacagccagacagggccgtgctattgcagggttccaaaacctcgtacaatacaaacaatcagcactcagttgcaactttttatatgaattgtgttagtgaaggccaatactgggattgccctttcacacaaagtagttcagagatcgatgaatcgactattctaatttaacatgaaccaacttgcaactgagctcatgcatcaacatttacattttgtcttgcaactaattaaatttaactaatcaagccatcgactcgcgcacacgagcccatctcacgcgcgcacagatttgctgccgccagtttcttccccctcgtcgccgtcattgccgcctcgtggcgcacggttccgccttcgccatcaccagagagaaactcggtgatagctgcgggagaaagaggaagaagaggagaggagcgaggaagaaggggagaggagcgaagaagaagcaacgactgacatgtgagacctcagtgtcatagagttaaaatagggtgggtagatggtgaggctgttggagcgagtaactagtttgactagccaaatcagatggaaagttagctatgtgggtgtttggagagtccgatttagatatgctgttgaagatgctcttaatctttgtcaattgggtcaattaacatgcatgccagaaagaaattaaacctaaggtttttttttgttttattcgtcctaatgagccgacctaaaactttaccaaaatgaggaggtgaagtactaaccacattggggagaacaaacttttcgtaaagggcaaagaaaaataatgattcgtgaataatcccaggtcatatgagatctctctttttttccactcatctcctaaaagacaccgtgcaatcgtgcatgctacgaaaaagatctaaaagctagataacactttgctgcatgtataatccactatatagcaagaaataattgatgtgtggctctctgctctcttggaacaaaagacgaactcactaacaccataacattggcacaaaaagatactatactacctccatttgaggttataagatttttttaacattgtccatattcatatagatattaataaatctagacacacatatatgtctagattcattaacatatatatgaatgtgggcagtgctagaaagtcttataatataaaatggatgaaatggaggaagtatatatatattaatcgatcttgaaacttttgttttgcgaatctatagtgcaactacatctggaaatcttcaatggattcctgagctagaaggatttaataattacacaccaagcaccacttggattattgattgaattagcttttgaataatatgccttttcttcgattttgatgcaagagcaatacgaggttgatctgacacattgtccatgaaagcacaccatacaccaaataaaagatagagtaaatttaataaatcctaagttttgaggcatcggtaaagtaaaatcaaaatctgaggtattaccatttgtttcataaaactctaggttttggagtaaaatgtttaaaaaaagcatttgtttcatgaaactctagattttggagtaaaatattttaaaaaagcatttgtttcatgatcgaaactctaggttttggagagtaatatgtttcaaaaaaccataggtacaaacttatattgttccttcggctaatatatttatccatagtaactgtaaaaaaaaaggcatgagatatttttcagcacatatgcacattacttgtattttcaataaatgttggttgtcgacagttcgatcatttctatgtatattaacccgttaatgtgtcattattagtggggtattgtattgaatatatttgcaatagggaaatgaggatgtgaagaaaaaagtaaagtagatgagagcgatgtgtatttagtatactatgagagcgatgtgtatttagtctactatgtgtatttagtctctcgcaccgccgcccgtgagagaaagaggggaagagagaggcggggg

SEQ ID NO: 35454 - DNA, 5381 bp, Oryza sativa
ggaataattctacaccataatagttgcgaataaatctcctccattccctctctcattgggattaaacgaatgatgccttaattgggcacacacaccatcatacgcagcatagcaaacatatacacatatagatgttctcgatgtaaccacgcttacaaaggcctggtttagttcaccaaaaaatttccaaaaaacatcccattgaatctttatatacatgcatagagcattaaatatagatgtaaaaaaactaattgcatagttaggggggaaatcacgagatgaatattttgagtctaattagtccatgattagccataagtgctacagtaacccacatgtactaatgacggattaactaggctcaaaagattcgtctcgcggtttctagacgagttatgaatttagttttttcattcatgtccgaaaacccttccgacatccggtcaaacatccgatgtgataccaaaaaatttcttttcgcgaactaaacatgcccaaattatcaaaggaaccaaagatcctcctagatcaggcgtgtgtcagacgtgcccatgcactaaatgacatacaacatacatgtatatatgtgtactcttaactttgaaattattatatatgtaaacatgagatagagtgtcaagtttaggacaatctatataaatactatagagaagggaagtactgcaactagctagtgatcatagaaagccgtcatggttgatctcatcacatggagtagcacatgcttatacaggttgtagcatctgcgccgagatgtgtatcatgtgagcttaattagctcttgaggctttgcaaaatcaagtatataaaacccatttttttaagtgacagtgcaaaagcaccacatgcatcgatcatatacacacaccagtttaattatcttggtctaggcaatgcatgtgtgagcttgataagatgttgggcgtatatatgtacagatatgatatcctggaatttagaaaaacaatggatgggaaaagagaagataaatggtgttgccggctaagcggctaattaagccacaatatgtacctagcctagagaaggaatggagaattatcagcaagaacatatacatagtgtgtcaacacaaaggagggagaagatatatatatgtgctgtaatgaaaatagatgcacaacggagacacgaattttacgtaaaaacccttgcgggaaaaaaaccacgggcaccaaccgacaatgatcagtatagaggagttggatacaaacgcaggggatacattgggctatcgcaccctactcatgcgactttcaagggatatataaaggagaaatatatgagtcctaatgggaaaatacttaagagtcatattaggaaactaatcctaatagtcaagttctattatgaaacttatccgaatatattgcaggccaaaaattcgaatcacatatttaacatgcacacatgtgtacatatatacagtatctgcagtttaatttgtgtatagagctgtaaacatacatgtggcgattgttttttccctaaaaacagaaaagaaaggaacaatacatcaacattaataaatgcatgtaactttaatgtatattcaacaaagattatgtaaattatatctcttaaaacaatatatagtggcaaacaaaacaatagctacacagaagttatgtttggcaagcaactagaaatgtttagcttgagaaaccaacatggtaaaccttacattcgaaaaatttatttatatgactaatcgcctttcataaagattcatatatcatataacacaatatccctgcacacgcatggttcctaataaagtgtaataccccttgaaatatagaatggattcaaatcacatgcatatatactatgctagctctgttctcaaaaggatggcgtcctgaaatgctgtgtcagtccatcatttcgtctacaactaattataagccataatgctcattagcaacaaaaaaaattatagtaaaacttttacatatgtgttcttgacgacttaaaagtcaatattgaaaataaactgtgttgaataaacattaaaatcaattctaaaattaagttttaaaatatttaaattttggttgcagcaaagctgaagagcaaaccatggagctaacaaacacatgtataattgactggttgccaatttacattttccgcctcctaataagctagcatttaatattgtagcacccacagatagtcatccggaaagcagtaaaccagaaaccagacacattttgtgggatggtggcaaaatgtgtataaaaccaacgggaagcacatagctagcacacgaatttaggtacctataacctgccctcctcatatcatgtcatatgcgagataccaccaaatagaaaaataaaatgtgtatttacatttctcgcttactaagctagcatattattaagagaaaattgtgtgcccctgagtttttactcatccctttcatgccctttagtttttgttttcaatcacctttatagccattccttagactacatataacagtcaacttaaaaagcctaagtcttgtgttgaaagcaatttcaactcaaaaattaacatcgaaagggatagaattatttgacacccaaattaatttgaaaacaaaaattcaaattttgaaattaattctagttatgtttgatgaagttttcaatgataatttcacttgtatctcttcatagaaatttgttcaaatttgtttgaagttgattttaaattaaaatacaaattttagtttaagatagaaacagtgatgatatgtgtcattttcccttttgtaatttcatcaaattttattgcaattcatttaaaaaatttaaattttattgttcaaattcggggtcactcaactttctccctttaagttttataactaaagattttcttctagatatattatgttcttatctatgagtgagagacaatataatcattagaaaagctcaattgagatgaactaacaaaatgagtatatacagaaaagctcaaaagaaaacttagggctatgtaagggataagacaaaactcaaaagcatggaagagatagagcgagaactgcaaaggaaagacaaagatttttctctatttaataatagagcgcacacagtttatcattcggaaagcagtaaaccggaaaccagccacactttgcgggatggtggcgaaacgtgtcctaaaccaataggagggacatcaccagcacacaaattaaggtatctataacctgccctcctcgtaccatatcatatgcgagataccgccaaatagctttagataatagaatagcttaataaaacaatgtacttgttgcagaagtcgaggaaaataatactgttggttctcacattatagtaatgctctctctacttaatttatcaagtgtgctgtcagggatgacaacaccatggcaccatcagtcatcaggacagcccaccacctttgcaaatagagagaaaacggtacaatgacaggtataaacaaagaacggatagcttgccgatgttaccatttagacttctggccaactaaattatacttcactaattaagctctaataagaagccctggctgcttaaaccagcagcagctaccttagacatctattttggagcaatagatccgccatacatatattaattatctactcgatctctccattagtctccagctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctgtacgacttctccagctcaaggttggtgattatcatcgtcgatccccttctatagttctatatgtatatagctgctacctgctaggtcatgaaatatatcccaatccttcagatttttgtctatatatctcgatgtgtccagctatctagcttttgctttactctagcttagggttttctttgattctttggatgatcttaaggtgaaagacttctgttttttttagaaaaaaataaagaaaatcgatgcatccatttagatcactccttctcccatctaaataatctctatacactattaatttgatgaattgtgtatgcatatattgactctttctgtttagtctggagcattattcctgaaagagaaggagatgcgcagtaggagctggtatgcaaggggctgccagaatgtgagaatatatttctagaaatggtgtatacgatttttctaagttaaataactcacaagttatctctagatatatatttattttgatttgtatattaatttacctcgtttcttagctgaaaatttaggttaatttcccctagatgcataaaacatttgctatatattggatcgtaatggtatagtcttcctttttgttagcatgaaatcaataatagagcggtaccaggaggcaggagaggagcattgtcggttgctgaacccaatgtcagaggctaaggtatgcattctaatataatggtagcaaatttgaggtaaattaaaaattcatttcttgaggtcatctggttttgcatacagctacaaaagttgttgactaaattgccgcactttgtcgtcataaactccattttcccaattcttaactaaaattcctatatattccaatgtcattatttgcaattatcctgacatttctacttatgtattggcagttttggcagcgggaggttacaactttgaggcagcaagtgcaaaacttacaccacaacaacaggtaaaatcaagtccaatgtcaatgatatattacacatacaaccatagctaattacacacctcttctcaagttttttttttacccaaatcttagcataaccagatgaactcaagaaatgaagtcccccgcctgggaaaatgctttctctagtagtgatgttgacctcactttctctctaaattagtttttacttgtctgcaaactatttaaacgaaaacagtgcatactactttattaggatcaaccaatatgaaggtgaaaatgaaatcttttttaaggcccatgtggaaattcatgtttcaaataaaaggtgaaaataccttttaatgcatgattaattctacgtgctatcaattctagtcacattcttata

SEQ ID NO: 35455 - DNA, 4512 bp, Oryza sativa
ttttctactcatcttcactagtataaattatgccactaattaagttcctagagttacttttcatgttcagaagttgcatgcatgcatggcaagttactttaattactgtgctcttgtttaaagaaaagtgttaactttattctaaaaaaaaagtgttaactttacagttacacagatatgtccctcattagaaggtgtaataaatctgtttgtttgcagacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatccatattatattgcaactcttacgtgtcatatatgtcatgttatatttaaacattatgtgcaaagagatcaccctcaataatgttctatggtatgtacatatatattcatatatgtatataaacaagatgatatccactccacacctccctccccctccctcacggccgctacagcatggtgtcgtaaactgtgtggctgcaaagatagctgtgacgaggccttcccttccttcccacatgctcccagaggcatatttcaaggcaatgaaggttgcgactacactgaggtggccagatgggcagagccacagaggtccgtacatttcatcaagcaaaagccagtttcatttaaaaaatccgtttgaagagaagagaggtgaagaaaagcgcatttataaagtggtgtggcaagaacttcggaggtaattaccattaaagtggagtcgcatgagataccaatgcctactggagatgaaactaaggtggccaaggcgagaagaccgcagttggagccaacgcagctcaccacgctggtttgaccgagccctccaggagtcgtgtcacctcaaggggccagtctgactgtgcagagaggtcggtttgaccagggtcatccagggagctcgagggcatcatcttcgtcggtcaaaattgctagaggtcactatattgcccccggaatagagccaaagctaagtggatgcccgcggacttgaccactactcaaagaggaggttgcaacatcttcgtgcttaagaattgaagaaaaaatagctgaaaagttgagaaacaagattcaataagttgtggttgtaaaatcaaggagttagagagacttgagttgagagaaagttagggtttcgagtttagtttgagattttggtgaggagtgctattggtgcactttgtaaacactagttgatgcaataaagtcgagaattctaatctacatcttcgagtttgtcatctaccggtgcttctgggttctgacagtctaaccgcaggtgtgcacctggtttgaccagtgggatagcggcggtctgaccggcgaggttttggcggtctgtccggcggtgaacatgcggttcgaccgactgtgacagggcttcgtcatctactccgttcgaggtaaatcttttatttcgcaaaagattttgggtttttggtttttcctaccattcacccccctctggtaggtttgtttggtcttgtgcgatcctacagtggccgcctccaagacaatagtagaggcctaagccaatggagattgagaaaccgatgatagatcaagacgatggtgaggacaaaaatggaggtgggttactggttattagcaatgattcgctgccaagacagaacatggatgtcaacatggtgtttgcattgccgatggaattttgtgtcatggatgaggctgaaatttctcaagatgtggtttttgagaagtctaatgagtctaaccatcatatgaggccactcatctcaaagggcacattgattggaaaatgatctctagaatgttggtggttggaggtgtcgtcgtaaatttgatgccacactccttattcaagaagttagggtgtgaagttgtggtgaattgaataataccaacatgatgctcaacggcttcaatggtgaaccaacgaaggcgagaacgatctttttttgtgaagcttaccgtgggaaacaatatgttgccaaccaatttcatcgtcgatgtgcaagataactatagcgttattggattcataccaattgttgtgttccttctaccttgcaccagtgcttgatttaatgggacaacgatgagattgagatcgttcaagcagatacatcggccgaggttgcaatagttgacgcgtcaattgagtggtatgggattattcaatgcttattagggttagatatttctaactataattttattagtgtttctaaagatcgttttgtacccattatttggagtggttgcaaaagagagtgcaataacatcagtctacaaagaatgacattggttttgcatcggctgatccactataagagggagacatacataatggatctattgcatggaaaacatatgaaagttgattactaggttaaagaatatgttgatttttttgaatgggaatatcatgaaatgtcgggagttagccgtgagcttgttgagcatcagcttccaataaaattggatttagaccttataagcaattgcctcatcactttaattcaaacatatatgatcgtgtcaaggaggagatagaccgattattgaaggtggaggccatgtaggtattcggagtgagtgtccaatattgtccccgttgagaagaaagggagtggtaagattagagtatgtgttgattttagagatttaaatagagctactcctaaagatgaatatactagacctattgccgacatgttgattaatgatgctttgggacatagagtcatttgctttttggatggtaatacttgttacaataaaatctttatggccgaagaggacatgttcaaaacggcctttaggtgtcccggttttgttggcttgtttaagtgggttgtcatgacgtttggtttgaaaaaggccggtgcaacataacaaagtgcaatgaacttgatcttttgtgatttgctaagtataatattagaaatttatgttgatgatattgttgtcaaatcggatggtatggatggtcatatagcctgtttgcgtttagcttttgggaggatgcgtcggtatggtttgaagatgaatccactctagtgtgctaatggtatgtcatcgaggaagttattaggcttcgttgtgcatgagagaggtgttgaaattgatcctaggaagatagaaaatattagatagtttaaagcgtcagcatgcaagaaaaaagttcaaagattgctaggtcaggtgaattatttgaggaggttataatcgatacttttgttcccatatttcgttgggaaaaagaagccgattttacatgtgaagcaaacaacaagaggcgtatgaggaaattaaaaagtatttatcacctccacccatggtgcttgcgcctaaagttggaactctgtttcggctctacattgccaactgaggacaatgtcattggtgttgtgttaacacaagaagtggattgcaaggagcatatcatcacataggtgggctgtcatcttttggatgccaaaacaacgtatgtctttatagctttgcttatgtttatattatgattgtaccaaattacagcattatctattatctagtacttgcacttgtcaaactgatattattatatacatgttgcaaaggcaaattctaagtgggagaattcacaggcaaatactttgattgaatatgatttggcttatgaatcgttcaagtctttgaaaggctaaatcatagttaattttataataaatcatcttgtggatattacttatgatagtgaggtctatttacgtagtgttacaccatggaaaccttattttgaaggtacttcttgcgaagaggggtagggtatatgtgcagttttgttttcacacaatagagctatttttgaaacatcggtttacttagagttttcttgcacaaataatcaagtatatgatgctttgttattcggcttacaagtattggaagctataggagcaaaacatgtataagtttttggtggctcggaattgatagtgcaacaagttgccggggtgcataagtgttttgatgggtcattaaatagatatttagatcaatgcttagacacattatcaccaatttttatgattttgttattagaacatgttgctagagaaactttaaggcaaatgatttggctcaacaagcatctggttatcatgttaaaaaaaaggagtattcttcatttagaaaaaaacggtgcttcaattcaagagtttggacaaaattggcgatgggccgtctgacagacgcaccggggccaatctgaccagggaggaccggtggtctgaccagcctggcatagccggtctaaccagagaccttacctgacctgatcgacctattatggctagtttaaccagattccaacaatcagctaggtgg

SEQ ID NO: 35456 - DNA, 1558 bp, Oryza sativa
ctcctgtgttctggtggatctgtgcatgaaggaatacagagagccggagagcgagagagagagagttcaggctctagaacccattccccagagtcccaaccctccttcctcttttctttcctccctttttttctccctccttctctttttttctccctctttctctttttttctcctaggcctgggcctcctttttatctggtcaggggtcactacatgggcctctagctgcctaagaagggaaacatgctttttacaatgagggctagtctacagccggaagtgacctctgacaagcagagcacacgcctcctgccccgctcgcctgctttcccggtggacgcccatttcaaccttcatttaatggccagcgacttccttgccatacctgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacctgcgatctgaccggtctgtgaccggtcacacaccgcgactggtcacggaccggataagcgtgcgcggcgccgcattaaatgcggcgtggcgcgctcgtccaacctgctataaatgcggttaggtgagccccgctgtgctcacctaacccacacacgtggtgccaaaaccacagggggtcggggcgccccagccctcggggccgaaacgggagcggtccgacccctcggggagacagagggaggggtggccacgtcatcctcgggcccgacccccccccccgagggggtcaggccacgtgggtgaccacggctacccaagcctctagtcacgatacccccggccccatgtcaccgacaatcggtcaaggagtataagacattaatggaagataatctggataatgtgttcgataaacgtttgaaacaactttagaagagatagaaaaggataaaaagagagtagcaaaaacctataataagagagtgagcaaaatcgtttcaagtgggagtttagtatgtaaaacaattttcccattagaatctagatctaaggagttcggtaagtggtcacctagttggaagggtccttatcggatattttgaatcattcgagggaatgcatattttattgaaactttacgaggagaacggtttcaaagagtgatcaatgggaaatatttgaagaaatttttcctgagtatctggtaagatgcttaggaggtaataaggccagtaattagattatcaccctaagatcacgtgttctatgtttttcggctcacaattcgacaaaaggcagggtggcatgtcttaccgcccaaatttggcacctagaaaagaaatatggaaaatatggctgaatttggaacatatcgggtctcttccgtgatgacggtctgaccgccaccataaggcccggtctgaccgacggcatggggctggtctaaccggcaacatgtggccggtcagactggccgagtctgacttcgagtttaattttatcgagtcttcgggtt

SEQ ID NO: 35457 - DNA, 2751 bp, Oryza sativa
  unsure (1)..(2751): unsure at all n locations
attaaattaagcacatttgggatgaaattacatggagaggtctagtgcgtactatataactagctaggaccccatgcattgccgcaggcatatgatgaaattagaagttatttcaatcttttgccaatcaatgaaatattctttatacatgtatcgattgttacacgggtttatatatacatgacctctaatcgtttacttatctacctaaagtgggcataactcaatcatcataacataatggaggcattgaatttgtgagagaaccatttcctccattagctaattaaagaggctaacagagcatgcatactcaattcacttcaaatccactgaaagatgtacttgcagaatatggatgaacaaattccttatacttggtagcaccaatagaaaaatctcttcatagaagcggcagcaccagcttaatgaaatacgtatttatcctactcactaattggtgagctgaaataatagacctggaggctatcaaaatataatatacccaagcaagtacattggtgtaaaatcaaaggtgtttttgattattattctgtgatgaacaattggcattggagattattggttttgatatttggaatttatttgcgaagtgattttggagatgatcgggattttacaggcgatctacaggtactgctgattgggtccggtcagaccgggcacgggttgccggtcagaccggcagtgatggagcggtcagaccagcgcagcccgcggtctgaacggccgactctgtgtcgtttttgattttgggttgtttgtttggatatccgtgattgtttcatgattaaggattctagatggatactatgcgtatgtaatactgtcgtttgctactaatgagtcaagttggggatagcttggtcttggaatatggtttctttgtttgttctatgtgtaggtgactcgagatgccgaagagtatttgaggtgatggaccgggagtcggcttggggataagcgacgtacgtggtggtcagagatcatgcgggatactaaggctagagttcaatgcacgtggttggtgaagattccatatgtcatacgatggaggtattgtgtgcgtatgggatgcgcagtcgaatttggaaggagtccaaatttggtatgattggttatgtaaagtttgtttcttgtactagagggtttcctagggtgattagaacttctagtatgagtttggttcatggcttttggctgcctacctcgggtataaatagagggggagcgtgaggcttcccagtatcgctttcgagagcaaatgagttgatagttgagttagggcttcgagtttagtcgagattttttgtaaggagtgctgttggtgcactttgtgaacacatagagaattaataaagtcgtcatctattttaagagttcttcgatttgtgtttcatcgggtttcggcggtctaaccggcatcacactggcggtcagatcggcggcaagcaacggtcagaccggcggtggcagcaggcgacgggagctgatccaggcggtcagacaggagttactacctcggtcagaccggaggtatttaggcggtcagaccagcgcatctacttcggtcagaccgcaatccatcgaatttgagggtaacatttatttccgctaaaagttttcggtttttgggtataccaaccattcacccccctctggttggcttagttattgtgattcgatcctataagtggtatcagagctttgttttcttctttggattttaaccggtctagagtttttgccatggctgctaggttttcaactaagcctcatgttttcgatggaactgatttttctcatggtgtagtaggatgcaatcttacattatgactgaggattatgatattcggagaaaagtcaaatccttatgtgattcctgaacaaattaatactgctcctttaaaaactgaatttgaacaaaattacaaagctcgcaatattcttttgagtgggatttctcgttcggattatgaccgtgtttctcatcttcaaactgcccataagatttggattgctttgagtaattttcattaaggaactaataacattaaagaacttcgtcgagatcttttcaaaaaggagtacattaaatttgagatgaaatctggagaagctttggatgactatctttctaggtttaacaaaattttgagtgatcttagatctgttgattcttcttatgatgttaattatacacaatctgagatttctcgccactttttgaatggttttgacatgtctatttgggagatgaaagttacatctattcaggaatccgttgatatgtctactttgactttggattcgctttacacaaaactgaaaacacatgagatgagcattctttctcgtaaagttgattttaagtcgagtgctttggtttcttcctcaacttctttggatgttgattcttcttcatcgaagtttccgcaattgctttgtgtaatgccatgtccgatgatcaactctaacaattcgaggaggaggacctggttttgttatctaacagactttctcaagctgtgactaatgttaggtacaggaaaagaggtggtccaaatctttgctttgaatgtggtggtacggatcactttcgttcgcgttgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35458 - DNA, 870 bp, Oryza sativa
  unsure (1)..(870): unsure at all n locations
tgtaatttgggagtcgccaaccaccttgatctgaacaaatccaaattaagatgagttttgtaaatcaaaaccggctagcggagctcatttagataaaatagagataaacacctatctcgtgggtggaatggaaggttattgggacaaacctataaagatgattcacactcctacaacaaaggcagacgatttactatacaaatcaacaaagatggatgaactagactagaaactaggcaaaaagtaaatgccatattgaaaaagcaattcaattggctaaaagtgttggaagtagattgtgtgctcaattgcaccaatcatagcctttataaatgggttggtcttatctcgtacagggccttctccatgtcttactcgggggtagagaccaattacaaggaaacccgagacccaataaaattggggaaacccgagactcgataaaattagactcgaagtcagactcggccagtgtctgaccggccacatgttgccggttagaccagccccatgccgtcggtcagaccggccttatggtggcggtcagaccgtcatcacggaagagacccgatatgttccaaattcagccatattttccatatttcttttctaggtgccaaatttgggcggtaagacatgccaccctgccttttgtcgaattgtgagccgaaaaacatagaacacgtgatcttagggtgataatctaattactggccttattacctcctaagcatcttaccagatactcaggaaaaatttcttcaaatatttcccattgatcactctttgaaaccgttctcctcgtaaagtttnnnnnnnnnnnnnnnnnnnnnnnnnnnnnnnnnnnnnnnnnnnnnnnnnnnnnnnnnt

SEQ ID NO: 35459 - DNA, 770 bp, Oryza sativa
gtgatttttagttgcactgtctaacttcagtcactatactactataaatattttttaaaccctttttgttttttatttaggcgataagtttagaaatgctatagaattttcttaaatttcacaaaagagaaaaataacatttttcacgaaaggtaatatgcttttttttaatcagcacaatctctagggtggaactttctagagtattttttatctagagaattatgctatcgtatttatcagggttatggataccacatacctaatagtagttgattaaatctcggcaggacccaccacataccatgtcttatacggaaataatcttcgaatatagaaggagttccgcataaggaaggatgaatagagttctacatggaaacgacaaggactactcgggttgtatccatattggttttcctagttctacatggacaaggggacacctattggtataaatacaagaccccctaggaagagaggggagacaatcaacatacacggaacaacagaagccacaacatacaagccaacatacgccaagacaaacgccagatatcgacaacagagatatacctggatcgaccctatccggttcctacagaggccgactgtagggatctagcgttgtctctgatctcgccggacacgaactcgaagaggaagactgccttgttgtcgactacgagtcagaccttcagaccgccatatcgacaacagttagataggctaccccaaatattgtattggtgggattatgatgaataaga

SEQ ID NO: 35460 - DNA, 5759 bp, Oryza sativa
  unsure (1)..(5759): unsure at all n locations
agaaggagttccgcataaggaaggatgaatagagttctacatggaaacgacaaggactactcgggttgtatccatattggttttcctagttctacatggacaaggggacacctattggtataaatacaagaccccctaggaagagaggggagacaatcaacatacacggaacaacagaagccacaacatacaagccaacatacgccaagacaaacgccagatatcgacaacagagatatacctggatcgaccctatccggttcctacagaggccgactgtagggatctagcgttgtctctgatctcgccggacacgaactcgaggaggaagactgccttgttgtcgactacgagtcagaccttcagaccgccatatcgacaacagttagataggctaccccaaatattgtattggtgtgattatgatgaataagagcaataccggcttcggccaacaggatgtagggttattacgtgacagcccgaacctgtataaaaatccctgtctccatctcttttacttcagtttcacgtataccctagtaccaacgatccccatactatgcaaataccggaatcgcgacatcaaacatcgacagtactgtaaaagagttttggcaccgcttaaacttttgaattatccataatcctcacgttaagatatctataataaaaaacatatgccatactccctccgtcccctatataaggtattgtgatattttacttatactgtttgaccattcatcttatttaaaaaaaattgaaattattatttattttatttttgacttactttattatccaaagtattttaagcataactttttgtttttatatttgcacaaattttttaaataagacgagtggtcaaacagtgtaagtaaaatgtcaaaatctcttatattaggggacagagaaagtatataacattaagtttatctactcatgcttaaaaaaatgcatatttatgaaaaccaatttacaccatcaaccaaacataggcggacgaacatcaagttttttctttatcctaaccacgacaattaggttgtgtgtgtttggctcaaagggatgggaattatccttcacacacacaatacacaacgactcattatcatatgatttattaaatattaactaaaattttgaaaaataattaatataattttttaaaccacttttctatagatatttttttttaaaaaatatacagtagtttgaggagcatttgcgtgaaaaacgagagaatagagtacaccaaagaaacacaaccttacaaattacataaaccaactcataggcaggcatgtaaatatattataaatatagatatggattctaatccctcgagacaacactttgcctctattcgagaacccaacagaggggagataaagtttcgggtattcgtggcacgcttcttaaactgttaaaatgtgcgattcgtgcgaaaattttctatatgaaagttattctaaaatatcagattaatttattttcctaagtttgtaataattaaaattcaattaactacaagttattatcacctcgttttacgtacaacactagttgattcacttgacaaacaataaaaagatgtgagcaagggggttttgaactcccgacctgcaattccttcccaggatctcttcccgcgtgtactccgtcagctccaggaagctatccgacgcgaagatctgcacaacccccccacaccacacccattctgtcagtcaccaccagcacacgcaaacacgccggcgaccggcgagaagaagagaccggcggcggcgaagtggctgcttacgatggggttgtccgggatcctggggtcggtgatgacgaagttcttctcgatgcgctccagcgtggtggccaggtcgatcccctgccggatgtccttctcccgctccgcccgctcccagctgtccgtcctctccaccacctccggcgccggcggtggcgccggcgccggctcctccaccaccgccggcgcctccctgctccccaccgagctcctcttcccgatcttgaacctgccaaagcatggacagacacaactctcagtgtcactgccgtcccggcaatctgtcgaacaggtggggtgcgagagtctgaccccatgagggaggagcggccggacttgcggccgctggcgagccggctcaggcgggactcctccttcttcaggtcccagagcggcgacttgaaggacccggctcctcctcctccgcccgagggagtgccgggtgccacgaccggcgacatggcggccatcttgtccgcgtcgctcatcttgggcggcgtcagcagcgccgcgtcggccggcgcgcgcgccccgcgcggctgcttcaccgtctgcaccacctccgtcatcgacgacatcgccttgtccttctgcctctctgcgctccacacacgccaatggcggcattggtaagacaagagaattagagaaacatcgaggaaacagaggattccgcggcggcggcggcggtgctcaccgtcgtagcggatgagcgacaccggcaactcgttcggccgcatccgcttgtcgctgagcccctccgtgtacttgctcacctccacctgcatcctgttcgctcatacccgaatcagaatcgcagcccagaactcgaatgcaaagctcatctcatctcatcaatggcgacgaacgactagtgcttcgcttacttacccgatgaacttgatgaccttgccgttgtcgtcgcggatgggggtgacggtgaggaggttccagaacggggcgccgtccttgcggtagttgagcaggcggccgcagaagctgcggccgtgcttgacggcgtcgcggatcttggccacctcggcggcgtcggtgtcggggccctggaggaagcggcagttgcggccgaccacctccctgggggagtagccggtcatggtgaagaacccctcgctggcgtagatgatggggcagtccgggcgcgtcgcgtcggacaccacgaacgtctgctgcaggctcgacagcgcgtccttgagctcctgcgacacccgcggcagggagtcgtgcgacgcgcgcccgacgccgccgtccaccgacgacttgccgctccccgtgccgccgctgtcgcgccccgccgtcgccggcgccaccggacgccacgcctgctgctggtgggcgccgctgcttccgctaggcgcatcctcggcgacgatctccaagccggcggtggcgccgccgccgccggaggtggggaacgccatccacttctccaccgcgtcgactatctccttcgagctgctgctgcccgccatggatgccgatgagattgtcctcggctatttatcagcgaaggtgtagcaatcttggccgtgcaaccatcgattcttgctgcaaacaacaccaaaaaaataataataatcagaaaattcatacattacactcacatccacccaaaaaggaacaaattaatcatcacaaaaccatgcaaccaacccttgctccaacaaatctaggacaccacgagaaaggcaaagatacctaaacagaaggattcttttgcttatctagggagtactataaaaaaaacccatccatttttttcactgttcaagttcagaaatgtaaagaacagcaacctgacagaagaatggtacaccaatcaaaacacccctctctctctctctctctctctctctcttcactgttccattaccctatccacttccttatctgggctactggtctaccacttcttccaactcaacgagaagccacataaaaagggaagtaagacgagagagagacaaattaatcagcaacctctcttcaggcagcgagcgagtgatcgatcgattcagattcaggcagcagacagcagagtactcaggtcactagctaggctgataggcttggatcgataccaatccaatcagtcaggtggcgccggggagacgagggaagaggaagaggaagaggaggaagcaagtaggcgacagaaagaatggcgggcgtagcagcagcggcggcaggtgaggataatgcaatccgcgagcccgtgagcgatcgagcgactcacggtcgtctcgccgggattctgtggccgcggcgcggccacctcgccccccggccggtgacggcatctccgcggccctcccccagaaattattgctcgggtggtggtggtggtggtggtgagaggggtgtgacggcgacgggcggcgacgacgatctttttggggcgggcctgcggccacgcgggtgagcacgacggtagctccgacggattgagatactctacattaaagcccatgtttagttttcacgcaaaaaattttcaccccgtcatatcgaatattttgacacatatatggagtattaaatatagaaaaaaaaactaattacacaaattaggtgtaattcttttaagcctaattacaccttgatttgataatgtggttatgtggtgctacagtaaacatttgctaataacatattaattagatttaataaattcgtctcgcagtttacaggcggaatctgtaatttattttatcattagactacatttaataattcaaatatatatccgtgtatctgatgtgacacgctaaatcttttcacccctaaactaaacaaggcctaaatcagataattttaagtcattaatatgtggagctcatagtaaagaggtcccacatataagtagctcaaagtcatgtagtaactcaatccggctccgactgcctgatcgaggtgggcggtgaagagaggggttaaccgaaatcaacgcggcgcaggtgtgggagaagatgactggagatgacgtagtacgggacgacagagagcaatcggtggtcctccgtaccgtcgctggatgaatgaaagctgcacacgttggtgtagtttttcttcttttctttttttttttatcgcaacttgctggtacaagttcgatctccaggacaaactgtatcatacaaatttcattaccgattggagtcaaaatgtcaaacaaacactcacttgggtctaacgagtgtaaactggaacaagcacaactttagaaaaaaaggccaaccactaacggctagcgcaaattatttttttagcggaaaacaattttcgttggtggtagtgtaaagagacccattagctaaaatatttttgagtaaaataatccactacttccgaggcccgccagatgcctatctgggatgcccaattgaaataacactgtccggcccaattgtgcaactgggatgcccatctttagatgtgggattcgaacttaagatctctcactgcaatcctcacgcacgttaccatcccacctactacacacatctgatttggatatatatgcttcttttttaaactaaccctggaagcatctttagtccgtgttggtaacaccaaacatgactaaaaatatctttagtccgggttggtgttaccatccaggactaaagatcaatgtttagtccgagttggtattactaaccgggactaaagatccctcatctttagtccaggttagtaatagcaaccggaactaaagtgatgatctttaatccaggttgttaacactaatcaggactaaagatcgttaggggcctgacacggtctgatagctattgaactgtggctaaaaatgatctttagttccggttgggggcctgacatggcctgataactattgaaccgtggctaaaaannnnnnnnnnnnnnnnnnnnnnnnnnnnnnnnnnnnnnnnnnnnnnnnnnnnnnnnn

SEQ ID NO: 35461 - DNA, 5497 bp, Oryza sativa
tgcaagattaacaactttatgaatagatatatcgattgctacagtgcaacacaacatcttgtttgcttgttattgaattgttaacattttcttcacaaaattatagttatctctcctcatcagaagatcaagccaccataagttacataactcacctctcttcctcgtctccgatctattgtctttgcccccacctcctaaccacatagacaaatttctcctatgtgagcaacgttgacaaaccaaccttctcttctcccatggctgagccggggccataaccacctcacagtgacctaccgtggtcacctcctattgcagggatttcaagccatacagcttcaccctaccccaaaccctcttcccgcctctgctcttaaccctgctgaactaattcagcatgctttttggagtaagtcattgccaatgtcgcatcaccactagaggaaatcatgcatcgttgctagaagaagccgcaggtgagttctaccatcagtatcccgcttctccctctcccatggctagaggttgaaaatggcaccttgaccgtcagggagcaaagtcgatagcaaaaattgatctaataattaccctttttccttcgaaagagaagttaatgattagtttttaatgaatgaaaagagaagttcatgattagttttgaatgaattgattctagttttgtagataccatattgttgtacacttgaaagatgtggtaccagtcgttgtacatgatggacttgtttttgggagatcttgcgatcagactcttgtatggaccattcgtttagtgtaactaaacgacacataagatagatacagtgggggtacaatgttcaaagaaagccgtgtatcttggagctgtgctcactgtcaagccttaatttgtatactagaaaacagttgtaaatttgagaatatctcctttcagactttgccacagatagagaacttgtcgggggaatgatttcccttgttaatgcatggacagcccaacataatgacctaattagctagagccaaatcgagaatgaacaaatctataatctagagtctagataagcataaaagcatatacatgtggtcctatgaaaaatataaaacatcgcatgctaaaacttgcaatttcgtattgttgtgcaaatcaaattaaatttagatgattgatagaaaaattaggggactggaaagtataaacaaagtgatctcattgcaaactttgaattattttttattacctttattgatggtgagtatggaaaattttttgcaagaattttacttgaaataaattgttttcactacaatttttgtgaaatttctcgcgttttaaaggaatcataattattatattattcctcagggtaattaactttaatgataagtttttatgaaattattgattttaagtctgcatttttttaatcatgtgaaatatggacacctatgattgcaacgatgatatggacatgctttttggcagttttgtcactacagagtctttttgcagaccattcgttaaatactaattattatggcacttagaacagacacaatggagagcactgttcagcgacagcggcttatattggactggagcactactccttgagcattggtctcgtgctagtttgcatgcctcaagaatttgaaaattatctcctttaaatcggttcctgattcccctaaaaaaaaatcgcactacaagaaaaatactctgtatagacatttttctagtactgtagaggcacttatcaaatgcctttacaacaatgtagaggcattttaaaaaatgtctaataagtgtcttatggtgaattgtctctacaaacgaagagacattttataaaatgtctataatatggtagaggcattttttagagacactaaattgtaccgcaaacatataaaaccagtccaaaaaagagaataaaatagtttccttgcttttgataagtcttgaactcatgatcttttggttaaatcattttattcttcgatacactaaccaactcaactccatgtcattacttgtatacttgttcctttaattacttatatttagtcgtttagtacacattatcattctaaaaagtgtctctatatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctataaagtgtctctacactataaaacttctgattgtagaagcaatttacaaaatgcctctacaaaagtgcctctatacgaggtttttgttgtagtgtaaaagtgcctctatacgaggtttttgttgtagtgtcggttcctgactgataaattgttggacaatagttttcttggccgacctgttcatgacaaacctgctccaaaaaaaaacattatttcaatgaaaatagaaaaatgtattgggtttcaaaaaatatggcaaaactatatagcgccatgttgtccatttggtattgaaagtccatattttcaagttgaaagtcagacattccgtgttgaaagtcgaactacctgagcatcaattttggtgatttgtgcaagtttatgattttgaagaaattgcaagacaggtttgatcagttgaatatttccatgagtgtatataagaattctcagaagtttcaaaatggtcttgggatgtcctaagcttaccattaattatcgacatcattgaagagataatgcgatgtagaaagatgtctgattcttgaaacagtaggttcttttgtctgaagaccatgacaaactgaattaacacctagaaatccaattactacatcatctagcattggatacgaaggtacgttactcagaagattgagtggatccaccacgatggtaattgatgaaacctacgtagacaatgcttatccaaatgagtgccttccatgaattctgatcctttgcaaaataggtcctccaacggtaaaactagatttggattcttagcaaaaattagttccacatcgttgtagttcgcggcttttgctgtatatatatcgacaaagaaaatcgctataaaattatttttttaacatgatataaatgcatgtgtttatataaacgcgcgcgcactcaccctataaataattagccgtgaatgcgagcacccataccaagtttagaatttgaacctaggtggttaggttctagcacaagaaacctaactaatttagctacgctcatttcacaaatcacgatacactttaagactattattaggcgatattaccaaatacattatatgtagcatgttgacatagtcttcatctgacatggcgcttacgtggaatcacatacagaaaaaaactaaataagacctacatatcattgacaattttttttaaaaaaatctatggcccatatgtcaaccatagtgtgaggcccatatgtcatcttctctctccctcgcttcttcctcctccctatctgtgtcttcctcctattccatcttccccctttcttgcgtttgactggctggctctctcccatccccacttctccacagtaacgaggatgcattggcaacctcgacctcttcgggccatcagtgagctcgggtgctccaaattctgtggctcttggctaagagacagaggcagacgatggaggtagggaggcagtggccaacgaaacctagacgcctctgtcactaacttcttcctttgagctccgtgactcttagcgtatagatcgaggcagacgcagagaaagggaggtagtagccggtgaaccccatcgatccccctctatcgttgaccttcgcctttgcctatactccgtaccgaagcggcatccaccgggggatgacacttcatatgatgcactccccgtcttgacgctcctctggctccccaccgctactctcataggttgtgagccaatgggcaaggagcagcacgacgcgacggccatcggtaggggagatgaaagcagtatgatgcgttgtggtgtggagaagcttacggttgtttggcagcgggggtgcatatctggttagcgtggttaaggtcatgggcaatgtggcggagctccgtcatcggcgtgccctggacctcttcttcccctcccgcggccaagttctctctccctaccaccttgactctgctgtcctaggtgccttcttccagccgctccccaccgtcgctctctccctacagctgcctggctcgactcgtcgctcatcttgagaaaagagcaccggtagagattgacggagcgtggggctcctcaccggaagaccgcgcaggtccccctttgccggttcggccgggggcgctaagtgaggttcttcaccctcgatctgtggaatgttcgcgagagagccaatgcacaagacacgggcgatgtagacaggttcgggccgctgagaagcataataccctactcctgtgttatggtggatctgtgtgtgaaggagttacagagagctggagagcaaaagagttcaggctctagaacccctcttcctctttctctcctctacgagctcaggtattctcagagtcgtccctcctattcttgttctggatctcgatcctcttcttcggtgggcaaggtcctccttttatatctcaaggggataccacatgcaccacttctacctacccttcttttgggtggggatccaccctatcttaaccataacttggctcgcgcctttgcttggaagctaaatcacagcttgtccttgagtgaggcccagcgccgtcactcgcctgacacaggggatcaccctgtcattcctccattaatgggcggagatttgcaatggccgctgtccgaatgaccctccgatgggatgggtcatacctacctccagttcgccggaagcagatgcaacgtgggagcacggtttgtctgctgatgacgtgaccagcgtcagaccagtcacagaccggtcattcttgtccaccacgtgtcagtttagcatgccgcacgtctgtccttcttcatacaatgacttccttgcaatggttgcgatgaagcctggaatgtatctggccgggactggcgtgctaactccaggagttagcacgccggctccggctagggacgagtgcctggaggctctcatcattccgacgggacggggcgaggcgtgtgacaggccgcctgctgccacctaacccgcgatccgaccggtctgtgaccggtcacggaccggataagcgagcgcgctgcgctgcattaaatgcggcgtggcgcgctcgtccaacccgtaataaatgcggttaggtgagcgccgctgtgctcacctaacccgcacacgtggcgctaacaccacagggggtcggggcgccccagccctcggggccgaaacgggagcggcccgacccctcggggagacagagggaggggtggtcacttcacactcgggcccgacccccccccccccgagggg

SEQ ID NO: 35462 - DNA, 531 bp, Oryza sativa
cggcggatcgccgtcggggctaggcttacgcaggccgcggacgacggctacgaccgcggcgggggtgggcaaagccgctccgccgttgcgattgggctgggcttgggcttgggcttgggccttgggatatgagcctagtctgacccaagatcagatgtcacgagtaccgtgtttagtaggtcacaagtccaatttctgtcacatgttgcctgcctttgtagtgtgatttttagttgcactgtctaacttcagtcactatactactataaatattttttaaaccctttttgttttttatttaggcgataagtttagaaatgctatagaattttcttaaatttcacaaaagagaaaaataacatttttcacgaaaggtaatatgcttttttttaatcagcacaatctctagggtggaactttctagagtattttttatctagagaattatgctatcgtatttatcagggttatggataccacatacctaatagtagttgattaaatctcggcaggacccaccacataccatgt

SEQ ID NO: 35463 - DNA, 750 bp, Oryza sativa
cattgctataatttggacaaacttatgttgtctacaacgttagagcatctcgagtgtatgaataaatcaaaccgtcgcgccacaaaacgaaccgaacacattggggagagtcgaactgtatatgtcagaagactcgaaccaagccgaataaaaaaaatgcaccattgcatggtgagcacatacatactgatgcgtggaaagaaaaataatactgcctctatttctaaatattggttaccgttgactttttagcacatgtttaaccgttcgtcttattcaataacttttgtgaaatatgtaaaaaaaaaacttttgtgaaatatgtaaaactatatgtatacatataggtatatttaacaatgaatcaaatgatagaaaaaaattaataattacttaaatttttttaataagacgaacggtcaaacatattaaaaaaatcaaacgcgtcaaatatttcaaaacggaggaagtaatttagttggctttctctttgctcagaatgagtggtgggagccgcaaaccggtgtttacactgtgaagttcgaacactcagacacgctactgattttgcacagcaaaattgatggcacactggagatgcccgtatagttgacaaaaatgttacacgcactgacaataacaacattataaagggctttcacagtgcggggacgtagcgagtttcttcgcactgctagctagaaaaatcgccacctgtcaaccgggagtgcaccccactagagtccctcg

SEQ ID NO: 35464 - DNA, 476 bp, Oryza sativa
aaccacattatcaaatcaaggtgtaattaggcttaaaagaattacacctaatttgtgtaattagtttttttttctatatttaatactccatatatgtgtcaaaatattcgatatgacggggtgaaaattttttgcgtgaaaactaaacatgggctttaatgtagagtatctcaatccgtcggagctaccgtcgtgctcacccgcgtggccgcaggcccgccccaaaaagatcgtcgtcgccgcccgtcgccgtcacaccccttttaccaccaccaccaccaccacccgagcaataatttctgggggagggccgcggagatgccgtcaccggcccgggggcgaggtggccgcgccgcggccacagaatcccggcgagacgaccgtgagtcgctcgatcgctcacgggctcgcggattgcattatcctaacctgccgcggctgctgctacgcccgccattctttttgtcgcctacttg

SEQ ID NO: 35465 - DNA, 471 bp, Oryza sativa
aaacatctctggatcatgcgttgataagttgctccagcgttctttagtccgaaaggcatggtgatgtagcagtaggccccgaagggcgtaatgaacgaagtcttcaagcagtcggattccttcaatcggatctgatgatatcccgagtagcaatccaaaaaactgagcagctcgcagccggcggtcgagtcgactacctggtcaatgcgagtttgagccatcgcgatctcgcgggtttgagccatctcgcaactttccttgtcacatgtgacagcttgcttgatgtcgctccgtaggaatatgactcctcgaggaccgggcatcttcatcatcatgtaggtatagtgcgggacggccatgaacttggctaacgccgggcgtccgagtatggcgtgatacgctgtcctgaaatcagcgacttcgaagcagacgttctctgtgcggaagttctcccgagtaccaaaagtgacc

SEQ ID NO: 35466 - DNA, 942 bp, Oryza sativa
  unsure (1)..(942): unsure at all n locations
ttgaaaagttaagagaatgcacgaagatttcagtaaaaagcttggcgaaggtgaatttggatcggtcttcgaaggaaaaataggtgaagagagtgtagcggtgaaacgtctggaaggtgctagacagggaaagaaggagttcttggcagaggtcgagactattggcagcattgagcacatcaatcttgtcaggctaattggattttgcgcagagaaatcaaataggcttctggtatatgaatatatgccaagagggtcacttgataggtggatatattaccgccacaacaatgctcctcttgattggtgcacaaggtgtaagatcattatggatattgccaagggtttatgttatcttcatgaggaatgcaggcgaaaaattgctcatctggatatcaaaccacagaatattcttttagacgagaatttcaatgctaaattggctgactttggactttccaagctaatagacagggatcaaagcaaggtagtgacagtgatgagaggcacacctggatatctggcacctgaatggttaacatcgcagatcactgaaaaagttgatatatacagctttggagttgttctcatggaaataataagtggaaggaaaaatattgatctctcacagcccgaggagagtgttcagctcatcaacctattacgagaaaaggctcaaaacgatcagttgcttgatatgattgataagcacagtaatgacatggtgtcacaccaggaggaagtgattcaaatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35467 - DNA, 1347 bp, Oryza sativa
  unsure (1)..(1347): unsure at all n locations
nnnnnnnnnnnnnnnnnnnnnnnnnnnnnnnnnnnnnnnnnnnnnnnnnnnnnntgaagataacataaacccttggcaatatccataatgatcctacaccttgtgcaccaatcaagaggatcattgttgtagcggtaatatatccacctatcaagtgaccctcttggcatatattcatatacaagaagccgatttgacttctctgcacaaaatcctatcagcctgacaagattgatgtgctcaatgctgccaatagtctcaacctctgccaagaattctttctttccttgtttagcactttctagtcgtttaactgcaactctctcctcacctatttctccttcaaagactgatccaaatccaccttcaccgagctttttactgaaatctttggtgcattctctcaacttttcatatgaaaacctcactggcattccaggcaatggctcaaaatcaatttcttcatctatctcttgatacttcctcctttgcacataaagggtgataactgtgacagccagtacaaggataagaattgctgaaattgttgcacctaaaattgcctttgttttgtttgctgtggaagcagaagcagaaggactaagctgcaccttgaggtaagcagaggagttgtaatgaagggcttcaggttgtatcgtttgcaacgagaagacctccgataccgagaagcatgtgccatcagaatcattctggccatacctgaacataacggccctgcaggagcaattcttcaagcaggattgcttacagtcatctctgtttgttgcattcaggatggtgtggctgacatcgaagtatgaaacatcagtaagggccaagagctgatggcttcgcatttcttgacaagagattggtgtcagtggtgagcaaccaagatttgcctttcgctcgtcgaccggcttgaagtagcttaaactagaattactctgaaggggacaggtacattgcccacctgtgcatatcccgtattttccgcacgccattgggaaagcacaatcatcagggaataccttgattacatcagacacgactgtccactttgctcctgtattagaccattcatacagcctcaagtgcccatcaaactctaacctcatatactgggtggagctggcttgtggcagtgagatattgcttggctgagtggactgcacaaatatgctaaggctgccattggtgaaggtaaccttggttggatcttttccactcttgtttgtgttcactgaatgagaatagtagagctgtggtggtgtggattcaacataagcaaacaatccatctggttgaacagccatatacacctgattctcagtcgaatttgttgta

SEQ ID NO: 35468 - DNA, 4405 bp, Oryza sativa
  unsure (1)..(4405): unsure at all n locations
gccgcggcattgttcacccaccgcgtcgagaggttggcagtggaatagtcgtcccgctccgcagagaccggcggtgctatggttgcgagtgcgatgatgccgatgccgatgatgaagaagaagaagttggccgaaagcatggtgcttggatgtgaactgagaatgcgatgaagaaccaattaagcaagaaacttggggcatttctgccagagatgagagaagatgttgtcagttctcacctgatgtcagcatggcaatggtggagatgatgcggtgaccggcaaaatggtctcaccatcgccaaggtcaccggactctggagtctgcagtggtcagctacttgtcttcttgatctctcagtaagttcacacttcacaccaagctgggctagattattatggttttggtttatctgtgaagacagattgacttgaccatttctctttggggggggaggggggggggtcaataattagccgtgccgacaaatggtagtcgtttccatgtaccaaattgctgatatcatcaacattaacaattcaattcaggcgttgtccctttcagtaaaaacaattgaggcattgtccttgcatataaagaaggcaattcaagagcaggtattggtacggtagtaaggctggtaaggaaacacgggaactgacgaactgtattgtttaatttccaattcacgcgttccagatcttaaattggttgtaaggatcagttcatatgtagatttttccagttggtatgatcacagtatcacaccaatatgattgtgggatcttggtcaaagtttccattcgatcctgactgcttgtacagactctagtggtttatatattaaaaataactacatgtacatgtccatttattacaaaatttcactctttcatctgtccatgtaaggggttttttttcataggtaaagaataaaatttctactgcatgtttttataattaaaaggggtttcagaagtataactttacaataaatggaaggtgttgatgataccataacttggagatggacgagcaatgggaaatatagtgcgagatcagcctatatagcacaattcaacggaaggataagctcagctgcagcaaaactaatctggaagcaatgggctccctccaaatgcaaacactttgcctggctgttactacaaaataggatttggacaacggatcggctgcagatcagacaatggccaaacaactatttctgttaactatgatacaggaacctagaaacaactcaacatctcttcaaggattgtccttttgtgcggcaggtttgggagagggtcctagggaggctgaactgcaatgaaattgacctgacacatgatgaaaatgaatcgctgttgaactggtggattaggagaacatctcaaggtgggaaggaaaaagctaaggcaaaaaaatcaatccacatgttggtagcatgggaaatatggtgtgatcggaacataagagtatttcaaaatcaagaaaaaaccctgcagcagctactagacaagattcatgatgaagtcaagctatggagaatatgtggagcaacaaacattgcgagattatcggcctaagaccttttgattgattagtgtttttcttgtttctttttatttcttcttttatttttcttttcttttatttttctttttccttttctccttcaccgtttggtgatcatgtaaatagtttctcccctacttaatataacaccaacaatgctggctcggttttcaaaaaaaaataactttacaatacagaagtattcatacattttagattttctttttttttggaatacgcaaggagcacatttttttccattatttacaatgtgaaatgaaaaacaagcacgggactggtactggaggctagggatctaatggggatatctcgcgctagatttggctaccacgacctcgcagaggtaaaactgaagggacccctacatttgccgacttccaaagcacggcttctttcgccatcgctttcgccaattcgatccaagacttgctctgttgatggaagatccggttgtttcgctccttccaaatcgaccaggccaccagcgttgcaatagtgtcaaattcccggcgatgctgctctctcaacttcatccggctttcacagagccagaggtgggtagacagtccggattgcctatcgctcttaatgtccaacaccaaagctgcctcgactcaggtcagcctaccagaatgtggtcgatgctctcctcctgttgatcgcaaagaacacaacggtctgggtgaggcaacccccggctccgtagatgatcagcggtccaacatctgttcattgctaccaaccacaggaagaagcggcatcgaggtggagcaaacgatttccagatcggggtcaagaggaaggagatccgaccaaagaacagagccttataagaagatattgagctgtactgacacgagctttcccatttccagctgaaagaatcaggagtggtagggttacaggtcaccgattggactagcgaccaaagcttcagattctccaggatggcttgaatcccaagtgccccagcgatgtccccgatccatcaacgatccgttagtgcctcggccaccgtccggcgctggtgcacgtgaggcgaaacacgatcgtagatgttaggggcaatggatcggatgcagccctcttgcagccaactatcctcccagaagaggatcgtttgtccatctcccagctgacagactgtggatgcagccacgaagctcttctccttttgcgaccccgggatgtctaggcctagccatggtttacttagtgaagtccgttgtagccaagtccatctggagcgaagtgcaatacccatcaactccagatttggcaagtctaaaccgccatagttcttaggagcacagaccctcgaccaagcgacccggcagcaacctccattggcttgcgccttgcctgccagagaatcccgcgtcggatcttgtcgattcctttgatcacccacttgggtgcatcgatagtaatcagcaggtagattgggattgcactgagtacaaactgaaccattgttacatgacctatcaacgacatttggttggatttccaagctggaagccgccgggctatgctgtcaacgaatggctgcaagtcttctttcttcaacctgaagatggaaaggggtagacctaagtacttgcaggggaaggatgcaacatggcagggcaattccggctgtatcccagcaagcaactcctctgagcactgaatcggcagggttgaacattttccaaaatttgtccggagcccagaggcctcaccgaagacgtagattttctttcaaaagaatcatctgaaagaattatgcaggatcttacatttgtaaatgaatcctgcaatttgtgatatcctgcctggaagaattatgtgccctattcaggagtcaggacacaaaatatgtaggtattttagcctaacaaatatgtaggtaatgtctcgatgaaagcacttaacattttctttgtctgtatgtgtttggatggttgctttttcttaaccaaattgcaacagtaacataaaatatgaaggttaacccactaaaggacataatttgttgcaccaacaatgattatttctcatactttgatgaccggcgtggtttacaaaaccatttgaaggttgaaatgttagttcctggcgaattaacgagattaaaaaatgcgactgtataatttgtaaaccaaaatctgaatcctagcggacagttcaagcaaactaaaaatggatttcaaacggcttatggagaaaaccgatcagtttgagccaaaaaccaacctgtgtaaaaccatagaataaatgtaagaacatttagaaaattgaatggaatttaggaaaatctggaaaaatgagaaagactagcaagatcattgctataatttggacaaacttatgttgtctacaacgttagagcatctcgagtgtatgaataaatcaaaccgtcgcgccacaaaacgaaccgaacacattggggagagtcgaactgtatatgtcagaagactcgaaccaagccgaataaaaaaaatgcaccattgcatggtgagcacatacatactgatgcgtggaaagaaaaataatactgcctctatttctaaatattggttaccgttgactttttagcacatgtttaaccgttcgtcttattcaataacttttgtgaaatatgtaaaaaaaaaacttttgtgaaatatgtaaaactatatgtatacatataggtatatttaacaatgaatcaaatgatagaaaaaaattaataattacttaaatttttttaataagacgaannnnnnnnnnnnnnnnnnnnnnnnnnnnnnnnnnnnnnnnnnnnnnnnnnnnnnnnnnnnnn

SEQ ID NO: 35469 - DNA, 13209 bp, Oryza sativa
gactactatagggcgaattcgagctcggtacccagaaaaaaattaataattacttaaatttttttaataagacgaacggtcaaacatattaaaaaaatcaaacgcgtcaaatatttcaaaacggaggaagtaatttagttggctttctctttgctcagaatgagtggtgggagccgcaaaccggtgtttacactgtgaagttcgaacactcagacacgctactgattttgcacagcaaaattgatggcacactggagatgcccgtatagttgacaaaaatgttacacgcactgacaataacaacattataaagggctttcacagtgcggggacgtagcgagtttcttcgcactgctagctagaaaaatcgccacctgtcaaccgggagtgcaccccactagagtccctcgttcccacgttgagatacgctattcttcccctcctaagtccacgcgcggcggagaaagagcttctcgtgtgcactgtggagggtgtggctctgtcgcgcgcgttcccctcgcgccgcctgggagaagaatcccaaaattgccctcccgcccccacctatttcttcctcccgcgcaagatttcgttgctcccacgctcacatggttgctcggctccgtgggtgggagtccctcacgcctcgccctctccaattcacggccaactcgccatagccgctcgcgccaccgacagagttgttcccatgcaatcctcaccttcccctccagagaaacccttgctcgagctctccctcgccgtcgttgtctgcaagaggtaagcaaaccctagccctgcatggttaacggtggcgcgccgccgagggatgggaggataagaagcgtggcaggataggagacggatcgacgtggcggatggggaggagaagcggcgccgtggatgtggaggagaaacgatgcgcacgagtggggaggaaaagtggagcggcgcggcggaaggcagagcgagcggcgctgaggataggaacgcggattggagtcgatgcgtcacgagaaggaaggggcagatggggcagattatctgtggcccattcggctggggcaccggctaggtatgtatttgtgggctgtgttacctcactaataacataatccagttaagccatttaaaagaggtcgcaagcactgtggggatgcatggcctatggatgattccgggccaatttcgtggataaatgggctagaggcacgttaggagtaccttgtcctatgagtgtcttaaggccacgagtaatgtagaggaaccaagtagtatatatagattgtcgaaacaagatttcggtaatacttaaagggggtggctatcaagctagaaaagtggatgggtttgaaaacaagaaattttatacaggttcaggccttcttattcaagaagtaataccctactcctgtccggggatgattccgccgagtatatattgatcgtatgatctggggaaaaagaagtgtcccgagaggaacccggacccctccttatataggggaaggggtccgtattataaaatacagtccatatcccaaacggaatatatgattacagataaaatacaatcgtaaccgactaagatcccgggtatttccttgacatacaagtttaaaaactaacccgaatcctcgtaaagatattctatctatatttggtgtcgtgtacccaactaaactataactgccatgtagatatgggatatctataatctccacagtagcccccgagacctttgcagtcgacgaaatagctttttcagaacaaaaagcaaaaatccgagtgcttcaattcctcttgctctggcctgccgagtactaaaatcaaagactgtgaagggcgaaaataaaacatggtgcatcgagtagatgcacctaattaggtataacccccgactatgtggttagttgaaaaactaaacgtgtagttaagaaccgagtggttttacaaccaaacatcatatagcaaagcacgcatggtattcagtaaaatacccagccgactgcttctcaacttgaatatatcaagaataaaaatatgaaaagggcccgagtgataaacactcaaaatgtccacaaaaagacatatttgacaagaatccgagtaagaaactcttaaaatgatctaccaaatatgataaaaatcatggtaattaagaagtttaatagcctaggctataaccctcaccataatcaaaataagcatataatatgccaagagaatgactcttaataaactagtcatctcgaatcaacccaaatagcttttgcagcctaataaagcttacaaaaatagtataacacctttctgtcgggcacctttttatttgcatcgtggtaattccaaagaattatcaaactgcgttaaaaaggattttaacagcatcgggtcacatcattgtgagcacaaattgccaaagcaaaaagcgcctaagtccatagggatcacaacgggccacgctggtaataatattgggctgaagtactgtacaggcataggcccattagcactcccgatactctaacaaaacaccgaagtccaagcgacgcttcgtcttccccgccgaaactctcgtcatttccccactccttgttacagtacaaagctgcgccgacgaagctagggttcatcaatccgccccaatccattctcaaaaatccacgaaacttctccacgcgtccaccgcaccgattccccattcccctccagcaacttttcagaccgaatctgactgttcgactcgcacccatggcggaagagagagaaagtttcgagagtcagtaggcgccctccgacgtgacggaggagaatctgaaggaaatggtggcgcacggcgttcttccggcaaaggagatcatcgggtggtggccagcgtttggcgaagcgttcccaacccccgatacacacgaggtcgtggtattttctcacttcttttatggtggattttctcttccaacttcaagattcttccgaggaattctaagcttctatggaattagcctgcatcacctgaatccaaactccatagtgcacattgccaatttcattcacgcctgcgaagcttttctgggcattaggcctcatttcgccttattccgccgaatcttcttcctcaagccccaaccgaacaagagcaaaccatgcgtggttgggggcgccagcttccaactcagaggaacactaagccaaaagtatttctccatgccctttaagacctcaaacaaaggctggcacgcaaactggttttacgttcaaaatcctaaacccgcactccccgagtactcctgtcttcctcggatttaccaggacacatggaattcattgcctatgggagatgaagctgctcaggcagtggaattgatggaacgaatgctaaagctgaaggaacagggtttgcagggagaacaaatcactcggcacttcatcaaaagtcggttagctccaatcaaagagaggtcccacacggcttttgagtttgacggcaagcatgatccaaatcgtgaagatctagactctcttgactttaaggtcatgaaggaaagaatatacaagatcttctcaaatgccattgttatcggctattcacatctgttgccagttgtgccatacaatgcattcaaccctcctccaccggtatgtactcaaacacttcagccttcctcaaaatatgatctcgtctttttgttaaatcaattgacagtggacgatattatgtctaggattttgctctgatgaagtcggatcccccaatcgctcagcgccgatcacctcgccgtcagactggtcaggggagcgggggaccaaagatccggtccgaagcccagcccaacacttctaatccagccggccagtcagattcctgtaagaggaagttagtgctaagtgacgacgaaggcgacgatgctgaaaagactagagatagagaaacaaccagaaaactcccgaagcaagccattccaaagaagaaaacatccagtcatcctatgccgaagatcaggaagtcttccaggtataaatcatataacattcttccttgtactgatgctcacttatcatgaaaacaacgctgacagtacaactcaaactcgtaggaaaccatctgatatagatccttctgggaaggactctgatccgactaacatggagacgagttcttccaaggaaaccgggccgactgctaaggatcatccgagtgacaatcagccggcaatcgacaatgtagaatccggtgatcaacccccgactggaaaccaatcggccgaagctgaagccggagttaatcaggagcccccgactggaaaccagtcggacacagggccaagccaagagattccagaagttgaagctcaggctgatagccctcgcggacatgatgccagcaacgacccgaggcctggatctcctgctaagacacaagagccgactcgtcctcgcccgggaatcatcacgggtaaacaccttgcctgaaaccgtgttaatccaaccgactttaattgatcatctgatctttatccatggatacattaggaccaatgattggtgatgaagaggaagttctccggatacgtgcggctgaagactcgcgcccttccattttggtcaagtggtgggatgatgacttgcaacctcaaggaattgtaataaaccggcaaaaagaagacgaagaggtatgcctactgaaaaaggcgctcggccaagcgattctcattgtaaacgtaagttccttgacgcctgacctcagccatcttgtttgccatctagctcgagcgctgataaaactgttttgcagaggattcaccttaggagcgaggcgaagaccacaaccctagagaaattagttcctcatcttggaacccttgaagctgtcagagatcaattgcacgaagcaaaagagcttgccaagaaaaccgagcacgatctaagggatcggatcgctgagctccaggagtctaacttcgaactaagtggttcatcaaaaggtacacaaaatccgtccgactaacttgtgctgtcatctttgtagcttcaattaaccggagttaatgtagtgcaagctgccaagatatctcaattggagaagcagattcaggctctagaaagcgacaaagcagagctggcaagacagggggactcggctttgaaggatgttgaaggtagcatcaattgatactccgaaagccattgccttctgtatgctgactcattaatatgaatctgttggtgcagaccgcaagatcaagtcgcaggctcaattcgacgtcctggttggcaaaatcaaaagacttgaaggggccagggatgaagttgctaatgttgctaccccactcgtccaagcgatgttcatcaataacaatggcccgagtacacttgatgcttccgaaatcttcgacaagctgagagttgctccggatacatatttcaagaatatcaaagaagctggaagtatgggagcgagtctggcgttagcaatgaccaagtccctttacccaaaaatcgacattgatgccattgacggctttgcagacgggacaagcgaagaagctgttctcgatcttatcaatgatgcacagaaggttgctgacaagatagcagttgatgtagtggagagatttcaggacaccgatcttcgactgactggtcttgatgactctgatgatgagaaaactgatactgattgatgtaatgtaatgacaatgattctgatgatgatgatgatgatgatggaggcacaatttgtacaatactgatgaatttatgctgtgcccaatgtttcatacttagcttctgatttcttaaaagtttttgtcaagccttattgagcctaaaacccgcaaaagctatttaaaaactttcagtcctcatggactaagccaaaaaattaagcaaggcaatgataaatcgaataagcaaattggactaataaaaatcacactccattattatgacaatagcccccgactgataacttcaagggaaagcttgatgttgtcagtcaagatagggagatacagaagcaaacttaagcataaaaacgacgaagatgttcgatattccaagagttgtcaataggtgtaccgtcttcacgcttgagtcgataggaacctggccgagtgacttcagagattataaatggcccttcccataaaggagataacttgtgctgatcccgtgtagtttgaattttcctcaaaaccaggtcgccgactaagaaagcacgcgatcggacattacgattgtgataacaacgtaacccttgcaagtatcgggctgactgaattaaggctgcttcacgggccttttccagtcggtgtaggtcatccactcggtcttccccgtagcgctcttcgcgaaaattacgaaaacgcaatgattcaaattctacttcactaggcaacattgcttctgctccataaactaggaagaatggcgactggcccgtagcccaactgggggtggtgcgcaaggaccaaagtacagatggcagttgttccacccatttgccggcataaggattcagtcggtcaaaaactcgtgcctttattccttggagtaccatgccgttggctcgctcgacttgcccattgctcataggatgcgctacggaggcataacaaatcttaatgccgaagtcttcacaaaaatctttaaatactccactggtgaattgagtaccattatcagtgatgatctgattaggtaccccaaaccgatgcacaatgttgatgaaaaaatctctagctttatctgccgtgattgtgatgaccggtttagcttcaatccacttggagaatttatcaatagccacaaagagatgtgtgtaaccgccaactgcctttttgaacgggccgaccatgtcaagcccccaaaccgcaaacggccaggacagcgggatagtttgcaactcttgggctggcaaatgagtttatctagcgaaaaattgacaaccttcacatgtccgtacgatcttgtcggcatcggacacagcggtgggccagaaaaaaccttgctagtaagccttgctgacaatggtgcgtgcagcagcatggttgccacagataccagaatgtatgtccttcagcaattgtctcccttcttctaaggatacacagcgttgcaaaattcctgatggacttttcctgtacagctcggtctcatgaataatataaagcctgctgcgcctggaaatccgctcggcttcgtctttatcttgagggagttcagaaatcgtataagaggctctctccagtcggtttcgaccatagctatgttttgagtgtccgcggcttcaactgtttctctcttgggtacggttggctcataaagatattcgacgaacacatcagaaggggccgcttcgcatttggatccaaaattcgctaatctgtcggctgcttcattattgtcccgaagaacgtgagtgagttcgagtccatcgaacttatcctgcaactttcatacctcttgtcgataagcgatcatattgtcgttgaggcaggaccactctttcattacttggttaacaactaactgtgaatctccacgaactatcagatgcctgattcccaaagagattgcgatccgtagtccgtgaaggggcgcctcgtattctgccacgttgtgagatgcaggaaaatgtatccatagcacatagctcagtctttctccagtcggggaaattaaaacaactccggccctagtgcctgaaagtctctttgacccgtcaaagtgcatagtccaatactccatcttttccttgggcgtgtcctcttggcactcggtccactcagcgacaaagtcggctaaagcttgggatttgatcgaagttcgcggtttgaacgatatatccaaggacatcagttctaaggcccattttgcgattcgcccgtttgcttcgcgattatagaggatatcactgagtggaaacgatgtaaccaccgtgaccgagtggccttgaaagtagtgggataatttcctgacggtgattagaacaccgtacaacagcttctgaacttgaggatatctcgtcttggaatcggccaacacctcactaacgaagtagatcggtcactggactttctgaacatggccttcttcttcacgctcgacaaccaggaccgcgctcacaacctgagaagtggccgatacgtatagtaatagcggctcttgtgggtgtggtgaggccaaaactggtggagtagtgagaagtttcttgaaatcttcaaaggctttctgtgcttcgggtccccactagaaattgtctgttttctttaacagtttgaagaagggcatcccccgctcgccgagtcgtgagacaaaccgactgagcaccgccatgcatccagtcagcttttgaacgtgtttctaggaacacggcggcttcatgttgaggatggcgttgactttctccgggttggcctgtatgcctctgtgagacaccataaatccaagcagcttccctgacagtactccgaaggtgcatttttttgggtttagtttcatcctgaaagcacggatgctcgcaaaggtttcttccagattcgtaatcaaatcatccttctgcttggtcttgatgactacatcatccacataggcttcaacattgtgaccaatttaagtcgagaaacatctctggatcatgcgttgataagttgctccagcgttctttagtccgaaaggcatggtgatgtagcagtaggccccgaagggcgtaatgaacgaagtcttcaagcagtcggattccttcaatcggatctgatgatatcccgagtagcaatccaaaaaactgagcagctcgcagccggcggtcgagtcgactacctggtcaatgcgagtttgagccatcgcgatctcgcgggtttgagccatctcgcaactttccttgtcacatgtgacagcttgcttgatgtcgctccgtaggaatatgactcctcgaggaccgggcatcttcatcatcatgtaggtatagtgcgggacggccatgaacttggctaacgccgggcgtccgagtatggcgtgatacgctgtcctgaaatcagcgacttcgaagcagacgttctctgtgcggaagttctcccgagtaccaaaagtgaccggaagagtgatctggccgagtggtgttgccgatagccctaggatgactccgtggaagggtgcattactcgggtttaactcggtgcgagggatctacatgtcatccagggttttggcgaataggatattgagtgcgctgccaccatcgatgagagatctgcgaagcttgacgttgcgaaccactgggtctagtaccagggggtaccgccccgggtggaccactcggtcaggatgatccgagcggtcaaacttgattgttatctccgaccaccgaagatattggggcgtatcgggctggacagcattgatctccctttcagtcagcttttgctttcttttagactcgtaagccagagggccgccaaagatgtggttgagctccttactgtgatcttgaaaacctgtcgggggatcatcatcatcatccttctttttcgacgtactttgttctccgtcaggggtcttccgtgcattcttggcatattgctctgcaaactgcttgtagacgaagcaatccttagctgcgtggttggagttgggatgatgcggacattgggagttcatgatcttgtcaaaagtgttgacgcgcgaacgttgtcgggaggagtgtgtagtagtcgcgacgagttcctcgggcttacgcttgcggtccttgtgattgttacttccaccccctcccgtagtcggcacatctttctttgacttccaagtaggacccgactgcttggatgcgataatggcgtctttggctttggcatactcgttggctttttcaaacatctgtttgactgtcttgggaggcttgcgcccgaacttgccaactaggtcttcgtggcgaattcctttggtgaaagcaacgatgatgacgtcgtcggtaatgtcggagatcttgttgcgctgttcagagaagcgtcggatgtaatctcgaagggattctccagacttctgaatgacgttgtagagatcaaactgtgtgccggggcgttcaaaggtgccctggaagttggtgatgaagtggtcacgaagttccgcccatgatccaatcgtgccacggggtaatccatggagccaggaccaggcagaatccgctagggccacaggtaagtagtttgccatggccttgctgtctcctcctgctgcgcggattgcgagaccgtagacggtaagccaagactccggattagtggtgccgtcatacttctcgattccagtcggcttgaagccggctggccaatccactcgacgtaggtcgttagtaaaggcagctactctatccacgtcgtcgtcgtagcgatctggtgaatggcggtgacctcgtgctgcacggcgctgattgattatatcgcgaatatcgacaggacgctggcgaggtggggagcgaggccgttcaactcggcactccctgtgtcgctcaggaggcgagtgaacagatcgctcgtcgtggccccagctcctgcgattggatcctgtgccggtgatgctgaggcttggctggtaataatcatgagatcggagatggggagctcgactgccagtcggcgtgcagacgcttccagagttaaccgggaccgaagcggcgatcatggtcttggtctggttcaagatgttgacgacgtgatcagcttgattgagtgcgtcttccttgaagagggtgtcgaaaagggtgatcgcagcgacagcgttctgttgaagggtgcgaaagaccgctgttccctcgacgtcttgctgcccgatgagatctcgcgctcgtcgccctgcgtccaaggcttgttgtcgttggtcctcggcctcctttgcagcccgttcgcgttcttgttgctctcgccgcagtcgttcttgctcttgtgcttggcgctcctcttctagtcggcgtcgctcggcttcctgctgtacgcgttgtgcctctgtttctcgggcttggcgttgttcttccgtctcgttgtcggccatgaagacgccaaagtagagagggatgtaattgtcttcaaagctttcgtcgaagtcgtcgaggtcacggttgtcgtagcggtagccgaattcgtcgtactccacgatctctgttggtcgtgagtcgacgccgggggagccgaagtagccttccagttgatctgtcgaaaccgtgccgagtggccggagtatgacgccgacttccctggagctaggcaaggtcggtgttgaagccgacttccgcctaggcctacggggagaagacgcccttgtagtgaagacggcagccaagtcgtcggggagtttcatcaggattggcgagtaggccccatcatcttgatctggtggtgttgaaatagatgggatctcgtccgagtggtttgaagccgactcgatcgagataagcttggagtaaatcttggtcgagttcggaacaccgaacggggctgagacctagtccttccctgactggattgaatccgagtcaaggagagagatcttgccgaagtcgttggtgatgaagtcgaggctgccgaaccgaaacgcctgcccgggagagaagacgaggtcgtcgatgccggagacggaacccatcgcactaatcggcgaagaacttgacgctacccctacctggcgcgccaactgtcaaaacaagatttcggcaatacttaaagggggtggctatcaagctagaaaagtggatgggtttgaagacaaggaattttatacaggttcaggccttcttattcaagaagtaataccctactcctgtccgaggatgattccgccgagtatatattgatcgtatgatctggggaaaaagaagtgtcccgagaggaacccggacccctctttatatagaggaaggggtccgtattacaaaatacagtccatatccctaacggaatttatgattacagataaaatacaatcgtaaccgactaagatcccgagtatttccttgacatacaagtttagaaactaacccgagtcctcataaagatattctatctatatttggtatcgtttacccaactaaactataactgccatgtagatataggatatccataatctccacatagatgggtcccacaataaatgacattagttgtggcagatcctatatgtttatagggatagttacagataagtgggtcccatgggtaaataaaatatttctagtcccacctaccgtcaccgggctcggatccagacaagtggacgaccaaccagagtggcaacaggagcagcgagcgcacggcagacttcaatttcaatatgaacatatatatatatatatatatatatatatatatatatatatatatatatatatatatatatatatatatatatatatatatattctctaaatccatagacagatgagattctaggattatccttttgggcaaagacttttatgcatacttcttctgggttatctataccatactgtattcacataaagatgatacacgctagctaaagatccaccgggtgtaacgtcataagcacattggaaacgtaaataattgtaaccatatacatataaaatgacagcaatggaatcccaatcctctgcttttatttgtaaagtctctgttcctcgatgatcgaagcccaaacatctatgaagcacctcatgtttgactagccaattagataaccaaccctgctgcattatcttgatatctctctctatgtgtgtgtgtctatatatatatatatatatatatattagaattctccaatgcatcatcacatttgctaaccctagtgatgaaaccacatgcaagaatttagtagtatgattttaagagtgaagatttgtctagttctccgcacgtacattttttgataatgctaaacgatgcgtcttttgaaaaaacaattataaaaaagtttttttaaaatccatattaatttatttttcaaatttaatataattaatacttaattaatcatgagctaatagttcatttcattttgcgtatcttctcaatattatgtttttctcaaacacgggaatatgtacgcaagctttacaaaattttcccgtgcagtacacaccaactagcaaatatcacgaaaaaatcaataaaaaaaactgcatatgtgctcttaatagtattgcacatatattcaaagtctcatattcaa

SEQ ID NO: 35470 - DNA, 7619 bp, Oryza sativa
  unsure (1)..(7619): unsure at all n locations
nnnnnnnnnnnnnnnnnnnnnnnnnnnnnnnnnnnnnnnnnnnnnnnnnnnnnnnnnnnnncaagaaaaagaaaagaccagtagaatttcagaattatttcacacacatggacagattaagatactctgcagtaactgcaccgtgcctttatcactgatatatgttaaccttcggatttatgtgtactcgactggatctgatcccacgtgggccacgagaaaatggacatttagccactttcaaaatatggtttcgctagaatgccattctgaaaacgcgtttcactaaaatgccaatatgaaacgcgcactcactgccatgcattttcgaaatcattttctctcctccaccagatgatgagacgaaattacccttcctggtgagcgtggtgagcaggggacaaaacgccatggcctcgccggcatattgagtggcggcggcggcggcagctattgtcttctcccaactcggtcgccccatctcactctccaacctactgctgaccacatcgagagaacaagcatgggctgcctctttggtctcaatcccatcgccggcggagatgaagacgatgatcatattcatcaccaagccacggtcgtccttgtcccttttgcgttccatactcaactcatcttgccgaacaaactttcttttgacgccatcgcgtttgatccattgtagcaacgggaacaccgccgcgccatcgtcgtcctggagcgcgctccggagcaccgccgcttcggcatcgtcgacgtccggccatcctcatccatcccggagcaagccaccgcgccatcaactcctccttgaggtcctcttcaaaacccctcaagaaccgagaagaatggagcatcgaggagggagattgacatcgtcttctccaacttcggccgccggcgtcaatcttcgattccctccgctccggtgacctcctcgtcgattctttgcgcatgcaccatccctgggacctaaccaacctcatggatgcacatgcatggcttcacatcgaattgaatgagttggcgtcgtctcgccggagctcagagccgccgctgagacgttttattcatcgctgccatcaaccaagcctcatggcctttgctcggcctcgccctgtcccacaccgtcgtcgccaactcgttccgccgcatccccgacaggtcgacgccctcgtcagcaacgatgacgaccacctcgccgcgctcgaccatctccgccggcagcacaaaacgaaggagagaaagaaagagaagagatggacctgccattggccccaagggcatttccgtctaatcaccacaaagaagaggcaaaatgatttcggaattaagagaaaatgagaaaatggcaatccagcgagttgcgccgccttgatattggtgtattctagcgaaaccgtgttttgaagatggctaaatgtccattttctcgtgggccaccgggctgtgcgaactcgctacgtggaatacttgggcccttcccttcctttccccaatccgcctcatccgataataccccccacccctctctcgtttcggcggcggcggcgcgcggccggagcccgagctgagaccaccaccacggcaccaccacgaacacgacgatgatggccgcggcagcgagaatggcgttcgcctcatgcggccgcctcctcgccccctcctcgtcgtcatccctccccgccctgccaagaacccggggcagcgtcgccgccagcggcaagcatcccgtctcgttcttggcggcggcgagatccgcctccgtcctctgctactgctccgacgccaccgtcgcgccggccccgcaggcggcggccgcggagggggaaggggaggagggggagaagaaggcggaggttccccccgtggaggaggtggcggcgctgctggacatccgggtggggcgggtggtgaaggcgtggcggcacccggaggcggacacgctgtacgtggaggaggtcgacgtcggcgaggagcagccgcgcaccatctgcagcggcctcgtcaactacctccccatcgaccagctccaggtctaaccatacacacaatccatccaagatttcttatcatttcaattcaacattagagataattcaatgtaagagtaagcactcaccgcggcgtatttatgcttttgcatagcatatggatcacaaaaatgtctcatttcaatccatccaagatttctcatttcaatttagcattacagaaaattatttgagagaaaacactcactgtggcgtaattaagaagctttatttagactcggttaattacatcgagatgatcaatcgaactgagtcaaccccggcctctgcataaaatgcacacaaccaaaaaagaaagaaacaactagaaacatctcccaagcacaaaagtttgacaaaaacatatatccaaaagcttacgcactacatggatcgcaaaatttcttcattacaatccatccaagatttctcgtttcagttcagcattacagaaattctttgagagtaaacactcagctgcggcgtaattatgttttcacatttacatggataaaaagaaacctctcatttcaatccatccaaaatttctcatttcaattcagcattacagaaaattcatgtaagagcaaaattatgttttagcttggcatggatcgcatgattgtgcatttcagaacagcaatatgtgccttccaagtgtcgtatatcggtatatggaccaagatgtatgctggagggtatgcatcagagagcggagcaagataatcggttataatcatttttaatttatcaggaaatgcatggattggattaacctggcccaaaatcccgatgctttactctgcaaagttagcactctattttggtcaagattcaattcgcaccaaatctggctgcgcatgtacagccctagtgttaacagagttcgggaacgaaaactatgctagtcaaataatgtgtaggtccttttggttatttcttttcgtactactgatgacaactgctattgtttgtgacacatgcaggacagcaatgtgattgttcttgcgaacctcaaaccgaggaacatgcgggggataaagtcaaacggcatgcttatggctgcatctgatgcttctcatgaaaatgtcgaattgcttacccctcctgaaggatctgttccaggtgaaagggtatggtttggtactgaagatggaaaggatcgccaatcagaagctgcttcaccaaatcaggtaacactttgggtagtttaaacttagattaacacattgttgttttaacaattgcatttcttatgaaattcaagaaaattgatatagtttaatgtagaatttaagaaaaatattttagttaacagacctcacctgtatatgtattgataaactatgctacagttttatactatacacatcccaaactaaagtatttttcagcatcgcagttaattggattgttgtgttcttttaggttcaaaaaaagaagatttgggaatcagttcagcctcatcttaggacatcagaaaactgcacagcatttcttggcgagcacccgatgcgtacctcagcgggtgtggttttctgcaaaactttgcagggtgcaagagtgtcataagtctctttcaagaagctttttttttttcttctttggtatccatattgtgtaccttactgaaaataatcatatggtatgagtaaaaatcttagagcaagatggtttctgaggctttatggaggtcgttcacaattttgtagctttctgatgtcaaagctggaacattttacttcaattggagattgatttataatttgatcatgagaattcgaaatgtgattaactttgtaaggaagttatgtggtactttgataaggtgatttctgctcttaaggatccatgtgcactgctgccaaattactctaaacaaacagtaaacacaacccattagccactatatagtggatattaaccactatatagtggatattccggtcgcctttcggtctgttttcctcagcaagttctatgatgtatgcaaatgttgtgatttctaaacatttttttgagcatatctcgatgtcatagagatcaaggtttcccttaccgtttttggcgcggttaccgcacccccacggtaaggtggttaccacggtccactaaaaccgagcggtagccgcgagacataccgtggttttaaaaactgaaaaggttaccgtgcatggtaaccgtggtaactgtgcggttttgtaaaccctgatagagattaccataagccgaaacgattttagcgccttaagtgtccatataaactggttgacagttgcttcacatgtattcatcataaattttgaggaacaatgagatcggaaactcatgaactgactagtttctcttacaaatgcagtaaatcttggattacccatcgatctaatgccatatggtaaattgaagatgcacatatatactacatcaacatagctgctactttgatttccgtgatttgaatatgttttccttgtagtattgtagctccttaatgctttctctaatgtcatccatcgccctgtggttcttctccttccttggagcatgtttcctttctgcggacagtaaacaaaacaaagcaaggttatgttttgtggagattctgtaactttttggtctgtaaataaaggaaattaaaactgctatggagaaaataagttgatttcaatcaacttcgactttttaaaacagctacctacgatgtatatggattgatatacatcgacgatatttttttcctcaattacaacgtgattctctttttcaattccacaataatgtgtgggaattcagttgttaaagaataagtcagccagcagcttggtcaagtgcagaatttgttaattcacggaggaaaatcacatcgcacacacccaaaagtgtagcaatcagatattaaactgttgaagcagaggactacaagcacagcacaagactgaaagcaagaattaacattacatttataaataccggagtaattttacctttggggaaccatcgggagcacaaagccgatatactgcttacatcaactatcacatgagagaaaatggctgccagatgtggcatgtacttctataaaacaaaacaacacagaaaattgtcattcaaaaagtgtttcaaaacaaaattcataatgctaactatcctatgctagctcataaggatattggaatacttttcacaacattctttgaggttacataatttatttatataatgctgaaggtgaaatcatttggctactatagtgatgtcagttggacagaggtgacctttgcttgctagatacaaattcaatattacctaaactgaacattttcaacacgataataaaaaaagttatgtaaatatacaaaatctcagatgcaattactgatagaagggacattgaatattgtatcagaatacaatttttcatataccaaaagaagataacaaagttgcatatggaaggcggcttaaggaaagtccgtaagttttatttgagcaatatatgctctatgcacaaataacactgcagtgcaattggtatgcagataaggtaaagtctgcaaagtgttgcattaacttgagttctgcaatattaaaaaaaaaacgctttccaacttaacagcacagataatattttctgatctcattctttaccaataaatctaggataaactaaatcgaaatcgcacactggcctgcctcactccagatttaaccagttcaataaggccaaataaggacataataaaatccaacgtaaaggcatttcaaaattacagcctggccatttgcctaaccatttcacttttaactgaggttaagtgtatgctttctcttactaaccttcaaaaatagtaaatccatatagacagaattcccagctatcagtggagtggctgagcctatatacttcctaataaaatctagcacctgaaaataattgacaaaaggaaaccttcattaggaaattttacattggaaagagaaacattcagaatatgaaaacatgcattgaacatttgtcagaaatgtacaattgaccaaaaaatagaaatagaaagaacgcttgtatgcaacagtaacaacacagacagagacacacacatgcacaaaggtagttctacacacacaacttggtaaagtttccatagaaactgcaatcgaggagaaaaaaaaggtaaacataaatggcaaatggtgcagtaatataatgtattattgtttgcaagcaacaaaatcacaacagatatcataaatatcgttcatcttacatatgttggcaaaatacattaactatcaaaagactgaaagagacctagtttacacatagagcagcacaacaatagaacatgatttcactaaagctatactacttaaaatgttagtagtggtggtgtccatttccacaccaccgctatcactaacatctgggccccacaatctatactgttataccacttttcaacaagtctactattggctccccccaaatttcaaaatcacctacttgttcaataagaaaaatcatggtattacttatactaaataagtgcttattaattgatttaataagctagaaattcaatttgttttccattgcaacgcacaggctaggctagtatatcaagatgattgtacactgtagtcacatgtacactgcacgtatacagtatcctcatttgcaaaactcatgattgtagttgctgtctagcaacacaacaaagttccacctagtcatctactcatcttgaaccgcgatatgtggtggataacgccattgaacactggtaaaggagttcgatacaatacattggccagtaggcgcctctttctatcggacaaaattctgcttaactataagggcaccttcagagattcagatgtactaaaagagaagagcatacttgtttctcagcatcattctcagaaatgtcgctctgcagcaccttttccttcagccctgaattggtttcatgagtaacagatttttgctcacaagtatatcattttgaggaagataagctgtttaccgctagcgctgtgatgaactttgcaccattcattcatgtcatttacacattccttgctctgtcttataaccaagtcaggaccctgcaaagaagtgactagctatgtttagcaatatctctggatttgagataccatcactacccaataaggtaatcagattgcctatgccagttgtgatcaaattgcagtattgatcaactgatatagattagaaacttgatatacaaagttaaatttgccaaacaacatggttatccaggatcataatgggattaatagaattggaaaaataagacatagactaaaccccaacttatcggaatcttatggcatatctccttgcatctttcctataccctaatattcgtaacataacaacatcttgattcagaatatatttgtttctattcttagatttacattgagacatatcgagctaattagtactaaaaacaaaataactcaacattccgatagtcctgatggatttgtagccttatttagcagtttttaacatctttatagaccatgagcttggatagaccagtttcagtatatgct

SEQ ID NO: 35471 - DNA, 12231 bp, Oryza sativa
ccctgcaaagaagtgactagctatgtttagcaatatctctggatttgagataccatcactacccaataaggtaatcagattgcctatgccagttgtgatcaaattgcagtattgatcaactgatatagattagaaacttgatatacaaagttaaatttgccaaacaacatggttatccaggatcataatgggattaatagaattggaaaaataagacatagactaaaccccaacttatcggaatcttatggcatatctccttgcatctttcctataccctaatattcgtaacataacaacatcttgattcagaatatatttgtttctattcttagatttacattgagacatatcgagctaattagtactaaaaacaaaataactcaacattccgatagtcctgatggatttgtagccttatttagcagtttttaacatctttatagaccatgagcttggatagaccagtttcagtatatgctactacgagcaatcattgcatagtgattaagagtcacatattgcacagccatataaaaataaactgttaaggagcatcgtaaataccaatgaaacatattattataagaaactgttcacttcctaaattcaaaagtcaatggtgcactacaagttaggtatttctgagcaaagaaaactattaatatagagcaatcagaattgcagaaacacttagtttcaatagacacctctattcgtttggtaagtttaccgtctgttataatacaagcaatctccagtatgcgatctttggtgatatccaaacctaaacaattaaaaaccagcaggctcccaattagtacactgtatagttttggtttaacgcatctacaaatttaacatagaagagaacaataacaaaaatgagagtgaaatcaagaaaccacagttcagaatggaagactgaaataacatgggaaaagttcctttttaacaaattaggaatatcaagtgaatcagtaatgacctgtatattgtttagcaacagtacaaagcatacaacccaccattatgtgtgcatgacaccagaattcagatcaactttagaaatgtagtagtatgtatctttacaaagagtgaaaaaatttatcagttgtaaatcatggccataatttattgatagagatatagcatgataaatatttcattgcaaactcaaacgcttaataaccaatttgatcaatattgtgtagaaaactggagataacacagttaaggctttatatataaataatggaaatatagctctcatggttgaggaataagttttattaagcatatttaaaaaaatctaatgaactcaaaagaaacatacagcttatgaaaagaagactaaccagtcatttccaagtctatccacactaatggcttatcataatcacttgatgatgaagcaaggttttctccatcgtggtttacaatcattgtgtgattcagcctgattttatctgcaaagtaaaagtaattttaaatctcatcctgaggagacagcaattaaggattggtgctatgcctacaagacaaaacaactaaaataaaatatttattcgtcactgcagaaatcaagttagcatgttaatgcataggtcattgatctattgttagaggatagatttttatggactttcgtgattctatcactgacctaggagattagatcaagtcccctaacaatacattattgctttctgatacagtgtaatttggacttctataacaaaaaatgcattggaagaattgactttagttttcaataagccacccactatacattgaataagactgcatgactatttagaaagcttcacaaaccggtgaatggaataaaagcctctgattttatgctttgacaaacaatatttcaggatttaggactattgatctatgagatcagacattcatgtttcaatttttttttcaatccaatctaaaactggcaacataatatcatatttggttatgatgaatcgatatcatgagaaccagtagattatttcactatgaaacatcatggttgacagcagcgcatcacttcattgacccagcaccgaaatacaccgccaccaccacgggatcaacatttagcagcacatcacttcattgacccagcaccgaaatacaccgccaccacgacaggatcaacattggtacaaacagagagcatcaattcaattcaacaatgcaaaggatggaacagcaatagagcgctcttcttaccaatctccgtgctgctagtaacagcagcagcttcggccttgctggatgttggtggttccgcaccttcctctctatcgtcctcagcatccagattaagaacagagaacatattcgcgagtttgctcatcttttcccccaagaaaagagtgacggagctgtaacctggagcatgcggggggtacagttgaaaccccccagatttgggggggaaaggaactgctattagtattagggtttaagagagagacagaagaagccttagcttccatccagatctagtagaagagaaagataaggttagggcgaattggaaagaaagggtggtcactcaccggaggcggaagcgggatggatggaaatcgggcagcgcaggagagcggagtcgagggcgagaagacgcggcggcggaagcagcaggacgacggcggcgccgctgctcttcgcagtcggcacggcagcaggtgtgacggagtcgagatcgatcgactcgtcgtcacggctcacgaaggcccgcgaacgtgagggcccattaagctcacattgtcctagctcaagcaaaagtttttatattttttttaaaaaaaaatacgaaaatgctcactgccgggctacccctgcgcgcccctccccacgtgcgtacctattcggcccacccacttctctctcctctttttccacaaaagatatttcacctagtgtattttcaatgtttcactatttatagatttataatgttacagtgaattaaaatactcttttgcaaaaaaaaccacatattttagaaactctctattaacggaatttgatttgtttttttcaaaaaaaatgtttcatctagtgtacttacaatgtttcactatgtatagatctaatgttgcagtaaacgaaacattccattgaaaaaaaaacccacatattttggaaaccccctattaagggaatttggtttattttttttgttccaccgaaaaatgtttcacctagtatactcataatgtttcactatgtatagatctaatgttgcagtgaaccgaaacattcttttgctatttgctgaaatattgtttttatataaggtgaaacaacacccgatttaaacgagtgaaacattttcgatctagtgaaacaattccgatatacctggtagaacatcgtgtaacatttaaaaataattcaataataagctttttttttgtcagaatatatccatgtgtggtcttgttttgaagatttaattgcaacgaattaatgatgcaaccggatcatgatttggataagtaatttaaaagaaaaattggtttaaaatagttttgcacgtaaatcgggctgacgtcagcgcccgatttccctcgctccccgtcggacgaccgacgcgtagtcgcgtatgttcttttaaagtagggcggaacacataaatcctcttaggattttgttttgtggcagacgatgagagggttacaccatgacaatttcacaggcagccccttctcattctcctctaagacgatttatcataagaagataactacctaccatctgcaaaatacgggtggggtgttgcctgcaaaataaccatttcccgatccagaggaaggcgatttatatggcccggctatgaaaagccttccctccctttgtaaatcattattgtattcctcagaaatctagaaaataaaaaagaaagaggaggtaaggggggataagaaggaagcggcggtactcaatagaagataaatacttttagccattgacttttcaacacattggtactagtaatgacattattattgcaagttactcccttcatcctagaggcctagaggggagaggggaaagaagaagagtgggcaatttagtcataaaaacttgaaaaatttagtgaaggagtaaatagtagtatatggcctggaaatttatgatggtatggttccaattaaccctttaattacatattcacaaccactttttttctccatttacctattgtccatccctaaaaattcttagtagtacggactactcactgcataaaaaagaaaccattctgtttcatttacttcaccagattattcaaatatttgctacaccctattaaatttaggttttctcaaaaaagttttggtttcagctattggttaagtttatttcttaggatatttaatatatcgtgtattaagtagataatttgtaagaataatctagtcgataatctaaattatacagggccagttaagcggagattaagtttcaagaggaaagaatatgctaccctttttgtaaatgacgtgtggttgaaagtataatatcaagaaatttgaataagaagtgacctttgaataagatgaatggttacatgttataatgttataccaaaaatcaatgacattatttattaaaaaacagttgtaatattttgtttcattcgaccgaagaagataattaattcgtactccccgtactcattaaggaaatcgttttagacagtaacacggtctccaaaacacaactttgacttcttgtttctataaaaaatatttattgaaaagtgatatatttctataaaaatatttattgaaaagtgatatatgtatatttttatgaaagtatttttcaagacaaaactattcatgtaatttttatattttcaaattattaatgatttatatatctaaggtttaacttaaacattgtcctaaacgacttcttttatgagtacggagggagtatactcattgaaagggcaacatcagttctgaattccgtactctttgtgcttcagaaatactgcagtttaagaactctattctacctctgtaacgagggcaaaactaaagcaatttgatgacttctgtccagctaaaatgttttttacatgccgtagtcaaaaactagttagtacagtataaatttagtatgttgcatctcaaacttttggtatcagtctctctcagggaggcaaaatgcctgtaaatttttcttggactcttcccttcaatttcactacctttgggcaaaccttcccaggacgataaaataggacagagcaatgcagcatctcaaaattcccggataagcttatgcatggttacagactgaaggtgaacatgacttgtccaaaccaaaccagtaagcttctttgtgcataaaattatctgcataaacatttgatatatcaaaaccatcatattaagagcattcaatccagtaaatagacatactgcagaacacaggacatctagcaacatcatacacatgttgaatggtcccaaacgtaggtgcagtgaattcatgtgtattacctgttgctccaaaagatccaacacagatggccatctttttccatgcttttcatgtcagctcccttatgtccttcagcaggtaggctattcctcacgctgcctgccttccagtgtagcataatcaagcatcaccagacctacataatgcacaccatcataacacaaagcaatcagtgtaacacgattttttttcacggtgaacataattcacaaagcaatcagtgtaacacgattttttcatggtgaacattattaagaaccgttgacagcaaagcacattattttacaaacagtttgccaggactgattcacagaaatagcaaaagttcaaatcacttgacaatcatcatcaacccagggcagacaaaggcaaagctgattaaatggagcacaaggtggaaaatagaatgcctggaaaaatgtaatgaatgcacccacatcaccccagtacagtctcctaaacataacataagatcaatgcaaagttaaacaaaacatcattcaggatctggttcatgttcagaagaaacaatgaaaggtcaagtgtttctttctgctgtttgaggccttcttttaaagcaaaacgaaaaggtaaaaatctataaaaggaagaaacaagcagcctttggcatgtatttcaaggaaaatggtatatcatgtatttcaagtcacgatagtatttaaaaataaatggaaaataaaaacttgtggtaacttatgtcagaaaactctatagtttacaatattcagagttgttggtctaagtgtcaaatgtaaaagtgaaacatggaaacttcacattttgatacagatctgatcaactccatgtcctccgatagacaaaaatgagcagtgactgtgttgcgtaagtacatactgcagatagtgcaaaccacatcacacatatatggtattcttttaagaggaaaatatggtaatttgacacgctcacgtatttgaggaacttacacttgaaaaatctctactactttaaaattccgtagtggtggcggtgactccaaccctggaagacacgcggaacatgagctgttggatcgccatatccaacgctcccagttatcagttatccccatgtgcttgtgcttcccccctccgcccgcaacccaaacccacgtcgctctcccgatccaaccgcctccgtccaaccgccgccgccgccgccgctccatcccctcgtcgcgcctcgccgtcgcaccacgatgcgccgccgccgctccatcccctcccgctccatcgcgccgcaacgccagattcatcgccgctcccctccctctcgaccgtttctctcggcgccatctccgcacatccccgccagcgccggatctcccttctcgccctgtttccttgctgaagcattgtcgtgatattcagtttgatctgctcgtcatatcgctgccgcacaactcgccgaataccaaggctcgtaaacaagcgccgccgctgccgccaaatccaccgaccccaatctacgcggccaccacacgatggatgcatcaccgtcaattccgccctcgccgactccgccacagccgcctactccaccgccactacagttgtcaacgactccgccgccgccactcccgtcgtcgccggctccgcgaccgccgtccgtgctgccaccgcccttgccgtcatcttcggcgccaagcattgtcagcacagatatcgatccggtaagttaagcacctagcttaattagtccatgaaaactatcgatatatatgtgtgcgctgtattgcgatttgggttacttagctaggtaatgttaatgcatggtactgtagattaatgcaaggcactgtacgttaattaattattaattgaagcacctagctagccatccactattatattataaaattattacttataatatatcaattgcattaatatatactcctacactagcttgtgcgcagttctcaggcttgcttctttacttatatgaggaactcatctctcgcactcgcaaaactgagggactcattaacgcatgattaattaaatattactccctccttcccaaattgataatcatgtaatagaatccaaaatttctcaaattgatcatcatattactgcatggacacagatttcatctaaatacaattaatgcagtatgagagaatgtgtgcatgctatgatgtaattggcatagggttttaatcgatgcatgcattgtgggagaatacgtgcatggtgtcttgattgatgtgatttaaattgtccttggtcttggtacataaacttatatgatgatcaatttgggaaggagggagtagtttttaattagaacaaatagatttttatggttttatacaataactctaacaacataactcagcataaaatcaacctggccatcagctcattttacgaatatacaatactctgtgtggcatgattcaccaagaaaaaaaataattgatagctatgatcgagcaaaataaagcattgtaccaactaatgctacactaatattgacctccctgccgacgtgcttttttccagtgttatatataatctccatgtgcaatatagatatccttgcttaatctcatgtggtactcaggtcaatcaagacgccattcgtgctgatatgattacaacctgaccctcgaataaagcaaaaaattcggaatccgaggagcatggaaattttcagtttgaaataagtagcacagcctgaaatttctttaactgggaagaccatttgtacaggtttggtttcaatcgaagctacaggtttaatttggaagatcatgcagccatgatgctacaaatattaatcttgatggtttaaattaacctatttcatctatacaacttgattcagcttaatttagttcctacattagtgcacagttattcttcatttatttgtgcgtacaggatctatggaagagggccattaggtactaagagacctattgtgccattatattcatgaattttttggctgtttgtaacctgtgaaaacttataaggatgtgatgaaattattgttcctggcatataaggttttcatcataataaatttaattattcaacatcattttactgtgattttaaattggtgtatattttttacccgttgcaacgcacgggcacctacctagtaaggaataaaaacaacatggaataggggagctgaacaattacttcatcagatatttattgttgtggcatgattaattgtgaaatgcactatttgaatgagaaatccccatccatatacatcaggaagctaaacatcattgaaagactatgaccgtggatatactataaaaattaaacagaggtctatttgtcaaaattgaatgacaattccaaagaggaaattatatcattgactatcagaataatatgacatggctaactacatatttgtagtttccaaggcctcatgctactcacaatatttagcgtgcactactgtcacaaatgtaacaaaaaacaattgaataggcactatcaggccaattaaaatatgccaatatgtggctatagaatgatatattactgtatgaaactatgaatagcaataagacagactcacctagaggattcacccaataaatttgtaggttcaaatcttccatcttgtgtgaataatccatgtgccttttggtttgttgaatgtccaaatgcattagtgtcatcaatactgcgtagttttgcttccagaaggttgagagatgagtctagtttcactattttcctagaaatggatagtctattagtccatagtttcatcagataggtacaagatgtaattcagagaagtatttatgctgacctacttttagtaataagcaagcaaaagcttagtcaagcattagattttctacagcaatgggaaagccattaacttctctcaaaaacagcatgattcatcttttatattccctccgtactcgtaaaggaagtcgtttaggacaatgtttaagtcaaaccttgggaatataaatcatgaataactctcaagttgttgagtttgaaaatgtaaaaattatatgaatagatttgtcttgaaaatactttcataaaagtatacatatatcacttttcaataaatatttttatagaaacaagaagtcaaagttgtgttttggagaccgtgtcgctgtccaaaacgacttcctttatgagtacggagggagtatatgctaaatctgtgctaattgccaaatcgccaacaatagcttctcatatccttctctcattgatttgcaaaaagaaagacagaagtacaaatttcaaagtaatcaatacaaaaaataacaacttctacaacacaattttctctagtgtcgtacaccaattcataagtttagaggcataggttgtgaaagcacgttcctcgcacttagcaaacaatgacaagagatatccttaatgctcagcatgaattgacttgtaaaaaatcttaaagaagatttatgcaatccagttaagcatgtcattctccaatacaacacttattccacaaacacgaggaaatcttgaacaggctattatcaaattttactccaatagagaactaaatggattcataagaaattaatagtgcaaaaatgtgcaagcctcctacaaaggtattttccaattcacacttttttgtgatggtactagccctcctagaaaaaaatagataggtaccatcacaaaaaagtgcaagttgaaaaatactattgtacttttttgcgatgctaccaagtaaaaatgcccttctgaaaaatacaaggattgaacgttgtatcccttttagagtcttgcaggtcaataattttgtaaaaaccaactcgttcccataattccggtgagttgtgagttccacacgatattgcatcaaaatagcttaaacattttccaagatactattcagaaacaacacatgattccggtaagaaataatttcccataatgctatgagattgtgatcctgaatcattgaactctagaggcaatgtccgcttccctgtattgtacacatatactgacttcttttcatgtgccgacgtatataattaccctgggtaattaactatttgccactcttacgagtggtgataaaggatttaccactagacccacatgtcatagatatatgagggtccacatgtcatagacaacgagtagcaaatccttaattagcacatcttaaaagtggtaaaaagttaaatgtccctagttacccatatcttagcacaactgtaacacacaagcagctatagcgatatctaggaatacacaaaagatttgggattttttattttttattttacctgtggaggagggaaagcttgtcattgcattgcgccgcgaacgagttgaggaactccaccgtgttcgctatgaacatgttcacctgcaatgcggagagagagacacacacacacacgcagtcagagacgccaaaagaccaaaatcgtttgctcaccccgaaggtggagcaccaccagatgagatcgaccgtggagatcggagagggggtgagggggcgagtgaaggcggggcggaccaggtagatggtcctctggtcggagacggcgatggccctcgcgctctcctcctcctcctcctcctcctcgaacccctcgtccctcggcgccggtgcggagggaggatgcggcggcggcgagcgcatggggctcctcgccgcggccgacttcaggtggcgcagcatggcggcttccggatcgagccgagccttggaagctggaacttcaccttgcgcggcagacaaaaatcaagaacacggcggcggcggcggcggcggcgtagaatcgccgacgagcgagcagagcaaatctcgtactgtgtccgtgtgggatctaacctaagagcccgttacgaactgccaaaaaggcccatcatggcccatgggccgatggtcaccttgctttaggctgtgtttagatcaggggtgaaaaattttggcacgttaaatcggatatacggacacatatttaaagtattaaacgtagtctaataacaaaacaaattacagaatccgtcagtaaaccgcgagatgaatttattaagcctaattaatccgtcattagtaaatgtttactgtagcatcacattgtcaaatcattgagcaattaggcttaaaagatttgtctcgcatattagtcgcaatatatgtaattagttattttttagcatatatttaatatagatattcaaatgttcgatgtgacgggtgaaaaatttttgggtgggatctaaacaaggccttactcattttctgcagagtaatcgatgcatggggtcccatagatatgatgatccatcatggcatcatttcctctcatgggagatgagaggacctccacctctaactttttaggtctgttttcgaatgccgaaatccaaaccgctggacagaaggaaaaggggttgttatactatgggattttgttgaatgataatggtacatataaggtattaggtgatacttgacgggaacagatgaaacaacatatatatcgaccgatatctgttggtatcaagtctcgcaccatctagtatcaaatctgatataagatcgattcttaaatatcacgcagtactatacctctacttctctctttctccacttcaattcaccaccaaacaattcatccccaaatttatccccttccccctcctcctctaagaaagt

SEQ ID NO: 35472 - DNA, 2813 bp, Oryza sativa
tcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaaaccctaagcaaggggaggcgcttgagagggtcgacaaatccgcggcgtcaccagccgcaggtgatgcaggggaacagcgagatggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccacccccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagttcctccaggtctatacgaccgggattgaggccgctgggggtgacgacagggtcatggcgaacttctttcccatggccctaaaaggacaggcgcggggttggctaatgaacctgccacccgcgtcggtccactcttgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagcggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgttgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgc

SEQ ID NO: 35473 - DNA, 2987 bp, Oryza sativa
  unsure (1)..(2987): unsure at all n locations
cccatccaggaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggtgcaaggccggtccggcagaaagtgcggcggcaagccccggaacgtcaagccttcatccgcgaggaggtggctagacttttggaggccgggttcattcgtgaggtcatccacccggagtggctagcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcctttcgggttaaaaaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaaaattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaggccctttggccccgggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgtgccccgaggggccacttggacgaagaacgccccgggggtacggcccctagcgaggaggatcggccccgccgaaaggtgcaacggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctcacagctgcctcaaaccgcccactgggtgatgcagttcgcggttctctgtcactcagggcgcggtcaaggggggggggggggtttttccccaaacccgggtttttttggaattcctctcccgaacgaagacgtcctcagatatttggtccgtctcgacttccgagcgactaacaatatggcagagtacgagggactccttgccggactcagagtggcggctggactggggatccgccgcctcttggtattagcgactcccagctagtcgttaaccaggtctgcaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggctttcgtcaaggattttattggccgacagctctcaatgacgcagtcgatctggtccggcgatgcagagcgtgtcagttccacgccaagcaaattcatcagccggcccaggccctgcagnnnnnnnnnnnnnnnnnnnnnnnnnnnnnnnnnnnnnnnnnnnnnnnnnnnnnnnnnnnnn

SEQ ID NO: 35474 - DNA, 1885 bp, Oryza sativa
cgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatatgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggctaaccccgcaccccccctcgggtgtgcagggttagccgggggctaccacacatgcacatatattcctttcagcatttcaataaaagcagtttcaatttcctaaaggttgtgtctgtgccgttttttccttttgaagaatcttgacttgaaatagggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgtgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaaaaaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggttctctcggcgcggacgctttcaaggttgcggcgcgcctgctcctcttgcgccgcctcacggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccatcaagcccctctccacggcgccggcatgttcttccagcgccatggcacgggcctcaagggcctc

SEQ ID NO: 35475 - DNA, 11059 bp, Oryza sativa
cccgtgcctcgaggttggcagcccgctgctccagcgcggttctctcggcgcggacgctttcaaggttgcggcgcgcctgctcctcttgcgccgcctcacggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccatcaagcccctctccacggcgccggcatgttcttccagcgccatggcacgggcctcaagggcctcctcgcgccgccgggacgccgcttcggcttccgttgcccgccgctctcgggcggcagcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctaaatccgtctagtaccgcggtgtttgcggcggccaaggcctgcataatgggctcggcgctcaccggggcgacagaagaggaggagaaaagccgccttggagaaaaagcgacgcggcttggccccccggaggatacgctgagctcggggatgtcccccgggcccgtttggtcctgggcgtcgcccggtgaggtaggcccaggcgacgcgcccgcggcctcatcgcgagccgcctcggaggatgtcgcctgagggccgcccgagggactgggcccgagtgacgcgccagcagcagctgccgcctcagcttggcgagcccgggcggcctcctcccaggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcctcggcctcgaactggccggacttggggtggcgggaggaatgcgacgggacgtctctgaagcagaagaaaaagccagaagacgaacaaagtgagcaagaaaaaacttctttttggagaaagatggttgcaatgagagtaagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccggccactggtacgcaccgccccgccccctcgggggggagatgggggaggtgttcctcccagcttcctcttccccggggcgtcggcagggcggctgctccccgagcccccgacgcggggcccagaagcacgaccccctcccggggcagattgtttcccccggcggcgctcgcccgcgccgtcgttgcccttaggggctctctcctctgaggccccgacccccagcataatggatagaatggagacgcggtcgggatcgatgcagagggggaggatctcctgaggaaggtgagacgcctccgcggagctaaggttcagcaccctttggaccacgatcttgaagtcctcgggagcccaatcccatctggctccctggtgggtccgcatgaagtcttcaggcccagtgtactcccaggcgctccgagcgcgccgttggagcggcgcaatccggcgacggaggtaatcgccgtacaccatggccccggtgagcccctgggatcgcaggcccgccaggcggtcgaggacggcgtcgtactcctcccccagatctaccggcgcccgccagttagagacctgcgccgggggctggcttggaaggcggaggcgcgcttcgtcggcgaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccagtgtcatcaccgcattgggggtgaggtgcgccatctggagattgtagaactccagaacatccatgaaaaaatgagaaaatggcgggaccagcccagccatcgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtggtgtggcagtctcgaatagaccgcccattatggacaaccaaagttaccaataccaatgtgcatggattgagaccgttgggtattttgcccaactacggaaaccggtcccacctgtcacagggtggcgtcacacctgaccgcttcccttgggaagggaaattgttctggcacaacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggggggcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaagatgttgtgtgaagaagggcaaacatgcacgttgccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcagacaccatcctagtcattgggttaggaatggccttaaatcccatttgaaatgtacaaggccaacgtttagtgtgcagtgtcatgcttttgtgcttgaggttatccatttcttagaaataatttttttaaaataaattcttagaagtgtctaaataaaaaaatattcatatgtggtggtaggtgcacagatggaagagcaacctataaggtaacaacaatttgagtattctcgattttttggtgccacacggtacacccctttagcttggagttgctatagttatgacaggttgcccttgccattagtggtggtatgcaatcatcccaaatattacgaagagttaacctctagaactaacaaacatccttaaaaaaaacaaattttgctaagaacattcaaagtttatatagtttgctggtagatatcgtaaaaacatgatacgattggaggacacactcaaaatgtggtaatttgttatagaatactttcggccaattaaagagagaaagtctttaaaatataagcttagcttctatttgaaaatttgaaaattatgcaactctaaatcttccatcacccaaagtacattgcttgcatacatcatattccatcaccaaagtcaggttagaagcttttggctcgaaggacattctcgtctttttgaataatctctagccaattaggctgaatgggtcctctagcaaattattagctttttacagtgttctccaattgttatacatttttcgatgtctaccaacaaattacacaaactttgagtatcctgtagcaaaatttgtcaaaaaaaaaaggtacaaacaagcattgattttctcataactccgcatatttagctttattgcaaaaaaaaaaagaagacaaagaaccttcaaaactttctaaaatatattataaacactactactttattgaatcatctccaagaaaagagtataagctttacaagaatatatcctatttatgtgaagtactaagatctttacctaaccaaaagaataatcatgtacacgattttgaggcagctcagactgaaaacactcaacaatgctaacatcacatgaagcctcttattactatacaggaaaaagaactgctccagtttgatctaccctgcaaaaatcaatacaatcagtctaccaattgccaacaaacatagttaaaacataacgtctgcaaagaaaggaaggaaggaacaggagagaaaacggtcatagaaattcccgatcgaccgagcgccgtttccgtataagggataccgtttctgaccgtaccgtttttggctatcttaaaattttttttctaatttctttctgcatcgtattaatatcgatattgagtagttaaaatgataaatatggtcaattaccggccgatcgagcatcgtttctgaagagatgctaccgattccgatcgttttcgaccgttttcacccctaaataggacgaccttgttctatctaaataaaatggtaataagctctccccctatatggactagaacacttcaaagttgcctcaccttaaaatgtatcaagatttaggggaacatcttcatcaggcttcgcttttggttgagtttccttgccaattagtttcagaggaacatctagttcaggggggctctgcacatatagttatttagataatcagtgatgcactaaacaaactatctttgtcgaaatgtcttgatgctcgaaacattcaaagtaccatgcaacgtatgagtggccaattgatgtcttgaaaaaaggaatgttgcttgatgtcatttgcaccagcatttgaacctatacgatttgaaggatctctctgaagtaatccatggattaattgctttgctgcaagactaacctggagaatcatagtgatattaataaatgagaacaaatgaaaactaaaatacaataacgaagtgtaagataggcataaacattttcttatctaacacatgctaacacatacccttaacatgatatcttacaggcttgctggacagattgtaaattggactcaacctttgtagttgcaaattgaatacagtatgcaaaaaatattggcctgcatgacaggaaacttcactggccatttctctaaaaaagaagttcttaccggaatgctactgggaaatgtaaggtctttgtgcagtatgttataaaatgtctttttcctgttctttcctcggaaaggtgtacgcccatacagcatctcatacaatagaattcctatagcatgggaattgatgttagctggatgtcatcttattattagcataatgcatatcaaacaatataataatgccatatcaaacaagttctcatggttaggtacttaggtgtacctgaaaacacatatctagtacttacacatcttataattatctagagagactagggatgtattggtgtggtagatacatatacagatctcagaaataaacacatacggagggcagtgtaccttcgggtgcttctaggcatttgacatctaagcagcatggttcaattgacacatggagaatttggataggttggagtcagcacataaacccacatgttctaatcatagcacctaccggtaccttttacacggaggccacttccatggaagggctaggcatgagaggatttttagaagggatattacaccattcaattttatgtttgttttgatccctgttatctagttaaactgactaacctacttaatgtgatgtaaattaaaaaagtgtgatatagatcagttatagcaggcaaaagtttgctgcagtgcaacttgtgacatgagttttgtttaattatgcatagcagtgtagcacaaaacaattaacttaaccgctaattatttagtcaaagtggtaatatggactattctctgggtggaaacccatgttcaaaatcttgtttgaatggcacatggattattatgaataatttgatgagattttagttgaacctcaaacatcttttaggtgattgctataagactataccaactaccaagaagatcgaataaataaaactaactcttttaatccattctgtgcaattcttgtaatcaactagttcataagatgacccaaaaaaatatattaggttattgcttaccgagagcccaccaatcgattgcacttgtatgccctgcacccgttataacctcctaaaacgatgcaaaagttagacaacaatcatgctacttgctgagaaagaatcagagaccaacattgacaacaagcggtttcgtaagatgaactgaaaaatgaaaagcatacatgtaaaattaactaaaagataaaaaggctacacctgggtcttatgataatgcatatcaagttgaaattaaaacaattactccaacaataagcataaagaaaacacaaggatcattcttactggagcgatatactcttcagtaccaacaaatgaatttgatggagtggaaggttctgagacaaatgttggggggagaaattcttgtgaccttcttcgttttaatgatgtggaattttttatcacctgcaggagatttaaccaacatcagggcaatatcaagtgttttaagtgcgatagtttcttatgaacaacaaaaacacatgctggaaaccaccaacaagtactcaatataaacatgttcttgacaccattactgactttgaatactatgcaagtggaaaactcaaagctcattactcaggaatgaagtatatttttgttttaaagtttgcgatcacacattctagcatacagactataaatgaccaaaaaaaatgaaggtaaatggaattagcaaatattctataaaaactgcagcaagcctgaaagtttattccctcaacttacgtggggttttgaagtcgtcaaaaatgaaagatcaaaatcagtcagtacaatgtgcccatctgcttggagcaaaatgttttctggcttcagatcacggtatataatacctacagcaggaataacacatgcagattagcaatctttgatctcataataagtccaatggcaaatcagtatctttaatgaaatagaaatagatcgccgattgttaacagtaaacattattaatacttggtttcactcaatgaatctgttcaaaagataggagcactaaattatgtaaacacatctatacctaggcaatgaaggtactcgagaccaattacaacctctgcagcataaaacctacagaacggatcaaaataatgttatataataaaagagagagtaggtgagtcgaatgatatagttaacataagatgataaggattcatggcaagaatctcaattatcttatttttatatttctttactcctttaaatgttccttgtgggggtggtggtgagtctgcctcacataactagtcaaaagagaagactgaaaagaatggatatcgaagacttctggtgggtgttcgagaaaaagactactggtagtattctgttacatttctttcttctttttttttttcatacatgtagttcttcaatcctacactacatgtatgtgacaaaattatttactagaaacaatttcattctattgagcctcagaaacagtatatcacaacaactgaactcaacagctgtttgcaaataatcattcacaagttagcaaaagcttcaaacattgcaatccatgcaaacccagcataatttattaagaaaaaagcaactttatcatcattatgggaaaactacatacttggatagtttctacaacagaacataattgtttgtatcaaatttgggggaaggaataatctggctggcagatccaagttcaatcaagtagttcatatttacttgtttgtctgcccatggggtttacatggcagtaaaagcaatgcagtagttccccaaatcagtttccacagttttatttatcataagctagtaaaatagattaaaaaatgtaataatatgtaagatgtaagtacttttgatgacacatctttaggtggccaaacctattacaggaacaaatattatttgtaaaaaaaactatattccatacttgggaaattatgtaagagatacacttcaagaatgaaagaaaaggtaaattttgaaaacatcatgattttcaaatagtggtatgtacgaactgacccagatgcaggaaattggaacaggtaccttgcacattcttccctgaaaattttcatgggttgcctatcaagcactgcaaagagttctcctcccggacaaaagtctgttatgagacaaacatgtgttggcgtctgaaaatagacaacattagtaaagaaccttgtggtttttaaattagctggataatgaaaaactagtatggaagttaatacaaaaactactctctgatgtttgtgaaatgatgaacaccttacagaagccatatttaactgaaactatgagtaattattttatttaactagcaatacaaaatatctgggataaagcattggtcataacaatgtcagtctaacctgaaatgaagtatacaatgttgggagaaatggatgatccaatagtgcgtatatttctctttcaatacaagctcgatgtacctgcaagagagagggagttgaagtaattcttgcaccttatcgtactagcaacagcaggaaaaaggttgatcacatccagcatggatggaaatacaataacaacataacagcatgctcatgttcatgaattaaaattaccttgttgcggttcaacatcactgacttgtccatggccttcattgcaaataattcaccacttccttgtagctcaaccaagtgcacactgaattcaaaaacaaagagatggtatagagatacttaaacagggtggtatagaggcactataacctagacatgcaccatacagaaaagaacaagggagcctaagaaatatactctatccaattagaaaaaacctaacattaatattatactagttgtatccagtcctgctaacttgtagccacataaaagaatatttctggtttgtcctgttaaggccattaaagaatttcaagatcccgtcgaaccacttagtgtcatggtagtgactatttttactaaaaaaacattttaattaatccaaactagacaaaactatgactgacgttaccagttttttatgatgcagtcaaagtaaacattttgtttctgacagcatgctttcagaagatataacaaccatctatcagttagcaaaaagacatcgtatagaagattgttcaggacatcttagtacctgccagtgtcaccacagccgagaggttttacaggcttgaagtgtttcaagccaatcttctcccctaaatttgtagcctgcatgccaaataataataaaaaatttatggtttcatagaatttaatttgggagtttcagttaatatgtttcccattcaattttaggatgcacattatcatatttttaaaaatcagagactattaagagcttagggtgctaccagcgtccagccatttagtacaatccaggggtacacatttgctactttggaacatgtgtgattacagtcattactttgcatggattcatgtactaattcactggaacatgtttatagtcatgcggacagcacgctcaaactaacctgggtgctggttagcgcttttgacggaccatatataatataatgcataaacttttttcttgaatatgcaagagagttgcgtatcatttcattatgaagaagagaaaacggaggaacggggagggacccctctcctcaccaa

SEQ ID NO: 35476 - DNA, 753 bp, Oryza sativa
  unsure (1)..(753): unsure at all n locations
tagttatgaactaagttactgcctgaaaatgggtgaaatgcagcatcatacataatatgtgctctcaattacctccatcatgttctacagtagtcctactttcagcataatagtaacaaacatataggcgctggacaacacaccatcatcccttttctgccttgctttctatttaacaaatattaatgcattcttgccaggaaatctggttaaaaaggataacatgagacactattggcgttaacctccaagttcacttactcagctagtcagaggaattcttttgctataagcctagcattatatattatagagtattatctaatttggtacagtttgactcattgctgctgcagtaatagaatttgcgcaccaaacaacaaaattaacgtaccttttctatagctatccaagaagggttattccgtttgtgaggttttggagaaacacgcattgagtgaattgcccacaaatcctctggtctctgagacaaagatagattgtgttatgccccaacataacagagaaaagttaaataaaatacttctctaactacaatattcatataaggtacattaccattttttctcttttataatttagatattagttgtttacagtgtgctgcacaatggccaagtgcaaacagatgcgaggagcaaaccaaaacaatcatttaagtgtgaacgtcagnnnnnnnnnnnnnnnnnnnnnnnnnnnnnnnnnnnnnnnnnnnnnnnnnnnnnnnnnnnn

SEQ ID NO: 35477 - DNA, 953 bp, Oryza sativa
gaatgaacccggcctccaaaagtctagccacctcctcgcggatgaaggcttgacgttccggggcttgccgccgcactttctgccggaccggccttgcacccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcctggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctcaatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatgtccttgaggctccggcga

SEQ ID NO: 35478 - DNA, 696 bp, Oryza sativa
ttggttaccgttgactttttagcacatgtttaaccgttcgtcttattcaataacttttgtgaaatatgtaaaaaaaaaacttttgtgaaatatgtaaaactatatgtatacatataggtatatttaacaatgaatcaaatgatagaaaaaaattaataattacttaaatttttttaataagacgaacggtcaaacatattaaaaaaatcaaacgcgtcaaatatttcaaaacggaggaagtaatttagttggctttctctttgctcagaatgagtggtgggagccgcaaaccggtgtttacactgtgaagttcgaacactcagacacgctactgattttgcacagcaaaattgatggcacactggagatgcccgtatagttgacaaaaatgttacacgcactgacaataacaacattataaagggctttcacagtgcggggacgtagcgagtttcttcgcactgctagctagaaaaatcgccacctgtcaaccgggagtgcaccccactagagtccctcgttcccacgttgagatacgctattcttcccctcctaagtccacgcgcggcggagaaagagcttctcgtgtgcactgtggagggtgtggctctgtcgcgcgcgttcccctcgcgccgcctgggagaaaaattccaaaattgccctcccgcccccacctatttcttcctcccgcgcaag

SEQ ID NO: 35479 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnnnnntataaaagcatcgagaaaaggatttgctcccttcctttcgccattgttcctcttgccttcgctgcctgagctctaactctttctctgccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcgatggctgggctggtcccgccattttctcattttttcatggatgttctggagttctacaatctccagatggcgcacctcacccccaatgcggtgatgacactggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgctgaaccgctatatcccctgcgtcctccgcaagaagtgggacgactggaagagcgactggttctacacccccctcgccgacgaagcgcgcct

SEQ ID NO: 35480 - DNA, 643 bp, Oryza sativa
caaaggagaaaggaagccattacttgagtccagccagctacactcttagcaaggcagagaaggaaagtatgtttgaatgcttggagagcataaatgtactgtctggataatccacgaatatcaagcgaataataagcacgaaggagaagaaattcacaaacctaaagtctcatgactgtcacgtgttgatgacataactgctaccagttgtaataaggggtatccttccaaacaatgtctgggcaacaataacaaagctatgtgcattcatgaacgcaaggtcatcgattcggatagattagaagcccttcagaatgatgtggtgcaatgtcttgtcagttttgagttgatatttccaccttcatttttcaatataatgacgcatctgctttgtcaccttgtcaaagagatcagtattctcgggcctgtgtacctacgtaacatgtttcctttcgagaggtacatgggcgttctgaagaagtatgttcgtaaccgtgctcgtccagaggcaagcatcgccaaggggtatggaatagaggaggtcatcgaattttgcgtagaatttattgaataccttcgcccaatcggggtacctgaatcatgccatgaagggagactacggggaaagggaactctcggaagg

SEQ ID NO: 35481 - DNA, 595 bp, Oryza sativa
cttttaatgcatgattaattctacgtgctatcaattctagtcacattcttatatgacgtacactgataggcaacttttgggagaggaaatctccaacttcacagttagagatctgcagcttctccagaaccaagttgagatgagcctacattccataagaaataaaaaggtataatattgataatacccttttctcgactaataaataaataatcttttcctaattaaatggcgatatatctattgtctctttactaggatcaacttttggcagaggagattctaaaactcaatgaaaaggttgtacttgcatcttcttcttcttgatgaaatagctcatgatttaattggtatcagttcttacatctatacactgttcatgattgaggtaaaattacacgaatatatatcgctctatacttttaattgtaggggtctcttgttcaaaaggagaacagtgaacttcgcaagaagttcaacattgctcatcaacgcaacatagaattacacaagaaggtaaagtttctattcgatctactcgaaacatacaaaaatgtcgtagaatattattgatatataaatatacaatttacat

SEQ ID NO: 35482 - DNA, 580 bp, Oryza sativa
  unsure (1)..(580): unsure at all n locations
aatctgaaagaaacctttgcgagcatccgtgctttcaggatgaaactaaacccaaaaaaatgccctttcggagtactgtcaggaaagctgcttggatttatggtgtctcacagaggcatacaggccaacccggagaaagtcaacgccatcctcaacatgaagccgccgtgttcctagaaacacgttcaaaagctgactgaatgcatgtcggtgctcagtcggtttgtctcacgactcggcgagcgggggatgcccttcttcaaactgttaaagaaaacagacaatttctagtggggacccgaagcacagaaagcctttgaagatttcaagaaacttctcactactccaccagttttggcctcaccacacccacaagagccgctattactatacgtatcggccacttctcaggttgtgagcgcggtcctggttgtcgagcgtgaagaagaaggccatgttcagaaagtccagtgaccgatctacttcgttagtgaggtgttggccgattccaagacgagatatcctcaagttcagaagctgttnnnnnnnnnnnnnnnnnnnnnnnnnnnnnnnnnnnnnn

SEQ ID NO: 35483 - DNA, 1778 bp, Oryza sativa
caacatctgaccaagatcatccgcaacgtcgttaccatcagcatccctttcctcctcgcccgtttgatttccttcaaatccaacgtactgagcaaagtccggaatattgtcatcttccacttcatcttcttccatttcaacaccttgctctccgtgggatgtccaacaattatagcttggcatgaaccccgactcaaacaagtggaaatgaattgtcctggatgcagaatactccttctgattcttacacttgttgcatggacaacaaataaaacccttatgcctgttagctttggtcactctcaaaaaataatgcacgccgtcaataaactctttggaccgccggtcagcgtacatccattgccgatccatctacatgacatgaaaaaaaatcgtacacaaataattattcttacaataatgacaatcatataataattataaaataattacgaactctttcaacagttatacaataatgacatatctttattcatttaaaaatcataaaatattacaccaaataattcttatttactatttctaatgttttaaactaatattaatgtgttttacttcttttaattttcattttagtttgttttctattatttaagattaactttcactatattttccttctcaactattttataaaaccttctttagcaaatcaactaaatttctatatattctttctttcccacacaaattttctctcttatcaacttacaactaaattttggagacaaaaaagtgtgtaaaacatagctccaaatgtaatatgacaaaaaaaaatattggaggatgaacttgcaaaccttttaggcacctccgatttgtatgtaatcatcaaaattaattcactagaaattttggcatgaccttctatcttttttgaagaaattttgaagcttgctcgggcagctggaggaggaagaagacatatatatatataggggtgggactttagtcccggttggtgttaccaaccgggactaaagatcccgggggggcctgacaggccctgacagcatttgaaccgggtaacgggcatatttgatctttagtcccggtagccccggtttttattgcatctaggactattgtggaattcggccgaccgacgaaagatatttctccaccagtgaaagtgtgagttgtacgtatcatcatggcaatatacgatacattcgatacgcggatatgtgcaaaagtttcattcgaaatagatatatccatttgttccatatgcgcgtcattagaaaaaactcatttggaaacaagtggaaatttgtggagttacgcacatgagaaaaaaaaaacatacacacacagagcaatgggaaaaatgggaattaaatcatggggcccacactggccagtgtcacgcgagaaaatggatattttgccatcctcaaaacatggtttcgttggaatgccatctaaaaaacgcaatttgttaaaatgccaatatggaccgcgcgaccacagccactttgctattttctccattttctctcttttctccattttcaatttcattttcgctggagtagagcttgatgagacgattttgcccctgcttgccggctaaaaggggatcgagatctcgcgagctaccggccatggctcgacgcgccgcagccgccgacggagagtcccgtcgccgccttgccgctcctcatcctcctcgtctttctcctctcaacttcactcggtatggtcgccacaccggtgcgagaaactcgatgttggtttcttcgcattccaggctt

SEQ ID NO: 35484 - DNA, 616 bp, Oryza sativa
  unsure (1)..(616): unsure at all n locations
nnnnnnnnnnnnnnnnnnnnnnnnnnnnnnnnnnnnnncaagtttatgattttgaagaaattgcaagacaggtttgatcagttgaatatttccatgagtgtatataagaattctcagaagtttcaaaatggtcttgggatgtcctaagcttaccattaattatcgacatcattgaagagataatgcgatgtagaaagatgtctgattcttgaaacagtaggttcttttgtctgaagaccatgacaaactgaattaacacctagaaatccaattactacatcatctagcattggatacgaaggtacgttactcagaagattgagtggatccaccacgatggtaattgatgaaacctacgtagacaatgcttatccaaatgagtgccttccatgaattctgatcctttgcaaaataggtcctccaacggtaaaactagatttggattcttagcaaaaattagttccacatcgttgtagttcgcggcttttgctgtatatatatcgacaaagaaaatcgctataaaattatttttttaacatgatataaatgcatgtgtttatataaaacgcgcgcgcactcaccctataaataattagccgtgaatgcgagcacccat

SEQ ID NO: 35485 - DNA, 645 bp, Oryza sativa
  unsure (1)..(645): unsure at all n locations
nnnnnnnnnnnnnnnnnnnnnnnnnnnnnnnnnnnnnnnnnnnnnnnnnnnnnnnnnnnaaccgaatccatgccctatttacagttgttaggaaggattaatttattatccgagatccgtatagtacttgtagaatgattcataatgacagtgcaatatatgacaatacctatctatcacttcgaaaatatgtgcgaaagttttctccggtttatccattgattcgtagacatagattttggatttctcaaggttgaaaagaataaggacccagtggaatctgcaatttgcattagatgatacatgtgtgtgtgtctatatatatatatatatatatatatagagagagagagaggaaggaacaaaattgaagttatgattgtaggaactcacgatgtgttgtagggaagtagtatgaacatcttataatgctgctgcaccgggaaatggaggatattgtcctcggtttgtttctcatagttttgtagcatcagcgtgttcactttgcgggggtccatgaatcctgtattgaatttgttgtgccgacggcacaactgaatctctattctacaacgggtacaaggaatttgtataagctacgttcaaaggaggaacaaaattgaactataaacaatacttacaaag

SEQ ID NO: 35486 - DNA, 1555 bp, Oryza sativa
  unsure (1)..(1555): unsure at all n locations
nnnnnnnnnnnnnnnnnnnnnnnnnnnnnnnnnnnnnnnnnnnnnnnnnnnnnnnnnnnnnntcgacacatttatcagcctaaatctgtcaaattctgagaccatataagtaacaatagattactaagattaatacgataccaagcacaaaaattgttataaaagttagttgattgaacaaaacgatgactaaccttgatcaattcagtcattgatcacctaagacatatcagatgacaacacaggaacagacaatatttattaacgaagttcagccgaagcctacatgtctgggactttgattatggacgctccaacccaatcaatatagcacgcttttattctacaaaatatttagtaatactattaggagtgcagcgcgctccttagtattccgagcgccaaacatgtattagtccaggcgcacttcaccccacgtcccgtcatcccgctcccatcgttatcagagtaaacgatttacttcgataataaaaacaacttccctactcccgatcccatcccatgtcccgtcatcctgcgtccactattatcggagtaaatggtttacttcgataaagacaacttccctgattcctgtatatattttatttttcccatacccaaccaaccactctcgtccccacttcaatttttttccctttttttcggatctgaattgatccaccatcccagcccacagatcggtgacgcaccatggagtaggacggcgacaccgtggcggttgagggctattgatggtagttagcgatcaggtttgaccgtcaatattaccaaaatagaggagaactagttatgcttgcattgcatatccatgttagaataataatattccattagtatttggttcactaacattttgcagagaataatcattaagtggaggagaatcgacatcaaatcagatgataaatcaatcggacgatgtcgagaatcagacttatgtatgaatgggccaagaactcagaattgacacgatgaattgggccaaaattcacaagtctgcgtatgagagcaacggaggaggccacctgccaattttgggctaggccggcccgacccatggttcggccgaaccccccgcagcgccattcaatccaggtttctcctggacggcatagatgactccccaataacggttggtgggtattaccgatctttccaaccgtcataaccgtcattctcaagctataaaaggagctctcatcctcattttactcacacacctcaagcaagagttctctcatattttctcaagttagtttagtgttctcaagctagtggaataggaatagagtagaaatcggaatccggaagccttcggaagtgttcgggtatggctctagtagctcttctcttctcttttgtaagctttgtacttttattagaatactcttctatatacatttatggtattgaaatactttccgagtatatggatgccaactttacattatgttcatgtcatactgattataccgctagcttatctgggagatgcattggtacggggtaccgagctcgaattcgccctata

SEQ ID NO: 35487 - DNA, 1333 bp, Oryza sativa
ggtcatgacgggctgtcgtaaggaactcgacagttaagggtggcttctcgaagtatcaggaggacatcggatatagggaattagctagtatgtcagataactaggatgtatgtatactatgtatactagaagtataggaatagattctctttctattttgtttccacttagcttacatcctagccacgcctgacatacgtacatctatacaaccggtatagatgtatagatagatagattagcagaagtggaaaacgtgagaactcataattaaaaagtactattagtataggtatagatagatagattagcaccataccatttctgtcacgttttccatccatctccctcattttccgtcttcttccttctctcttcctcaagaaatggcaccacccgcacctgttgtgacggcagcggcagacatccccaccggtgtggccgcccttgcctccgccggacgacgacaacctcatccaggagatcctcctccacctcccctcacagctgtcgaccattcggccctcgcgcctccctcgtctgcaagcagttgcgccgcctcgtctcccggattccttcgccgcttctgagcccaccaccgggattctttcctcctcggcgttttcaagaacgagctctgctaccccatcttcagatccgtcctcgatcgcgagatcttatctcgctcaaccatttcgccctgcggctcaacggcgaccacgtcgcaagcctcctcggttgccaccacagcatcttctcatcttcaactacaacacccgtgagttcctcgtgtggaatctcgttcggcaatcgccatagccgttccgtcgaagctcaccagggaggggtggagggagaaattcgtcatgaacggcgtgatgctttgtgttgctgctgtcatcggcgacggcagccatgtgcacggcagcggcttctagtcctgccgcttcaaggtggtctcttgatcccgcacccgccgccgccatcttcgcacctactgttacagcggcaggtgcggttggcgccaccgttcttggggaagagagaaggaagaagacagattgatagaaaacgtaacaggagtggcactgtcccaattttataaaagtccagtgacattcatctaaatagctgcatataccatggcacggacctaattgtttttttaaaaaaaaacggagcaatggcctaagttcacagatggcccacacaggcccatgttcatacatggcccacgctggcccatgtggcgctgcgtggaacagttggcccaatttccatccccatccgtgtcaatatcgatacacggtaccgagctcgaattcgccctata

SEQ ID NO: 35488 - DNA, 1380 bp, Oryza sativa
ctattagcttggaaagtccaaagtcagccaatttagcattgaaattctcgtctaaaagaatattctgtggtttgatatccagatgagcaatttttcgcctgcattcctcatgaagataacataaacccttggcaatatccataatgatcttacaccttgtgcaccaatcaagaggagcattgttgtggcggtaatatatccacctatcaagtgaccctcttggcatatattcatataccagaagcctatttgatttctctgcgcaaaatccaattagcctgacaagattgatgtgctcaatgctgccaatagtctcgacctctgccaagaactccttctttccctgtctagcaccttccagacgtttcaccgctacactctcttcacctatttttccttcgaagaccgatccaaatccaccttcgccaagctttttactgaaatcttcggtgcattctcttaacttttcaaaagagaaccgcgttggcattccaggcaatatatcaaattctaattcttcatctagttcttgatacttcctcctccttcgtacatatatagcaacaataacaactaaaacaagagtagtaattgctgcaagtgtagcacctaaaattgtcttcaattttttttgtgtagggtcagaagagggagtaatctgtacctttagataagctgaagagttgtaattaaccttttcaggttgtattgactgcaaggagaatacctctgtcactgaccggcattctccattggaatcattctgaccatacctgaacgctactgctttgcatgagcaattcttcaagcaggcttgcttgcagtcatctctattttttgcattcatgatgatttggctcatatcaaagtaagaaacatcagtaagagtcaagagctgatgatttttgatttcttgacaagatactggtgtcactggtgcacaaccaagattagtcttccgctcgtcaactagctggaagtaacgtgaactagaattactctgaaagggacagatgcattgcccacttgtgcatatcccgtactccccgcacactgttgggaaagcacaatcatcaacatgtaggaattccttcattacatcagacaccatgatccagcttggttctccacgagaccactcaaacagcctcaagtgcccatcagactctaaccttatgtactgggtggacttagcttcttggaattggatactttcatctggatttcctggatgtgtggactgcaaaaagatgctgaggctgccatttgtaaaggtaatccttgttggatctctctggctcatgtttctgctcagctcatgcttaaagtatagttgtggtggtgtggattcaacataaccatgtacaccatcacggagaa

SEQ ID NO: 35489 - DNA, 7697 bp, Oryza sativa
  unsure (1)..(7697): unsure at all n locations
ggtactgaagtgccgctcgaccagatgagtctgccattggctttttcacggaggaccaggtcgccatctccagtcagctcaagggtagcattctctcctacagggcttgcctggttggcacaccagacaacccgtgccattttatttaccgggaaagaatctgtgtcagggaaaatgaagactgcgaagatgaattcttggcagggtggggtgcagaagaaccctgcggcaaatgagagatcggaggtttgtggtgatcggaggactatggcacgtaccaacccatcttcatatgggacgctgtcaaggactttgtttttgacccacagtgtcgagaggttggcactgggatagacggagcgctgcccggacaccggtggtgcggcaactgcgagcaccacgaccaccagcaccgtgaagtcggcgaagagatttccaggagacatgtttcttggattggaaagggaggagtgaagccagcaagaagctgtggtcagttcagaggttgacaagatctcctgacctgatgacactaagtcgatgagctgatgtggtcaccggaaagatatatggcctcaccgtcgccggcatggggtcgccggactggcggactctgaagtgtttgatcggctacttgtgttctcgctctctcagtacttcataactatatattaccacccggtgctttagttttttggtttcttgggaagatggaattttggcttgaccagttctaaatggccaataatggttttggtttctgcaaaaagatatgtagcctagtggttactaagtgacctcaaatttcagtttggatgtttgcaatttaaatgtttgcatatatccggttggatgtaaaggccgagtaaaaaatatccgtctctaaaagaaataataaaaaaaagaccaataaggccggtaaaaatacctttctctaaaaaataaaaataatattaagaaaatgaccaatcgagtttccctatgttgtcacgtgatttttaataataaaaagaaaaagcacatattgataaaaataagcattaaaaagcccaaaactatatgctacccggtcaaaattagttagcttcagtacggcatgacaaaaaataactagtggttaagccgggtaaaaaatacccttccctaaaaaaattaaaaataatattaaaaaatggccaataatcatctgtgctcaccatgtgatcgagagtatggtgagtagagttaactatatgctcgccatgtgatctagtttcgttacgttgtcacatggtttttaataataaaaagaaaagcacatgttgataaaattagcattaacaagcccaaaactatgtgctacccggtcaagattagttagcatcagtacgtataactagtacggttagccagtgtattatactattggcacaaatgtgtggaggatgggagcgttggctaaaatagagaggacagctggactaacccatgaccttggtccttgggcttagaattgcaaaagtatgtatgggtgagtagaggtaatctatactgcaatatgtagcaacgtacttgcacgaacatgtatgctgattcctgaccgtctggtcgcgaaatctggcggatggaccagattcgtctcacacgatcgtccggaaaaatcacccgcgcgaaccattgatcctatcccaccacgtaccgatcgaccccactcatccaatcgtacttcctgccttgcccgatgacgtacctcgtgcgctgtcaattgcgccccttcctcaaacctccttcggccttcctcctcgtctccttccgaacaccgtcatcacatatgagccccgagtgataaggacgtcgtcactttatacacacttaattaactccacaagttctaatgataatttgaagtctagttcgacctccaagttctaatgataatttgaagtctagctagttcgacctccaaaattagtaccgacttcaaacatgttgaacatttatgctaactccgatttgatcttgaacatgttggaaagcttatctcgttactttttaaacacacccagtctcatatcaaaattcatcctaagtcaacagaaatcatcaaaacaatacattgttgtttgctgaaaccgaacttgaaccttgagtcttataatagattatacccatctaggaaatgcctctctccacctccacaaccagcaactatctctagctttattatcataaaaagctttatacatcctgtaaaacaattgagttttgtttatttgaattttgccaagtgtcattcactttgtctctagtcatcctcgtttaattagtcggtgactatagattcagagtcactaatagttggtgtgtttatttgccgggtcgattagatctaccaccttaattgtaactatttcttgatgcttaattacctattcgcaatatttagattgtatcttatcttattcatgcagtgttctctcgtttgcattgtaggatcatcaaccacgcgtcagggttagtatgacatcgtttatggtgtagcaattgcacgacgttctggacttgttctggttggtagacacgtcgcacttgatcaaagcgagagttatcacctcaccagaagattgtaccacaagatatagcatcattagttggtatcagagcgtcggttgcgtggtgaagattttagttttgtatatttattttttctatctatcatctacaaaattactgtaaatgggtcttctttgataggtttgtttttttttccatcgtaggacatcaatttaaaatatgggtagttttagcacacttgagcaattgagtcaaattttagtacgcttaagcagtggaggcacatttgccattccagtggacgtatggtacgagtacacactaatctgacaaggtcaaagagcttagtagttgttttatatgcaatttgtttgttttgattggttgatttttctttaaaccaaattgcaatataggagataaagaaaacgtagagattgatccagtagagttttaatcgatctgtctaggtaaaagagctttgtatattttttttaggtctgcatgtgtgtttgcttggctttttcttaaccaaattgcaatagaagatagtaataggaaataccatggatcaacggcacgatttatcatgctatgctataggccctattgatggggggcgcagacactactggagaagtactcatctcttccggttcgcaaccccctttactcccaggtagcgaatcggaagggagaatccgggactaaagatgacagtctttagtcccggtttaaatacccgggagtaaagcttcatctttagttccggttggtaacgacttagccacgtggctggcacaaccatctttagtcccggttaccaaccgggactaaagattttgttttattttttttaatttggttgtgctgcctactgtagaaatgtatagtatagaaatgtatatattacacatatgtacactatatgtatctatacatatctatacatatatatatagtgtacacatatatatgcaatgtcaatatatacatatgtagaaattcatatgtatatacaaatattatacacttaagaggccatatacatatattaacaaaatatgagtttgcaagtaagtaaatatacacatatattaccaaaataagtacacaaaagtaaatgcatgtgtgcatatataaatatatacatgtattacaattccttcggactttgtaatctttgtttctgttactacgacttcctggcattggaagaagaaggaccggcttgatgaataggctttctgaacgtgcagagatgtagcctagaggggggggtgaataggctttcctgaaattttctcaacaatcgcagcggttaaattgacagggcccggaacctcctggtgatgaacaccggaacttctgggcaggatgagtagcccggaacttccggagttcttgagccaggaacttccgggcagcagagataaattaaaactgagatgaaaaacaggtcctagcaagggaagtttaggcacacagaggaacaagatgaagatcacaagatatcagcagattcaaacaaagaacatgcacaagagagacaaagacgattttttcccgaagttcggatcacacgaatcctactctccgttgaggtgctccaaagagccgggtctcgattaaccccttgcctcacttatgcaaagatctcagaagaggtccacgaccttcaactcaacacttctaggtcattttctagaattgagtgaccaccaagatcaaactcaaaattccttctagaaaaggccacaagtgcacgttgctctacctaggataacctctgaaaactcagcacaagaatctttactcacttacctcgtttccttgcggaggtgaggaaaaccttcacaaactttcccgggacatccacaagatctttggaagctcacgggcaacacataactgtctaggagaagatctcaaagagtaataagcctaagtgacagcccacaaggtatccaaagtgctcaatcaagcctaatcttcaagccatctctaaaatactcctacactctcatctaatctctcaatctcacaagataggctctagatttcagtggaggaagcaaaggaagcttgggaatggctagaaaatcctagaacataaaagaactgaagtggaatggccaaagggtgacctggggacgaaatccatatatataatggctaggtgacgtcatctagccgttactcacaagtttgaactggaaacctgccaggaggttccgggcaaaagtgccaacttccgggcagcacttaggaacttttttgcaattaaacagcgcccggaagtttcggccagaacctccgggtagccctctctgtcccggggagaaaatcatttttcaaaaatgattccaaaaatcttttgactcatggatatgactaagagcactttgtataccctagatccacacttgaaacccctcttaatagtacggtttttcctaaactcaatttcgaaagtgaaaaacctagtctaatcacctttggtgatttttgcacataggaacattcctattggggggggggtctccttgcattcttagccatcacaacttgcttttggactaaactcctgtgaataaacttgataaacacgttagtcccctttaaccaccttgtcattaatcaccaaaacccactagggggtttaagtgcatcttcactttccatcgtaatagaattctcctgtgggatcgagaatctgcccgttgatgaatctcatcatctgttcttgaacagcccttatgaaatcatcgtgggtgaggctatatatcatgtaaatcatctgtcatttggaaaaaaaataggattatacatatgaaaccagtaaacaataattgacggatgaataattttacgtacttccaggtcctggccaatcctgatttggtgtgctaagcagtgcatgtaatagcagacgtagtagccgcacaagttagtcccctattcctgctttgcacactgaaagagaaacaacgagagatttaatatgcatatctaatttataacaaagaagtaattcaatataatattggagcatgtactaaccggaaaattgaacctctgtgtgagtttttcattccaaatcccgcggaccaatgtacagaaccgaatccatgccctatttacagttgttaggaaggattaatttattatccgagatccgtatagtacttgtagaatgattcataatgacagtgcaatatatgacaatacctatctatcacttcgaaaatatgtgcgaaagttttctccggtttatccattgattcgtagacatagattttggatttctcaaggttgaaaagaataaggacccagtggaatctgcaatttgcattagatgatacatgtgtgtgtgtctatatatatatatatatatatatatagagagagagagaggaaggaacaaaattgaagttatgattgtaggaactcacgatgtgttgtagggaagtagtatgaacatcttataatgctgctgcaccgggaaatggaggatattgtcctcggtttgtttctcatagttttgtagcatcagcgtgttcactttgcgggggtccatgaatcctgtattgaatttgttgtgccgacggcacaactgaatctctattctacaacgggtacaaggaatttgtataagctacgttcaaaggaggaacaaaattgaactataaacaatacttacaaagtccacgtgctgagaatagagacgtcgagggcgtcgcggtggtataagtcgaagacttctttgtaacggatccaaagaacatcatctccttgataataatctgagtttcgcaccctcgctccgaacatctctctgcccatccctgatttgtccaagtaccattgatgaaaccggtacatctgtgtaggtagctttctcttatcttatcaggcgtgactagcggttcaccatgtttaaacatgtacttttaccggagctgtttcgataggtgcgtcctctagcaactctgctccatctttagtccagtttctttcaagaacttgcgtatctcaagttgttccggatctacgaacggttcaacctcttgttgtggctacagccccagctgagggacttccattccgcacttcactgctgcaggcttggctttaagagccttcctcaatgttcgatcataatcagaaactacgaccggtttgctcagttcagccatcttaataaagtgatcctgaaccactggggatatagggatcttcttttccggactccatggcttcaactgctccctaacttccactctaacggcttcatcgagctcctccggagtcaagtcatacgcccttttcttgagagcggggagccttggctcgtcagatttggctttcttctttggtcttgatggcatgggctcatatgggcaggaccttgacggtgtagacttggcagttggtgtaggctgaggagtcgttgcccgcggacccgacggtgcagacttggcagcaggtacacacggaggaggtggtggaggcagaggagcgggaggagccggtgtagccgaaggagacggaggaggcggaggagacggtgcttgcggcggggaaggaggaacggactaataaaccactttagtcccggttctttttggaaccgggactattgtggaaatcgcccgaccctctaaagatcacttctccagtagtgtgatacctgactggtcgcgtgcatgcgaggccacatgatcagctacatatgtatatactatctacatgtataatgagtatgtatatattgtatatacatacatatatataaatatatatataaatatagttttttatatgtatacattttaatgtataaaaatatacatttttaatgtataaatatatatatacacatatatgaaatttgtatacatatatatacaaacttggtatatgtatgtacataaaatataccaactttttatacgtatatatacaaagtttatatacgcacgtatagaaataccaaaaatacacgtatatacatgtacataaactttgtatacacgtataaaaagtttatatatgtacgtctttaaataaccggaaaaagaannnnnnnnnnnnnnnnnnnnnnnnnnnnnnnnnnnnnnnnnnnnnnnnnnnnnnnnnnn

SEQ ID NO: 35490 - DNA, 1822 bp, Oryza sativa
  unsure (1)..(1822): unsure at all n locations
nnnnnnnnnnnnnnnnnnnnnnnnnnnnnnnnnnnnnnnnnnnnnnnnnnnnnnnnnnnnnnnnttgctgctgtcatcggcgacggcagccatgtgcacggcagcggcttctagtcctgccgcttcaaggtggtctcttgatcccgcacccgccgccgccatcttcgcacctactgttacagcggcaggtgcggttggcgccaccgttcttggggaagagagaaggaagaagacagattgatagaaaacgtaacaggagtggcactgtcccaattttataaaagtccagtgacattcatctaaatagctgcatataccatggcacggacctaattgtttttttaaaaaaaaacggagcaatggcctaagttcacagatggcccacacaggcccatgttcatacatggcccacgctggcccatgtggcgctgcgtggaacagttggcccaatttccatccccatccgtgtcaatatcgatacacccttcgcggcggcggcggcggcggaacgacggcgaccggcggtcgagccgatcgaaagcatcaccacgatgatggccgcatcgagaacggcgttcgcctccggcgacctacttctactcactgtctcctcctcggcgtcaatcctcaccctggcaaaaacccaaggtatcatcaaatccatctcgttcagttctgggcgccgtcgtcggccgcgagatccacagtccatacctacacccggcaagcttcctctgatatctagtgattttttcggcatatagaaaaacatcatccaaaaaatccaacatatgtattgttcaggtttagtgataatattgatatgcagttcagatagctagtagtagtttgttttccaggataggcaattcaaacatgaaacatatttgcagtttaaagaaaatgttattagtaaattattcttccagtgcattgtgaaacatacttctcacaagaagaaatatgatagattaccaaagtagttacaaaatatgatgtgcatagatcggtggattttcttgtgctcagtagccgcctatttcatcttggaccagatagaatcgatgcagaaagtggagctgaatatgtggatgagttgtcttgagtagatatcactgaatttgcattgacaaagctgtaatccaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcattcaattcattgtctttagccttctctcgcaataaattgatgagctgaacgctttcctctggctgtgaaatatcgatatttttccttccacatattatttccaagagaacaactccaaagctgtagacgtcaactttttcagtgatctgtgatgttagccattcaggtgccagatatccaggtgtgcctctcatcacggtcactactttactttgatccctgtctattagtttggaaagtccaaaatcagccagtttggcattgaatttctcgtctaagagaatattttgtggtttgatatccaaatgagcaatttttcgcctgcattcctcatgaagataacataaacccttggtaatatccagaatgattctgcaccttgtgcaccaatcaagaggagcattgttatggcggtaatagatccacatatcgagtgaccctcttggcatatattcgtataccagaagcctatttgacttctcggcacaaaatccaatcactttgacaaga

SEQ ID NO: 35491 - DNA, 1896 bp, Oryza sativa
ggctggcaaagatgtcctgacctgaatcctgatgatactgaatctatgaactgatgtgctctccgaaaagatggcctcgtcgtcgcgaggcaaaagggtggccggattccgaagtggtcaactactaagtcttctctctctctgtctgaatacaagccaaaagactaccagtcttcctggtgctttaatttggtttaggttctcttgggaagatggattggcttgaccacttcaaaaaggctaatacttggcattgccgacattgccatgtgatcgattttgcgtgtcaatgtcaatatcgaacaagtttcctttgtgctgtctcgtcgatttttcatcctaaaaagaaaaaaaagagaagtcgtgccgattatattcaagcattcttagtcgaaaaaagattatattcaagcattgtcagagtagatattggcatggtaggcatggtagtaagaagcttcataattaagcattgccacggcattccctgattcccttgtgccattttcgttctgggagagcatgacaaatagtagctagctaatgaggtaagatcagttagaaaacacctgaataatattggttaatgtaaaatttacatgttcggagagggacggataatttgcttatacttcaatatgtactcccttcatgcgtaagctctcctatatacatgagtgcttattattattattattattattattattattattattattattattattattattattattattattattattattattattattattattattattattattattattattattattattattattattattattattattattattattattattattattattcagattagtaaaatgtccatacgagtaaagtgaatttaattacctaaagagactagtctccgacgttcgaaatttttgctagcgtctattgagttcctctagctgtcataatttcctttgtggaggatcctgtttgcgagtaaatgcttgtatatctgaagacaatattttctcctctatcatccagccagtgaataacaagtgcattctgcaagtaagggcccttttaaatattaggaaggtaaaaaacagagaaatagaaaaaacatgggtcctcttaaatagcaggaatagaaaaaacagggaatagaaaaaacagaggagtagaaaaaacatgggattctaatagaaatgcaagtgtagggaaaacatagaaaaaatacagaaatgatcgtttgattgaaccacagcaaaaacgtaagaatcggatgaaagagatagactcgaaggaattttttcaagatattggacttcttactaatttttctctaaaatctctataggattatccattccatatgaattttaaaagatgggatatgattcaatcctttgtttcaaatgttttcataggatttttttttcatagaattgaaattctccaaaatttctatatttttcgtataaatcgaaaggaccctaaaggttagaatggtgaggtcactgaaccaatttgtgaaagtgattggcagagtaagagttaagacaagtgcaggttggtgatcacgagggcttcttcctgttaacggggacaaactacaagcattgccagaaaaagaatgaaccattgtactcgaattttttagcggattcagattcggacactgacagtattgggtgttcatttaattttcatttatgtatgcttcgagttggacagccaagcgggaaatatccatcacattttcctccgtgatgatgtatagaagtattgtactctcatctccttactgcaagtatatgtaaggatgtgtgaataaatttcagtaaataaactgctttaacaagctatttcaactgacagttcgttagacaatgatttaaatac

SEQ ID NO: 35492 - DNA, 725 bp, Oryza sativa
aagcactcatgtatataggagagcttacgcatgaagggagtacatattgaagtataagcaaattatccgtccctctccgaacatgtaaattttacattaaccaatattattcaggtgttttctaactgatcttacctcattagctagctactatttgtcatgctctcccagaacgaaaatggcacaagggaatcagggaatgccgtggcaatgcttaattatgaagcttcttactaccatgcctaccatgccaatatctactctgacaatgcttgaatataatcttttttcgactaagaatgcttgaatataatcggcacgacttctcttttttttctttttaggatgaaaaatcgacgagacagcacaaaggaaacttgttcgatattgacattgacacgcaaaatcgatcacatggcaatgtcggcaatgccaagtattagcctttttgaagtggtcaagccaatccatcttcccaagagaacctaaaccaaattaaagcaccaggaagactggtagtcttttggcttgtattcagacagagagagagaagacttagtagttgaccacttcggaatccggccaccctctgcctgcgacgacgaggccatctttccggagagcacatcagttcatagattcagtatcatcaggattcaggtcaggacatctttgccagcctctccaatgtccacagctccttgctgcctggcttcttgtatgta

SEQ ID NO: 35493 - DNA, 2953 bp, Oryza sativa
tatatatttacattaaagaaaatgtgtacacatgcatatagaaaaatagacatgtattaattacaatccattatgtcctagctagctacgattttgacgtagtagtagtcgctatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtaatgaaattttgaatttatttgtacgtacatcgagctctcttgtggtgatgatttggtctgcaaggcagtggcaatactcgcacacatagtagcctcacaagttagttccctgcttttgctttgcgcactataaataaatgacaaacggcgagagatgtaattaatatacacttgtatatatttgaatcagagattcaatataaatgtagagcatgtgtactcacaggaaaattgaacttcggcctttctctccatttgccgcgaaccaaatgatggaaccgataccaagccctacatggagtttaaagatatgattcgtagtagcaattaattaacataagaatttatgacagtacctatctataagttcaaaaaccttatcaaacgtagactcttttttatccattgattcatatacgttgacggtgcaggcctccaggtcaaagagtaaaagcacccagtagaatctgcaatgtgtgtgggatgcattacatatgaaacagttagcatgttcgtacgggaatgaaatttggtataggaagacagtaaaattaaactaactctgtgttgtacggcaacagtatgaacgtcttataatgctgctccttcaagagatggacgagatcgtcctctgtttcttgcggatactggtcgagcattgcgacgtttacttttcgagagtcgatgaatccagtatcgaaaaccccccgccgtcgggccctttgaatctccattctacaacgataaaaggaagtatatattatatatagtctacttatatacaaggacctatttaattaaaggaaacgtaataagaaatctaactgaaagatacttacaaaatccagcaactcataatagaagcgtcgagggcgtccagctggtatagttcgtagatacccttgaaattgatccagagaatgtcatctccttgcaagaagttcgtgtccttgatcctcgctctgatcatctctctaccggtggcgctcatctccatgtacagttgatggaacttgtatatttgtgtggttagggactgcagctgctcaggcttgacaagcggtttaccgagttcgaacatgtatttcacttccgccttttcgattggtgcgccttgtagcaattgatccgtagttagcccggtgtcattaataaagtcttgtattccaaaatcttcaccggtcaccaacggctcgatctcctgatttggttgctctttaagctgagggactggtttggattttccagaagatgctttcttgagtgttcgctcatagtccgatagctctatggcctccttggcaggtgcagacatacccctaaagaagttcctgacactcaggtctataggaatcttcttttctggacttcgaggcttcaattgtctcctgacttctgatgccacaaaagcgtcaagctcatcttgcgtgcaatcgtaccccaggtccttgttcttggcggcatcaacttccgccttctttgttgcccttgtgggggcaggcggtggagcttggggggcccttgacttggaaggtgccggacaaggagattgcggaggagtcggtgtaggagcctaaggaggagtcggtgtaggagcctgaggaggagtcggtgcaggagcctgaggtggagacggtgctggagcatgaggaggagacggtgcaggagcctgaggaggagatggcggagccggaggagatggtgcacgagacgccgcttgtcgcccagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcacatggtgagaggttatttattagtaatcaacatatataagcagcaactagcggaatggccaaatctaaaatctataaactacgagcttacatttattgataagttcttgaagggaatatgcagctcacatggtgtccgctgagtgatgtcatcaatggggcaggtggtttcgtcctgggtttgcatggtgtccatactctatgatcctacctgccccgttgaggcgcagctgctacgatttcctgaagggctcaccattgtaggaggaatggtcggctggggatcatgggaccgatatgcggccatgcattcatcaaccttccttgccacctcctcttgcatgctgagctcgtagctcgataccctgaactcaagatctgcaatcttcgcctcggtatctctcttgctcctcatccgactcctatacgtgtggatgtcctccttgaacccaatcttccaaggaatcacccctttccctcgtgttcgtcctgaatgctctggagtctgcatggcgagtgacagctcgtccttctctctgtcgggttggaacgtgccctgagaagaggcttccactgcgtccgttagtcgacgcgcagcctcgcgtatctgatcgccgaagaccagggagccatcagctgggttgagcgttccaccgtgagcatagtaccagaacttcgatcgttccggccaatt

SEQ ID NO: 35494 - DNA, 1482 bp, Oryza sativa
cctcgaagctctgaaattgttctgccattttcttcagagtccaccttttcactttgtcctctgtacctgtgggaagggtgaatgtctcgagcattgtggtccacagcatctctttccacgaatctgggacaaagctctcatgatctccgcatgcccttgttctgtgccagtacaccgtactgacaagcacgttatcctgcacaacccaaccgctgtgacgtacgtagttcttagcggcttccgccggggcactaggtcggccgtcttcgtccacttccgttatgatgtgccgaccctcaagcttcttcgcggcacctcgttgcccgcgtgccctcttctgtccagcggagggttgactgccactagcctcctcctcctggttctcctccacatccctctccacgtgcccctcctggttcccctccgcatccctctccacgttcccttcctcgttcaaatactggtatggatcctcgttcccctcttcttcgttccagtattggctgcttccctccgcgattgtatcgtacaatatctgttcctcatcgcgatcagccatctgttcatacaggaaacagttgctaagtcatgagacatttttgctttaacaatcttatatgctaacaatcatatatgctaagtcatatatgctacgtctaactatcgtatatgcgaagtcatatatgctaagtctaactatcgtatatgctaagtctaattacaaatctaataatcgtatattaaaactataataatcttatattaaaactataataatcttatattaaaactcaaatagtcatatatgctaagtctaggtgacgtatattaggaccctagctagtcaataattatatactaagtctaattacaaatataataatcttatattaaaactcaaataatattatactaaaactcaaatagtgattatatatgctaagtctaattgtcgtatattagaaccctacacaatcttatatgctaagtctaattacaaatctaataatcttatattaaaactataataatcttatattaaaactcaaataatattgtattaaaactctaactataatgctaagtctaagtgtcgtatattaaatctaatagtcctaattgcattaaaaatttaacaatcatatatatatatatttacgtcacttgcctgcgcgaattcctttgagggctagctactactccggcttgagggacgacgacgacaacgtcttttctgcaacatacaaaaagatgtattaggataaacgcgaagtagcatatattgcatttcacgttcacacttcgttcacgatcgttcatgttcacgttctcgttaaggtcacgtttcattcacctacgttcgttcgttcacgtgcgtccatgttaatgtacgttaagtaaggttcgttcacgcatgttcgttcgtttatgtacgttcaaatacaacgttaagttcatgttcgttcacgttcatgttcgtta

SEQ ID NO: 35495 - DNA, 2015 bp, Oryza sativa
gttctcatctatctttactcctggttgttctcatcaaccgggactaaagatattttcccactatttctaaattctttttaaacccggttagggttaagaaccgggactactgataagcgcactgaatattaatttccattacatatgtgtttttaaaatagaaaataatgcactaaaattatttaaagtcgaaaaattaatgacaattacttcgaaaaattattgttggctgtagtaaattaagtggataaaacgtagtaagcaaatatatgatttaaaattaataaaaattctaataatcttatataattagcatatgaatgatattaaattaattgttaaaaactctaattaacatatgtaaatatatacgacatgcatgatttaaaattaataaaaattctaataatcttatataattagcatatgaataatattaaattaattgttacaaactctaattaacatatgtaaatacatacgacatgcatgatttaaaattaataaaaattctaataatcatatataattagcatatgaataatattaaattaattgttacaaactctaattaacatatgtaaatacatacgacatgcatgatttaaaattaataaaaattctaataatcatatataattagcatatgaatgatattaaattgattgttaaaaactctaattaacatatgtaaatacatacgacatgcatgatttaaaattaataaaaattctaataatcatatataattagcatatgaatgatattaaattaattgttaaaaactctaattaacatatgtaaatgccacatgcatgatttaaaacttttaaaagttgttaaaacctctaataatcgtgcgtaattcacatatgccaaacaacaattgatcggcggtgacggttgaccgcacgtactttctcctcactattgttccctccttgtgatcgctacgtgagtaaggggtgtcttcatttgataggaggatgctagggtcaatcgtcaccgtgaaaggaggttgcccatccaactgatcgtaatcctcgtcagtcttgttctcaaccccgacgatttttcttttgcctgggagaaccacgtgacgcttaggctcgtcaggccctctgcccttctttcctttgctagacatgtccttcacgtaaaagacttgcgttatatcattggcaaggacaaaaggttcatccgagtatccaaccttgttaaggtcaaccgttgtcatcccactgtcatcaatcattacgcctccaccagtcaacctaacccattggcaccggaacagagggaccttgagaggaccgtagtcaagttcccatatgtcctcgatggcaccgtaatatgtgccagttgttccatcgtgtcccatggcatcgatacgaacaacgctgttttggttcgtgctcttcatgtcttgggctctcgtgtagaatgtgtacccattgatctcatatccctggaatgtcgcgatcgacccagacggtcccctcgctaggaaggcaagttgttggttgatcgtctcgttacccatgagatgttgtcgtagccacacggggaaagtatcaatgtgatgccgtgtaatccatgcatcgaacttaccgatgtttctggcacgaactagagccaagtgctcatcgatgtaaggagataccaatgaagattgttgcagaaccgtgaaatgggctttacggaataaattattgtctaccatcattattgctttccttccgagagttccctttccccgtagtctcccttcatggcatgattcaggtaccccgattgggcgaaggtattcaataaattctacgcaaaattcgatgacctcctctattccataccccttggcgatgcttgcctctggacgagcacggttacgaacatacttcttcagaacgcccatgtacctctcgaaaggaaacatgttacgtaggtacacaggcccgagaatactgatctctttgacaaggtgacaaagcagatgcgtcattatattgaaaaat

SEQ ID NO: 35496 - DNA, 1805 bp, Oryza sativa
ggatgtccaagaattctcaatagggcaactcccaaaatataaagttctttttccacattgccgcttgaccatcttcactctctataggctggcttccagacccctttccgaacactactttaagatctttaaccatagcaaacactgttttcccgctgcgatgtttaggcttcgtacggtggtccgccttacgttcaaagtgcttgcctttcttccgtaccgggtggtttgctacaaggaatcgacgatgacccatgtatacaaccttcctacagtgcttaagatacgtactttctgtttcatccatacagtgagcgcaagccttgtaccccttgttggactgtccggataggttgctaagtgcaggccaatcgttgatggttacgaacagcagcgctcgtagattaaactcctcctatttgtcctcgtcccacacggggacaccttccttcttccacaacagtttaagatcttcgaccagtggtcttaggtacacatcgatgtcattaccaggttgcttggggccttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcatcattctagcattccccttgttcctgaacaaacgccttagccgtggtcttataaggaaataccacatcaccttagcaggaattctcttctttgttagctgcccgtcaacttctcctggatcgtctcgtctaatcttgtatcgtagtgctttgcaaatagggcatgcttctaggttctcgtactcctcaccgcgatataggatacaatcattcggacatgcgtgaatcttctgaacttccagtcctagagggcagactatcttcttagcctcgtacgttgtctcgggcaatttgtttccctccgaaacaatgttcttgatgagtttcaataaatcgccaaatgccttgtcactaacaccattttttgccttccattacaagaactccagagttgtatccaactttttgtgcccctgctcgcaacctgggtacaacgacgttctgtggtcctctaacatcttgtccaatttatggcccccttttcactttcgcagtcctccttggcgtcctgcaacatctgaccaagatcatccgcaacgtcgttaccatcagcatccctttcctcctcgcccgtttgatttccttcaaatccaacgtactgagcaaagtccggaatattgtcatcttccacttcatcttcttccatttcaacaccttgctctccgtgggatgtccaacaattatagcttggcatgaaccccgactcaaacaagtggaaatgaattgtcctggatgcagaatactccttctgattcttacacttgttgcatggacaacaaataaaacccttatgcctgttagctttggtcactctcaaaaaataatgcacgccgtcaataaactctttggaccgccggtcagcgtacatccattgccgatccatctacatgacatgaaaaaaaatcgtacacaaataattattcttaccataatgacaatcatataataattataaaataattacgaacttcttcaacagttatacaataatgacatatctttattcatttaaaaa

SEQ ID NO: 35497 - DNA, 4430 bp, Oryza sativa
  unsure (1)..(4430): unsure at all n locations
aatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcnnnnnnnnnnnnnnnnnnnnnnntttggtaatctaagtatcggagatgaagaaggaatcgaaacggagttcgagatagagatcgtcccggaaacagagtaaagtcagctgaaatccgaatcggctacgatcaggatcggcagagtccgagttggatagggttagccaattgagttgaatctgacaatgtagcacgatatacgttgtcgggttaggttaacgagcttcatgaggattgtcgtgcatggatagagtcctaagaaggcaattgtatctattaattaggatattttatgtaatttccttagagatatgtttgggcaaaagtctgccacaaagacttatggtattttagagtttgttagagataagaatcgtgtccgatatagacatattttgtaatctcgggtataaatagaccccgagccccatgtaatcaaactaacacacgcatcgccacccttttaacttttgttttgtttcgacgagttcttactttcgggttgagctgcatcggttttgatcttcaacaagaggtaaaacttgttatggtggcttgcgttattaggattagtgcttccatctttatgatactctaatcttatttatgtaatttgtcgagttatcatatatcttacataatctccggcaatatcgctatctaaccgtcaatcggctaacgtctggtacgagaagtcagccgattaggttaaatactgatgttgacttagattatataggatatctactactctatgaaatatccaacggcttgattgtctagaaattgtccttctttttatacttatagctgcatcagttaggtttgatcttataagtcgtgattagaatctcaatctgctttttggttgccaattagggtagtatcggggtttcagccgattttacctgatttagctttatatttcattatgttaggatatcattacaataaaatatgttagcttctgtgtaatgtattttacttgctttaatatcgagtagtatcggagtattagccgatacgtgctagatctatctgatcggttatgctatgaacagatatatagtcttgttgttaatatatattttgatctaagtgatttatactgtctcggcatggcgaccgatctatcccaatcacttgatttaagtatatatcgacataaggactatatattattaatatctacagccgatcgagtagatttagttcttccgtacttattaacatttgccgatcgattcacatatgacatcggctcagagataagtgatatgtcatcggcaattagtcgatcggctatcgtttatgaatttaaccgcggtttctttatctttgtttcttgttgattgcaggatcaaatcaactggcacactcatacacctaaaggcaagcttttagacctgcattggagttaagcagatctcccaggccttgtgtttttacatcaacacgcgctgggatgagactcctctgactttgtgtagtacaactgcaaactgcacaaaggttgtgtttaaatctacgggtgaaaagttttggtgcatcacatcggatatacgggcacacatttgaagtattagacgtagactaataacaaaacaaattatagactccgtctgtaaactgcgagacgaatttattaagcctaattaatccgtcattagcaaatatttactgtagcacgatattgttaaatcatgaagcaattgggcttaaaagatttgtctcgtaatttacacgtaatctatgtaagtagttttttttatatttaatactccacgtatgtatagatctaaacattcgatgggcaaagtcaccggatatccgtggcggtgcgtggaacagttgggcccttcccaatttccattcaccctttcgccgcggcggcagcggccggcagccgagccgcgatcgaaagcaccaccacgatgatggccgcagcgagaacggcgttcgtctccggcgacctacttccactcaacgtctcctcctcggcgtcaatccccaccctggcaaaaacccaaggtatcaccaaatccatctcgttcggttctgggcgccgtcgccggccgcgagatccacagtccatacctaccaccaggcaagcctcctctgctatctagagatattttccgccatattgaaaaacatcacccgaaaaatccaacatatgtactattgctcagatttagtgataatattgatatgcagttcagatagctagtacatatttgcagtttaaagataatattattagtacattattgttccagtgcattgtgaaacatacttctcacaagaagaactatgatagattaccaaagtagttacaaaatatgatgtgcatagattgcgatggattttcttgtgctcagtatcccacctatttcatcttggaccagatagaatcgatgcagagggtggagctgaatatgtggatgggttgtcttgagcagatatcactgaatttgcgttggcaaagctgtaatctaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcgatcaatacattgtctttagccttctctcgcaataaattgatgagctgaacgctttcctctggctgcgaaatatcgatatttttccttccacatattatttccaagagaacaactccaaagctgtagacgtcaactttttcagtgatctgtgatgttagccattcaggtgccagatatccaggtgtgcctctcatcacggtcactactttactttgatccctgtctattagtttggaaagtccaaaatcagccagtttggcattgaatttctcgtctaagagaatattttgtggtttgatatccaaatgagcaatttttcgcctgcattcctcatgaagataacataaacccttggtaatatccagaatgattctgcaccttgtgcaccaatcaagaggagcattgttatggcggtaatagatccacatatcgagtgaccctcttggcatatattcgtataccagaagcctatttgacttctcggcacaaaatccaatcactttgacaagattgatgtgctcaatgctgccaatagtctcaacctctgccaagaattccttctttccctgtctggcaccttccagacgtttcactgcaactctcttttcacctatttttccttcaaagactgatccaaatccaccttcgccgagctttttactgaaatcttcagtgcgttctcttaacttttcaaatgaaaaccgcattggcattccaggcaatatatcgaaatctaattcttcatctagtttttgatacttcctcctccttcgtacataaatgccaacaataataactaaaacaaggctactaattgctgcaagtgtagcccctaaacttaccttgatacgtttttgtgtaggggcagaagcggagggaggaagttgcactttgaggtaaacagaagagttgtaatggagcttttcaggttgtattgattgcaaggagaagacctctgtcacagacttacattctccatcggaatcattatggtaatacctgaagagtacagccctgcaggagcaattctttaagcaggcttgcttgcagtcatctctactttttgcattggttataatgctgccatcaaagtaataaacatcagtaagagttaagaattgatggtttttcatttcttgacaagatattggagtcactggtgcacaaccaagattagccttccgctcgtcaactggctggaagtagcttgaactagaattagtctgaagaggacagatgcattgcccacctgtgcatatcgcgtactccccgcatactgtggggaaagcacagttatccacgtcgattacatcatccatgtggattacatcagataccatggtccactcaaatccagaccactcatacaacctcaaatggccatcatactctaaccttatgtactgggtggacttagcttctggcagtgcaattcttttatctggctttcctgcctgtgtcgactgcagaaagatgctgaggcttccattcgtaaaggtaaccctcgttgggtcttttctgctcttgtttgtgtccaccaaatatttatagtatagctgtggtggtttggatccaacataggcatataaaccatctggg

SEQ ID NO: 35498 - DNA, 1073 bp, Oryza sativa
  unsure (1)..(1073): unsure at all n locations
agcaatgactgcccagtgaccaatacatcggatggatgatcaaatgactgccacactgtcgcattcctctgatcaaacagcaccagattgccatgctcagtgatctgcatgcctgccacggattggcctgaagtgttgctcgaccagacgagtctcccgtcgatttcacggaggacaagatcgccatctccagttaactcaagggtagcattctctcccaaaggacttgcccggttggccgaccagataacccgtgccatattgttttcctctaagggtaagccataaccgctattgaagttggcgatgaagacagcgaagaggaatgcttggcagggtggagcgcagaagaaccctgcggcaaaggaggggccatataaagtttgtgttgaccggaggatgattgcgcgcacggctgacccgtcggtgtaggtgatactgtgcgggagcaccgcggcgttgttgacctaccgcgtcgagaggttggccgtgggatagtcagggagctgcccggagacggacggtgctgcagttgcaagtaccactgcaaccactgccatcgtcgtcacgtctaagcaaaagagatttgctggacgcatggtgcttgaattgcagaggggactgcaagaagaatctcttcttaatttggttacatacaagaagccaggcagcaaggagctgtggacattggagaggctggcaaagatgtcctgacctgaatcctgatgatactgaatctatgaactgatgtgctctccggaaagatggcctcgtcgtcgcaggcagagggtggccggattccgaagtggtcaactactaagtcttctctctctctgtctgaatacaagccaaaagactaccagtcttcctggtgctttaatttggtttaggttctcttgggaagatggattggcttgaccacttcaaaaaggctaatacttggcattgccgacattgccatgtgatcgattttgcgtgtcaatgtcaatatcgaacaagtttcctttgtgctnnnnnnnnnnnnnnnnnnnnnnnnnnnnnnnnnnnnnnnnnnnnnnnnnnnnnnnnnnnnn

SEQ ID NO: 35499 - DNA, 625 bp, Oryza sativa
gtatctcaatccgtcggagctaccgtcgtgctcacccgcgtggccgcaggcccgccccaaaaagatcgtcgtcgccgcccgtcgccgtcacacccctctcaccaccaccaccaccaccacccgagcaataatttctgggggagggccgcggagatgccgtcaccggccggggggcgaggtggccgcgccgcggccacagaatcccggcgagacgaccgtgagtcgctcgatcgctcacgggctcgcggattgcattatcctcacctgccgccgctgctgctacgcccgccattctttctgtcgcctacttgcttcctcctcttcctcttcctcttccctcgtctccccggcgccacctgactgattggattggtatcgatccaagcctatcagcctagctagtgacctgagtactctgctgtctgctgcctgaatctgaatcgatcgatcactcgctcgctgcctgaagagaggttgctgattaatttgtctctctctcgtcttacttccctttttatgtggcttctcgttgagttggaagaagtggtagaccagtagcccagataaggaagtggatagggtaatggaacagtgaagagagagagagagagagagagagagaggg

SEQ ID NO: 35500 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnnnatctatttctatttaaagatactgatttgccattggacttattatgagatcaaagattgctaatctgcatgtgttattcctgctgtaggtattatataccgtgatctgaagccagaaaacattttgctccaagcagatgggcacattgtactgactgattttgatctttcatttttgacgacttcaaaaccccacgtaagttgagggaataaactttcaggcttgctgcagtttttatagaatatttgctaattccatttaccttcattttttttggtcatttatagtctgtatgctagaatgtgtgatcgcaaactttaaaacaaaaatatacttcattcctgagtaatgagctttgagttttccacttgcatagtattcaaagtcagtaatggtgtcaagaacatgtttatattgagtacttgttggtggtttccagcatgtgtttttgttgttcataagaaactatcgcacttaaaacacttgatattgccctgatgttggttaaatctcctgcaggtgataaaaaattccacatcattaaaacgaagaaggtcacaagaatttctccccccaacatttgtctcagaaccttccactccatcaaattcatttgttggtactgaagagtatatcgctccaataagaatgatccttgtgttttct

SEQ ID NO: 35501 - DNA, 1071 bp, Oryza sativa
ctgcgggcgaaagcgacttagccgctcgcctcgcggctgccgaacacaccgtcgctgacatgcagcgcgcgctggactcctccaccggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgctccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggctcgcgttcgcccccagctccgacgaggaaggcgacaccagcagcgaggacggcggtggcgacgaggccggcgaccctttgccagtccggccgggggcttagggtgaaatctcaagctctctctctctctctgtatatggaaagattgtctgccagccagaaaacacgagacaccgacgatctatacaggttcgggccgctcagaagcgtaataccctactcctgtgttttggtggatctatgtatgaatgagctacaagtgtgagctctcttctcccccgttctaagttcctaatcttgaaaagaatcaatcccctttaccccatgggcaaggtcctccttttatacttcaaggggataccacatgcacccttctctttccaaactggactgttctttttctctagaatgggcggagatcagcacggttgctgttcgaatgacactccgatgggactgcccatacctacctccacttccgccgggggtgagcgcgtcgtgggaacacggctgtgcgctgacgatatgattagtgtcagaccggtcacagatcggtcattcttgtccaccgcgtgtaatcttg

SEQ ID NO: 35502 - DNA, 711 bp, Oryza sativa
gaagaaattgcaagacaggtttgatcagttgaatatttccatgagtgtatataagaattctcagaagtttcaaaatggtcttgggatgtcctaagcttaccattaattatcgacatcattgaagagataatgcgatgtagaaagatgtctgattcttgaaacagtaggttcttttgtctgaagaccatgacaaactgaattaacacctagaaatccaattactacatcatctagcattggatacgaaggtacgttactcagaagattgagtggatccaccacgatggtaattgatgaaacctacgtagacaatgcttatccaaatgagtgccttccatgaattctgatcctttgcaaaataggtcctccaacggtaaaactagatttggattcttagcaaaaattagttccacatcgttgtagttcgcggcttttgctgtatatatatcgacaaagaaaatcgctataaaattatttttttaacatgatataaatgcatgtgtttatataaacgcgcgcgcactcaccctataaataattagccgtgaatgcgagcacccataccaagtttagaatttgaacctaggtggttaggttctagcacaagaaacctaactaatttagctacgctcatttcacaaatcacgatacactttaagactattattaggcgatattaccaaatacattatatgtagcatgttgacataa

SEQ ID NO: 35503 - DNA, 496 bp, Oryza sativa
ttttttcatcgtaatataatcatgtgagatcttgttataaagatttaattgtaacgaacacaatggtgtaatcggattatagatcggataagtaatttaagagaaaactttatttgaagcataggtggatagggtctcagctggtttagacaatacagctaccactagctgtgtagtcacatccttatatatatagagagagagatctccattaccacacaaataaatctcatttgttgtggatgttacaacacaatcaatctctcatttgttgtggaggttacaacacaatgaatctctcatttgttgtgaatttcattttttaatggtgacttcattctcatctgttacaaaacggaagagcagcaggcaggctcggctcggtcggccgcctcgcctcgctacgtccatggccgaggccgactcagcgcgtgcgcatgcgtgtggcagtccaaccatcacctcaaccggtcaacagggaatctccaatatcacc

SEQ ID NO: 35504 - DNA, 966 bp, Oryza sativa
cgggcagcgcacagaccggcggcggcggacgaaggcgatgtcgagcgcagggagcggcagcgcgtgcgggacagatggaaggatggaggagaggagctcctcactgtgagcacggcggccggcgcgaaggatgaagacggcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggcgctccggtgggattccggcgacgcgaggcggcggccgggaaagctcttgcggcggcgaagctaacggcggcggcgatttggcgcggcggcgactctagcggcggcggctcacggccgaaggcggcggcaagcggcggagctcgggtgtgacggcgcgggcgcggtagggggcgtgggagaggacggcaaatgggggaaacgagggaggggactcgggggagggtttttatgggcgagagaggggcggacgtggccggggagatggccgaaaccgccggcgacatggggaggagagagagagacggtgaggtgggattcaaaatgaatcccgcccacttcgtgcatgcgcgcgggcgggaagggcggaggagtggggcggcgacgtgggcgcgcggcacgggcggagtggggcgtggagaacggcgggaaacggcggcggcggcatgggcggtttcgacggcagcagttggagctccagctccaacggctggaggtgggagacgaccgacaggtggggcccacctgtcggcatcccagagagaggagggaggggcgcatgggccggcccaacaagaggaaggccgagcgggagagggatgggccgacggcccaagaaaggaaaaggagggaaaagaaaaaaaagaaaaagaagaaaggatttttcctgg

SEQ ID NO: 35505 - DNA, 887 bp, Oryza sativa
ccaccaaaaagggatatcgagttccggattgacttggtacctggaactgcaccgatccacaagaggccttacagaatgggagccaacgagttggcggaagtcaagaagcaagtcgatgaacagttacagaagggatacatccgcccgagcacatcgccttgggtgctccggttatctttgtggagaagaaagacaaaaccaagaggatgtgcgttgactaccgcgcactcaatgaggtcaccatcaagaacaaatatcctttgccaaggattgatgatctgtttgatcagttgaaaggagctactgtgttctctaagatagacctgcgatcagactatcaccagttgaggatccgcgaggaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaagttcggagtttcttaacgacttgcgggctattaccgcctgttcattgagaacttctctaaaattgctaagccaatgacacagctattgaagaaggaagaaaaatttatctggtctgctgaatgcaataggagttttgaaaaactcaa

SEQ ID NO: 35506 - DNA, 203 bp, Oryza sativa
tgatggcccatcagactcagatgatggcggccatgatgcagcagatgctgcagcagcaccagcagatgcaccagaggatgtagcagcaagtcgaacagtagcagcagcagtttggtccccctccccctcagtccaagctgccgaagtttctacgcgtcagccacccaccttctctagcaccaccaaccccatggaggcgaatg

SEQ ID NO: 35507 - DNA, 501 bp, Oryza sativa
cattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaagcatggtggggggaggcattgttgacctcgaatcatgtgttaaacagagttcctaatagaaataacgacaaaacaccatatgagatatggattgggagaaaaccatcactttgttattcgcgcacatggggg

SEQ ID NO: 35508 - DNA, 543 bp, Oryza sativa
gagctcggtaccacttagctctaacttcctttaaataattattgcaggtcctagccgatctttgctgctttgacattagagactatcttgatgagacagaagaggataccacaagcaaagctttagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagcc

SEQ ID NO: 35509 - DNA, 601 bp, Oryza sativa
cttcgtgttggtgtcctcggatagcccggccgagctcactatcaccggtggcagcgtcgtccagtgctaggccggcgatgacgtcatcgtgacgtcataaatcctttatttaattcgtaataattttctgtattagatgaaaatcgattaaacttcggaaattcataactaaatcatcgtaactcggattcgagtggttcaagttgctaaattcatctaaaatcgagatctacatgttaaaaatatccacatatactgtttatgcttatttttgtactgttttgttgattttgtttatttgctttagtttccgacgttccggaggagagcgtttacgttgaggaaggttcagaagcgtttgcggaagcttaaggcaagtcacacagatctcaaacaaccctttgagcatgttgaacctatctaaagctaatgttttatttcaacttatgcattattttcgaatgtcatcgggtggtgagccattcccaattaattatggccgaagatgactttattttcctatgggtaataaattgattagcttggactttatatattggattggttcagctaaatgctatatatataattgcttagccat

SEQ ID NO: 35510 - DNA, 551 bp, Oryza sativa
aggactgaaagtttttaaatagcttttgcgggttttaggctcaataaggcttgacaaaaacttttaagaaatcagaagctaagtatgaaacattgggcacagcataaattcatcagtattgtacaaattgtgcctccatcatcatcatcatcatcatcagaatcattgtcattacattacatcaatcagtatcagttttctcatcatcagagtcatcaagaccagtcagtcgaagatcggtgtcctgaaatctctccactacatcaactgctatcttgtcagcaaccttctgtgcatcattgataagatcgagaacagcttcttcgcttgtcccgtctgcaaagccgtcaatggcatcaatgtcgatttttgggtaaagggacttggtcattgctaacgccagactcgctcccatacttccagcttctttgatattcttgaaatatgtatccggagcaactctcagcttgtcgaagatttcggaagcatcaagtgtactcgggccattgttattgatgaacatcgcttggacgagtggggtagcaacatta

SEQ ID NO: 35511 - DNA, 1384 bp, Oryza sativa
  unsure (1)..(1384): unsure at all n locations
ttttaactagtagggggcatgattactacatgggagtgattgcacatctgtgagtgcagggggagcttcaatacttcattggtgtgcaacttgatggaagtgatcatgttgaacccctcaggaaccgcctttcggagaatactgagatacagagtgccaaattggtaggccagcttactgtattaatttccatttcaatgatctcaaatataaattggtgtataatattttaatttaggaataagatgagatgaatctagagactgggtcaatcagttggatagcatttgatttggttacgtctcaatcagttggatactgtttagnttggtttttccagnggtccccaattaaaaaacatgttgtgtttttggatggcttagtttcatacttcagtataccagtaaattgtataataattccctgtatattattgttgcttcagattcacatatactgaaacttggaaacgccgagcagacttgtaggttgtagcattgctttaagatttgaaatatgctaattcattttcatacggtgtccaattaggtcaaagctacagcagagaatgtggatgatgcagtcagggagcttcctgatgccaacttggtaaggtacatctgctttttgttgtttcactttattagtagttagttcttgatggaagttgtcagcaatgtgaaaatgtagaaccaactttgcgcccaaaaaaaaaatgtagaaccaacaataattgctcagttcaaaacaagacatgaaaaatagtatgggcccatactagactatgcaataatggattaaatccttaatggtgacaaataatttgtaccatcatcaatcttcataaagaactgaagattatttggcgaaatggaaacctcattcaatcttagtgatgaaatatttaagaaataccaacaggagcacaataaccaccaggtcctagtagcaaccttagaaacattttataagtgactaatgtgaaaattgatacgatggcttgtggccctaaataaaatttttcaacagagatatagaacttcaaaccgtgtgtatgcacgctgacgttcacacttaaatgattgttttggtttgctcctcgcatctgtttgcacttggccattgtgcagcacactgtaaacaactaatatctaaattataaaagagaaaaaatggtaatgtaccttatatgaatattgtagttagagaagtattttatttaacttttctctgttatgttggggcataacacaatctatctttgtctcagagaccagaggatttgtgggcaattcactcaatgcgtgtttctccaaaacctcacaaacggaataacccttcttggatagctatagaaaaggtacgttaattttgttgtttggtg

SEQ ID NO: 35512 - DNA, 1250 bp, Oryza sativa
accggtgcgagaaactcgatgttggtttcttcgcattccaggcttgttctgacgcgctcgcgtaccgttgtgtttgcaggggcgtgcagttcggcgagcaagaggggcggcgacgggggggcgagcagcggcggtgcggtagcggatgaggcgtactactccagctgggaatcggcagtggcggtggtggtggcggggcgacgaaggctagtccggccagggtcgtcgccgccgacatgccggagccggtgcggtggctgccacccaagcttgttcttcccggctgcgtcgccattgctgcacggacaaggtttagctgctacctagctggagcaagagccatcgacaatactgcagccaagaaggacattgctgagaagatcaatcacgcaggcttcggcttcgatgggttggtgtatgtaacgttgagttcttggagattgaacaagggcagagagatgttaatgctgccattttgtttttcctcctcctctctttctatttattttttttctgttgtttgttcttcccttgcattttttttttgggtgatttccctgctaatttgttccatctttgccatgaactttgtatttactcgtaacgcacatcatcgtcttgctctgttcaattcttgctatttaaacatcttttagtagatgaacaatgaaaaacttctcctacttctatcttcagctctgatgcgtgttagtgttcttgtggctagtgcacccgtgcatgcacatttcagtactatagtatttcacacaacaatggaccggcgatgcaggtgacggtggtggcggcacttaccgacgggcagagaagccagcaactagctgaaatggctcaaccagctcgatgcacaacggttttcaacatccaaccgaaggggcaatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcgtgtagcgctgttaacgaccaaatttggtaatctaagtatcggagatgaagaaggaatcgaaacggagttcgagatagagatcgtcccggaaacagagtaaagtcagctgaaatccgaatcgctacgatcaggatcggcagagtccgagttggatagggttagccaattgagttgaatctgacaatgt

SEQ ID NO: 35513 - DNA, 559 bp, Oryza sativa
ctcggtgaggcctctgggctccggacaaattttggaaaatgttcaaccctgccgattcagtgctcagaggagttgcttgctgggatacagccggaattgccctgccatgttgcatccttcccctgcaagtacttaggtctacccctttccatcttcaggttgaagaaagaagacttgcagccattcgttgacagcatagcccggcggcttccagcttggaaatccaaccaaatgtcgttgataggtcatgtaacaatggttcagtttgtactcagtgcaatcccaatctacctgctgattactatcgatgcacccaagtgggtgatcaaaggaatcgacaagatccgacgcgggattctctggcaggcaaggcgcaagccaatggaggttgctgccgggtcgcttggtcgagggtctgtgctcctaagaactatggcggtttagacttgccaaatctggagttgatgggtattgcacttcgctccagatggacttggctacaacggacttcactaagtaaaccatggcaaggcctagacatcccggggtcgcaaaagga

SEQ ID NO: 35514 - DNA, 647 bp, Oryza sativa
gtacccttaatccaaccgactttaattgatcatctgatctttatccatggatacatgaggaccaatgattggtgatgaagaggaagttctccggatacgtgcggctgaagactcgcgcccttccattttggtcaagtggtgggatgatgacttgcaacctcaaggaattgtaataaaccggcaaaaagaagacgaagaggtatgcctactgaaaaaggcgctcggccaagcgattctcattgtaaacgtaagttccttgacgcctgacctcagccatcttgtttgccatctagctcgagcgctgataaaactgttttgcagaggattcaccttaggagcgaggcgaagaccacaaccctagagaaattagttcctcatcttggaacccttgaagctgtcagagatcaattgctcgaagcaaaagagcttgccaagaaaaccgagcacgatctaagggatcggatcgctgagctccaggagtctaacttcgaactaagtggttcatcaaaaggtacacaaaatccgtccgcctaacttgtgctgtcatctttgtagcttcaattaaccggagttaatgtagtgctagctgccaagatatctcaattggagaagcagattcaggctctagaaagcgactaagcagagct

SEQ ID NO: 35515 - DNA, 497 bp, Oryza sativa
  unsure (1)..(497): unsure at all n locations
nnnnnnnnnnnnnnnnnnnnnnnnnnnnnnnnnnnnnnnnnnnnnnnnnnnnnnnnnttcctcgaggccatcagaatagcgtaaagcatcttctgggcctgtgggtatcgggtcttggcgtcccggagggcctcactaacaaagtagacaggccgttgcacctttcggcggggccgatcctcctcgctaggggccgtacccccggggcgttcttcgtccaagtggcccctcggggcacactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggcttcgggggggccccccttttcctctccctgctctttccgggtcgagtcagcacagggttagcctcggggccaaagggccttaagtgcagccttccctc

SEQ ID NO: 35516 - DNA, 654 bp, Oryza sativa
  unsure (1)..(654): unsure at all n locations
ttgtcctcgtcccacacgggaaccctttcccttcttccacaacagtttaagatcttcgaccagtggtcttaggtacacatcgatgtcattaccaggttgcttggggcttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcatcattctagcattccccttgttcctgaacaaacgccttagccgtggtcttataaggaaataccacatcaccttagcaggaattctcttctttgttagctgcgtcaacttctcctggatcgtctcgtctaatcttgtatcgtagtgctttgcaaatagggcatgcttctaggttctcgtactcctccccgcgatataggatacaatcattcggacaagggtgaatnnnnnnnnnnnnnnnnnnnnnnnnnnnnnnnnnnnnnnnnnnnnnnnnnnnnnnnnnn

SEQ ID NO: 35517 - DNA, 584 bp, Oryza sativa
tgagttgatatcagattctagtaataatgttggttaatgccaccgctccggtgttggttaattaaaatatattaaatggtgggttgtgggtgcatggttttgatggtcgcgcccatggcaattaaggaccggttcatgggatgccctagaagaacttatcgtacttaccacaagccattgtgggcaacggctgggcttgtagtgtagctttcctctagttgacgcatacaggcaagggtgggcatgatggagcgggacgggccctgcgacggcctctgtcgcttccggattcacctaggcacgagaggggactgcccgttgcccgctggggatgggggtgaaacctgaggtgtggtgtgcttggctagagggggttatgtgaagggtcctgtcacggcctctttccggtatgtcgtggtggcatgtcagtgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgta

SEQ ID NO: 35518 - DNA, 554 bp, Oryza sativa
atatgttatatctgccctttatgttaagatcttgttgcatttaggtatattaggcttttgtttgatatattctatttgctttgatatcttagtatagagttgtatcggagtattagtcgatacatgctagatctatctgatcggctatgctatgaatatatataatctcattattaatatatatttcgatctaagtgatttatactgtctcggcatggcgaccgatctatcccaatcacttggttttaagtatatatcgatataaggatcatatatcgttaatatctacagccgatcgagtagatttagttctgttttatttattgatacttgccgatcgatgcatatatgacatcggctcaaagataaataatatgtcatcggcacctagccgatcggctatcgtttatggatttaaccacggtttctttgtccttgtttcttgttgattgcaggatcaaatcaactggtacgctagcatacccgaaggcgagttttggacctgcactagagttaagcagatctcccaggcctcgtgttttacgtcaacacgc

SEQ ID NO: 35519 - DNA, 789 bp, Oryza sativa
aaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcagatggagacaaggaatggttcacgcgactccaacaatgccagtggcagcgaagagccgatcgatggagcacgtgccaacggtgcatctgacaacaatccgtccccaccgcctaagaacccaacaattgctcaggtgttggacaatcagactcagatgatgacaatgatgatgcaacagatgcagcaacagtaccatcaggtgttgc

SEQ ID NO: 35520 - DNA, 447 bp, Oryza sativa
actaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctcctccatctcctcctcaggatcctacaccgtctcctcctcatgctccgccagcaccgtctccacctcaggctccagcatcgactcctcctcaggatcctgcaccgactcctcctcgtgctcctacacctactcccccgcaagctccacttacggcaccttcaaagtcaa

SEQ ID NO: 35521 - DNA, 95 bp, Oryza sativa
cttatgacaaggtatgaaatgcgccatcttagaaaatctatctacaacaacaaagatactgtccctccccttctttgttctaggcagccctaaaa

SEQ ID NO: 35522 - DNA, 536 bp, Oryza sativa
ctgctcggtttgtgttcgtgcccagattcagtggccgaagaagcaaggatgatgcactgaggtgggggggggggggggggagtcggtgagagatttcagcggagaatctcgtctgattccagcgtgtgggacctccgggcgatggccgccgctggcggcggcggcgacgccaagtacaactcgtacaaggcggcggggctacgcggcgccatactggaggcggcgcacgtgtcgtgcctcgaggatcgctacgcgctggggccccagctcgggtggggccagttcggcgtgatccggtcgtgctccgacatggtcaccggcgaggcgctcgcctgcaagtccatcgccaaggaccgcctcgtgtcccccgacgacgtgaggggggtcaagctcgagatcgaggtcatggcgcgcctctcgggccaccccaacgtcgttgacctcaaagccgtgtaccaggacgaagcgtccgtgcacctggtcatggagctctgcgccggcggggagctcttccaccgcctcgaggagcgcgggtg

SEQ ID NO: 35523 - DNA, 739 bp, Oryza sativa
  unsure (1)..(739): unsure at all n locations
nnnnnnnnnnnnnnnnnnnnnnnnnnnnnnnnnnnnnctgcgagttgatgtagatctcgtgggtgatgccggcgtgcttgaccttgacgcggatggtgggcaccggcttcacgttgacgggctcctcgtcggcgccgccgcccctcttctgcaccagcatcccgcctggccggacctaccacacctcctccggcggcaccttcccacccgccgccgccgacgctgctccggcggcggcgccaaccaccgggggaggaggaggattcttcatcgacccgaacttcaccgtcgcgcctttcttggccttagggctcgctcccagcatcctcctctcctcctcttcttctccccagctatcacagagctcgtcggatctttgaagccaagaaagcgaagcacaccaatggcgggaaaggcgagcgagcaaagcacagagcagagcttgtggcgggaagaatgggggtttggagaagctgaaatctcgaagctgaggaggaggaagaagaagaccagatggatggagagcgacgagaggagaggagaggaggaagaaaagaagaggagagaagaaaataatggtggtgaggttgatgaaggaacaaaaccgaacgccctggacaaggggaatatataccccaatagattacttgccactggccacatgacattttccattatcaaaattcaaagagatttatataaataaatgtttcttgaaaactatatttaatcaacatga

SEQ ID NO: 35524 - DNA, 685 bp, Oryza sativa
  unsure (1)..(685): unsure at all n locations
aggcgcgggcgcccaaggcgtccaatttttcctctgccgtcgggcgccggcgtgcagcactctaagcccatcgcagtggcggtcgaggagacacgccgttttagcccgttgtttttcgttgggccgtggactagtggtgagcggtgaggtcataacatattgacatagccaatccaaggtttatttttcttctttaaattttgtttttttaagaaaagacaagctgccaatttttattaaatagagaaggagtaaacggagagagctacaaatcgaacgtccgacgttgtaaaaaaaatcggacagtcaaatgtttcggttgactgttggtgcaacattaagttatacatagtgaaacaaaaaagtcagcctatgaaacatatagaacttttgtgaaacataacaataagaatacatggtgtaacatatttctatcacatatgaaacattgagtttttattgtctgaaacatatgttttttttcatcagaatataatcatgcgatatcttgttgtaaagatttaattataacgatttcaacggtgtgatcgaatcgttcaacggataagtagtttagaagaaaatttttttttaagatcactaaataaatgcatcatgcatggtgtgggggannnnnnnnnnnnnnnnnnnnnnnnnnnnnnnnnnnnnnnnnnnnnnnnnnnnn

SEQ ID NO: 35525 - DNA, 986 bp, Oryza sativa
  unsure (1)..(986): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtgtatattgtaattgttattttcctagaaaaatgtttgcctttttaatatccaacaggggctgtctcttaaggctttaatctgaattttgggttaactaaaaaaaattaggggttaggtgttctctttggtctataatttggacaaacatgcttatggtctgataaggtcatttcaaataaccatctggcatggttgtacgttttgtctatttatgtctgattcaaggctgactatagtgatttttttggggttgtatggaatgagatatcttgttttatcaatattagcaaaattcaaatttatgtgatcaacgaacaattcattaactgtattcctctacaggaaagtcaaccatacttaggcttctcttcagattttttgactcctcttcaggatctgtaagaacaaagaacgatctatttccattttgattccctgatgatgaaattgatatccgttttatagcatgtatatcttcagatgtgtatcaagcttgccattcttgtgatgccttttgtttgatctttgcagattcgaatagatgggcaagatatccgagaggtgacactggatagtctccggaagtgtattggtgttgtaccgcaagatacggttagctatctactgctctaaatctgtcaatgctgcattacttttcttgtcttattgaatttactatgctaaatggataaagcatgtagactatacacaattggaacattctggtgcccttgtgcaact

SEQ ID NO: 35526 - DNA, 3810 bp, Oryza sativa
taaagtttatttgcgtacaggtttatgacgttgcccgccgggctgctattcatgatacaattatgaactttcctgacaagtacaacacagttgtgggagagcgaggattaaaggtgagatgcagtgtcttatgacatgccaaatccagaatagtcagaacctgttggtcctagcaataatgtctcaaaatctgtgattttacttcctttgcagttaagcggtggggagaaacaacgagtatcaattgctcgtgtattcttgaaggaaccttccattctgtaattccctctttccattttagccttaaaaagctttagattcagcgttgtctgactagcattaccatgctttagcaattgagcaagtggctgttttttattgttcctatgcaagcccttgtatgaagttaacatgtcatggtgatggtgtgccaaatggtcagagtgaaccctgctaaatctgaattatttcacactgttaacaaacactaattttgcaaaagatgagtttactgcattcctccctttgcttattttttttgttatctaatttataccagattgtgtgatgaagctacaagcgctcttgatagcaccaccgaagcgtcaattttaaattctctgaagactttgtccgttgaccgtacctctatctttattgcacatcgactgacaactgcaatgcaatgtgatgaggtatgcatgttcatgcaaatacattagaacaaaaaaacctgcaacttcattttgtgaaagtaatatgatttattgaactaaaaatagggattcagagtaatgtatcagttaacagcaacagattttcttttgcatcgattcaagaaatcgatagttaccatcatgggctagatctcaattatagctgatttatcatttgttcatatgtttgagctacagagctttccattatactcgatactgatgaatacttgtttgatgacacttcaatgattcttttataaatcttgtttcaaaatttgtattttcagattattgttttggagaatggggaggtagtggaacaaggaccacatgattttctgctgtcaaagggtggccgatatgctgaattgtggtcacagcagaataacagtgatgccatcgatgctgccgcggttagcttagaggtttcatagactatatacataattcccttttgcaagggaaaatgcaaaccatatttgaatgaaagaaggcttccccatatctgcattgtaaattgaatggttaggtttttagatatcggggaacagaaatttatagcttaggagcaaataactccgtttgaaagaaagccaggaggcaaaattttcctctttgaggaaacacccaacagttcgacatgtttccatgatgtaagcattttttttactaatccaagtaaatattttttcccactaaatcctatgaccgtgatctgatcgaggactgttgtcaaagccttgtggctgtggtggtgactggtgaggtatcatctcatgctacgtttgatatttgaggactgaggtgactactacaaatactgctgatgtgtgaatgtttatatgcttaactttttgttttccgcaggtatgtgagatcaaaacttattttatgtaaatattttggtcgttgccaaggtaagaatgaatttatgaatgctgcctcctttttggatgaaaattagaagatgttgatgttccctccagcagattgtgttagtctttgagctttagctttaacattgttactacctgcagatataaagaaacggcaaggttttgtgagatactaataaaacactaaatttacaaatacggccatccccatatattatgcggcgtgacatcatgcaaatttatgtggtgtatgtattatcagataaattcttttatgttcatttccagctcgatttacggctgaacagtgaatataatacctggcttggtagcgaggaagtaatacgcatgaggtaaagtatccgccaaaattcgaacttttacaacacaaggcatggtgctccgacatgataataacttttgtagcgttcggcagccatcgatgctgttaaatatcacggcaaagctgcagcaaattgagctgctgcagccgtagcgctgcggcaaaattgcccttcgaagaagcccatagatactgacttgtcctgtctgaatgtatattgtttgagattaagcgaatagagtagtttaattaatccaggatgctcatatactcattgttttgctttttttttatttccttggatatattggtgtcttgcattttttttaataatatatgcctagcctatgcttaagagcagacaaggaacattggacattccccaatgggaacattattctatgtcatctgctaggtgcctcctatgaccttcgtactcgtagcatgtgacagccagatgtattgtgattagctagtactgtgctacttaatttacacaacacaatagtattaatttagacatcttaacacggcatgattttcgtatatggtatttatgttttaccagccgatattgtggttttcaatagtacaaattgttgccatctatcgaaggtaaaaaggaaccaagaaaagcggggaaaacatatactccgacctacgttaattataaatcatcaaaacttgaaacgaaagtgattgatgagtgccatcaccagatctaccaaccaaatggacctttccccgggtcagcttcagcttcggtagttccagacaagcaataccaccggatgaggctgagaaacccaacctgcccgtgctgcactgtatgcctgtgtcgaccctccgctgccggtttcttttcataattttttttattgtgaacctttattgtcttaaaatttttaaaacaaatcatccataatattatttttcatagaataaattttttgaccacaccatttgagttaacatgttaggacaatatcatatcagatagcagtatgatgtttagtttatctactaccttgtgtttttaggttgctagtagcatttcttcaccaaccatagctaaggttagactatgaatctaacgcaacgctttgactagaaagctatgatcttaccgcactttacaagacaaataacatatgagatcaagatgagagagaaaaaaaatcgtggttatgtgtaacaatgaaccgaatacatagctaacttaattaaagctaacttgatgtgtagcaaagtatggcaacatgtagtcacgaatcaaacaaccccttaaactgtatttgattgttgattttagaaactaatccctcgcgcatgcaaaatagaatgaatcattaatgcatgattaattaagtattagctttttcaaaaatagattaataagatattttaaaacaaatttagtacatttagttttgcaaaaaaaatacaatgtttagcaaattgaaaaagtatgcgcgtaaaacaaacgaactcaaactaagtgccattgttcgtggcatggcaacaattatttatcttatactccacgatattttatgagcgtgaaaatgtcatctgatcacacctattaaaatgatgcgacaaaatatttagttcaaaattttcatagagctccttttgaaattaaaacttaaaagaaagttaaaaaaaaacaacaataacaataataataataataaattgcctaccagcaacactgcaagtctgcaacagcaagcaaagcagagatcacgtcctcccaggactggagcctggagggccaaaaccccccaaatttcccaagccaacccaaccaaaccggccgtctcgtctccttcgtcgttggcaatgcctc

SEQ ID NO: 35527 - DNA, 25625 bp, Oryza sativa
  unsure (1)..(25625): unsure at all n locations
aactcctcctcccccccaaatcccccagatcccgcacgccgccggtggccgcagcgccgccgccgcccaaaccctagccggcgggcgggcgcagtagcggagatctggtaccgtgccgcgatgggggacttcaacgtggcgctggtgatcgtggcggcggtggtgagcgtcctcgtcctgctcgtcagcgtctacctgctcatcaactaccagcaccccgacgacgccaaccaggcctacttccccaagctcgtcgtcgtcctcggcatcaccgtcgccctcctctccatcctcatgctccccgccgacgtcgccaaccgccaggcctgccgccgcgccatctacagcggcgcctgctccctcaccctccccatgaagaccctctggctcgccgtctacatcgccgacgccgtcctcgtcttcctcgtcatccccttcgccatgttctactacgagggcgaccaggacaagtaagtagtatacatatacatttccactctttcctctatcccattgcgcatctgctgctaaactctcactgaatgttgttgattggatccgtgtgttgttgcttcctgcaggtcagtggggaagaggctcacctccgctctcctgtgggtcgccgtctccgcggtggtttgcggcctcatcctcggcatcctatacggtgcggatcactgctctcctttgcctatcatgctaaaatttctagactagtagtaatattggagtgggatttttgaatctgttcgaatttgctatgtgacctgttctacctgaatcttgagttggttggttactagtgttaattcttctggcttcacttggagtgactagctcaagctttgagcttttcaattagtacttattttcgagcaatcaatgctgtacaaaccaggaaggcagctgccagatctgaattgtcctgtttgagctttgcacttgttgtgtagtatatctccccggtccacattatacccgcaaattgttttcttatcgaccagtagtctgtagcttcacaattggtagttttgtttttgcgctgtttcttatataatccttgtttctttcttccacccgatgtattaaaatgaactcctgctaggtcccttgaatgccctctgcaaaaaaaagggttttttttcaaggaaaaaaaaagtggtcttgtgaacaccgtggcttctaagggtttgggatgctttcactttacatgacctcactttcattgttctgctgcaggacttgttggcaaagtggacttcactgtcaggcatctttcttcagcagttgagacatttccaaattcattcactagtttctcaactggtcaaccttgcatcagtacatcgcccaagcaggttagtcaatcaatcaaattatgctttcttatgcctatagtaatgatgttatgtgctccccatccaatagcaacatttgatcgacacctttcttttggcattttatctacgactaaactgctttacggtttgttttattcagtgcgcagcttacactgcacctgctaactctcaaacaacttggacaatgcgcgctaccttccctgaatatgtggttgctcttgctaccatcgttggatctgttctcttcacagtgagttttacttcaatcttcatgttttgctttatcaccgtttctgtatagctacatctattcactctactggtctgcatgtgaccgatagctttatgtcttttattgagtgtaagctgtactagaaacaatttgaaatatggatcctttccaacatccaattctgctgcaatcatgctggtttctttttacaactttcctattcctgtttggtagatatttggtggtgttggaattgcttgccttccattgggacttatattctcatttgtccggcgcccaaaagctgtcattacacgctcacaatatataaaggtgcctatattctcacatacttcttttcaattatgagcattcattagaaccatatttttctactacatataattatcactttgaaattttcaatgtggattgagactgaacatattttctgcaggaagcaactgaactaggtaagaaggctcgggaattgaagaaagcagctgaagcccttcaccaagaagagaaaagtgggaagaagggcagaaaatggcgcaaaaatgtcaaggcccttgggaaggtgagcattgccattcaaacttttagcctcactcagtgaacaaacttacctttttgagattagtgtggagtaagaagcatttgtgttccatttcctttctaatcagaacactcgtgtccatttgtgtaccacatgccaataatttctgtaatgctctattaatgctcttattatgttttgcctgcccttttaatcatcaggaattagtacttttagaagatgacatgaaggctcttgaagagatgtaccctcaaggagaacaggtaactgaacatgaaatcctatttacattgtttcttttggtttattgctggcttaacatccatcatggtgcaggctgaggctacctgggctttgacagttcttggttacattggaaaacttttatttggtgctgtcgggtatgtgtaaatagttgtacggactttgcttctattctagtccaacctatctgcaattgtcttctaatagctacttatgatctcaggttaattatatcgattgcttgggttgcacatatcgtcatatacttgttgattgaccctcctttgtcctccttcctgaatgaaatcttcgtaaaattggatggtgtttggggtatatttctgttcattacattgttctgaactcgtcctattgatgacagtagcttgaccaatattctgttttctgtattaggtctgcttgggactgctgcctttgcattcttctgtttctatctcctcatagcagtgattgctggggaaatgatgctgggtttgaaattagttttcatcaccattcacccaatgaagtatttgacatatcccatggcatttccttttctatgtagtatcttttttggaatcattgataacgcattttttttcagatggggaggaactttgatgaactcgttcctgtttaatgttggactcatcctactttgctccatcaggtgtgctactgaggcttcttttagatgtaattgtttattgctattatttttgtaaattatgatgccatcttccatattggaactttttccatgctgacaaggtagcgtctattaattgtgaatttgttgcatatatctgaaattgtttctatatataaaatcagtgtgtcctttaacggttagcagtagtgtaaatgaagaacttttgtaaagcaaacattgagttgacgtagcttagcttgtgcctagtgcagctgaaaaatcgcttcaacatgttgacatgcgactttgttggtttcatcaaccttgcttcctccataacatatgcatacctgctgattatctgttaattttctccactaagaggccatctaaaatcttttgcagtgtgattcagttctgtgccacagcttttgcttattatgcgcaagcaactgcagctcaggagatctttggccacacactgcaatctctccgtggaattaagtatctctacaagtatgtatctagcatgcaaatccatagtcagtttacagttgtttgctcgaataagctggatatatccatgtggtggatattggagcatcaaacttttgaaaatgttctgattttaacatctgaatatgcaggtacaatgttttccagtatggctttgtggctcttgcgatactcacactcttttactatgcaatatttgtaagtgcattcttccaaagtattcagtcaattcgtatgaaaatctggaaaaatgttggcttgcttatttgtcctgaactgtttgttcagggatggcgaaagaggaaaccgacaggaagattccagctctcaaattgatttgtggtttgttctgtaaggaagcctgacgaattgaactacaaacatatttgttcacgagtgatagattggttagcaatgtatatgatctttgaaaccgctttctcaaagagctggagagtttatccatgtaaattagcaaccatgaagtataaggagaaaactgagatttcagtagggcacggacatggttgttaaaagcagaacccagctgcctttgtaatgtacacatttctcatcgcggctcttcttttccttgtgtattattattttacacttggctgatgttattcttgacaatactgggtccttcgaggcagagatgtttgatgtgatcgggtgccactttgggacccccttgttcttttgttgggtttgtatcgagttaggtcagttgatttctttcatatgtaccatactgtgattaccatacgaacttctagattgtattaaggatgtcttgatcatctgtcctctgtcaatctgcatttgcttctcatcttcagactgctcaaccaatcgagcttttggggacaaacttggctgtcctgttccaaatttcactctatttgttatggtcccttgtttagcggcatgtttaattttaccagatgaaagtcaattctggttaaccgcattctaaaccgtaaagaagctgaacgtaataaatgtatactccgtatcatgttaatccgaaatccagtgactgttcacaccttaacaaaaatggtgcctatttctttaatatccgtttacgtcagataaattgacagataaaataataagaaaagacatatatggaaggaaagagaaaggagaaaacgaaaatgtaaataaaaaaaagctactccatatggcatgaaatggaaaggataaaactaaaacaatatgagagaattttaagaaaataaagaacctatatatggaaagaagacaggagaaaactgaaactatctgtactagaagaggggggacaactgaaactatctgtttctataaatctgcctccaatgttccaatctatagctcaaaatgatcatcagcatgatgaatgccatttttgcgaacccttaggctgtccagtaagacttgacagacacaaggatcttctccctctgcatcggcccatcctcatgatcaacgatcctgctctcccatctcatcccgtctgcgatgttcttgatcttcaccaggacatcaacatcgtctctgaatattaccgtgccttctggcctcagcacacggtccatctccagcaaaatgtcctccatttcacatctgatgacatgcagagaacagcaatagattcagctagcttcatggctggagcaactgcaaagttgagcacaagaaacagaagcaaaatccagtacctgtctttgtacattgtgaacagggagtacgcatggatcagatcatacgtcctaggataagttgacatcgcctcacacctgcaaaattttcacatactaattaaagaccaataaacctgtaaattttggaacattttgcagcaacaaatacactgacgaagaaagcagtgctggagtgtaagtgggctgacccaccaactcacttattcgccaaataagtgggtaaccagttgatcgatccacttaattagcttataagtgagttcacgggtcaatccgcttacacgcctgtgcatatatgatagtctgcaattttatttttttttttgaagattttgcagcaatgaatacactgaagaagaaagcagtgcacatatgctggtctgcaattgttttctgaagattttgcattagcaacgacactgaacatattttggtcagaagaattttcagcttaccaatcttggtacgttccgatgagccctcgctcgtagatcacgccgagcgtgttggcaacggcggccgtcggcacgacgttcatcacccagacaggatcgtcgacgagcgccgccgcgaagccgccgaggccggcgttcatgtccagcagattccggtaccggcctttctcggccagcccgccgctgacgcccttgtagcgatcgactcgtctcctccacatctcagaatccttgataaaggtgtccaccgtgacgctgcttccaaggctgccgccggcgatcctcggcggcggcgatgtaagcctctccggccatctcttgacctcccctccggcgacgtctccgggcccggacacctccggtaggggagtgatgcactcttccatgttcacataccttgaaatcatttttcaagaactttcagaaacgaagccaacatttttttaagagtttataaatgtttttgagtatttttcgtaaaactactgatattttgaccaaactattgtaaaactacatatttacgacggagtataaaaaaactacagatttaatgccgagtttaccacgaaactacagatttaaggtataatgtgtaaaactacatattgttaatcaaatcaaatcttaaattttcattcgaatggaatcatgtttggatcattttcaggtgataaacatgcataccagccagcatcaggatcttggttggaattgcagaaaccaagaccaccaagctcatttctgctagccttgcagctgacatggttgatttgtttctgccaaacagcaatgtcacccatctgctgcaccttggtccagcaaaggctcttggcaatggcctcaatggccgattgctcggagctcaagtcctccggcgtcctcttccaccccttgaaatgtctctcccagttcaccggcggccctgacaggacccagtacccgccgggccggagaacccggtccacctcaatcatgtagagcccgtctgaaatgcaacaaccattgttgatattgccatgatcaatcaaagctacccctccgatcataaatattcgatgtttagaacaagatttaatcaaacttcgaaattcccgaccaaaaatctattatattattaaaggaatagaatttctacgttcgctctcatggcctagaaattctcacattaatcggagaaaaagaaaaaacagagtccatatagaaatacaatttagaaatacctaaaattcggaattaaaaaataaggaatattagaagaggagactagagtccatatagaaatacaattaggaaatagttgaaattcggaattaaaaataaggaatattagaagaggagactagagtccatatagaaatacaattaggaaataactgaaattcggaattaaaaataaggaatattaaaagtagagtatagagtccatatagaaatacaattaggaaataacagaaattcggaatattaaaagtatagtatagagtccatataagaatacaattaggaaataatataaatttggaattaaaaataaggaatattagaagtagagtatagagtccatatagaaatacaattaagaaaaaaaagaaattcggaattaaaaaaaggaatattagaagtagagtatagagtccatatagggattttaaactaaataaaatttggaataaacataagaaaattaaaagtaaagtttagagttcgtataaaaatataatttgcaaataactaaaattcgaaattaagaaaaacatgggaagaagagtttaaggtcaatatagaaatacaatttagaagtaactgaaattcaaaactaaaaattaaagaatattgaaagatgagtttagagtccacatagaaatacaattagaaataataaaaattcagaaataaaaataaataatattggaagaagagcgtagagtctatatagaaatacaatttatggaaaattcagaattaaaaaaagaaatattaaaagacgagtctagagtccatataggaatatatatatatatatatatatatatatatatatatatatatatatatatatatatatatatatatatatatatatatatatagttatttttaaattttatatatatatatatatatatatatatatatgtatatatatatatatataatttacaaataactaaaatttgatattaaaaataattaataactaacacgtatataaaatataatatgaacattcaaaaataaaaataaataatattggaagaagagcatagagcctatatagaaatataatttacagaaaattcggaattagaaaaaataaatattaaaagacaagtctagagtccatataggaatatatataatttacaaataactaaaatttgatattaaaaataattaataactaaacatatataaaatataatatgaatattacacattagtagttttgtaaagttattgcaaaatttaaaattatgttgtcattttaatatatttgaataatataatgagaaaacatatatgctattatatgagagaaaatataatgatactagccgcgcaatctgcgcgggccaccatgctagttttttattataataagtatgatacaatgatactactttagtactttttcttctttcgtttttaaaataagcatttgaggtattatccatggatggttggaatttcaaaagtttgaccgaatctcgtccttaacttcgaaaaagcctgtcaacttggtggcttccaaatcaaattaagcacaagtttgattttgcaggggtgaaatttgaggtggtggagttacaaagcacgtactgtacttgctccaggggatgaggcagcgggagcagtgcgccatgtcgaaggcgcgagccgggtaaggaaggcgcttggtggccatgatgccgagcatggccgggacgccgcgctccagggcgaagagcacctgcgcctcgtgcgtgtccttgggcgcgaacgacatcgtcagcacgtcgcgcgacagcaggtacgctccccagctcgcgacctgcacatgtggttcgttcacacttcagagttcagagtagtagacagtgcacattagcatcagattgatttgtcaattgtcatagcaaagaagacacggatattaggaaatgacctaatatcaaataattagaagaggtgaagctctgaacccaagtcgtctagcccaccaccctgtggagctagccggaaaacccctgggcatttctcatcaattgtcatagccaacagcttgactcatgcatgagtgtttcccgagtaaggatgatttgtctgatgaaaaaactttgtttacgagaaatcttatttgacgcgttttatacaaccatcgttttatttatgatgattaaattacaggccgaagggtaaacgatactagtgttaaactcgtcgtactccggttgaagttagccaagaaacacaagccaacaacaagggggaagaaaatcatgtcttggacattttgttcaatagtgttgatagctggatatatatgtcgcatcagacatcttgtaccatctttacagtgaacacaaaggtagcaagaatgatcaattagtaaggtaagctcttcgtcctgaaagaaaaccaatttctaatttaaaaacttgatttttgattattttttttaagaacggagggagtacgagcaaccagatccaaagatgcacagttgagttcagataaagctatctgccgtctggttagttggactatgattagtattttcttatccaaataagctctcatcagtacacaattccatgtgcacacttctatcgaactctcctaccaaactagatatcaatcaccgactcagacctaacatcaattaatccattgtttcttttttcaatttctcacaccgactctacacatggagagggtacttagttaacataaaaccagctttgatccacatccagaagctgatccaaatatatctaattttgctgtctgtcctcgaagcatccatgtactctatgtctagtactagttgtgaacattcaactatcctagtggcatttttaatccaacaattaacaaacagataaggcaaggataactggtgaaggtgttaatcacagatgactacatggagatccacaggcatttacccagtagaaaaaaaaccatacttttttcgcagggctaaaaaaaagggttttttcccctacattttggcaaaaatacgatagaaaaaaacaagggtgtttaactcgctacatcaggaaatttttcactacaaacaaaccagcactaggaaacacaatcatgggtgtttaactcgctggtacacaacacaagctccaaaaagtgtacactgatctacgcgctgatgatcaagaaacagtaaaaaaaaacatgaaaacaacacaactgtggtggagaaatattgatagcagcccgaatttcatagggattgaattgcaaacaaattttggaaaataaaatagggactcgattgtaaaatatcaacctcaaccagtcaaactctaccactagccgtcagatcagagatgtgcggtcgagattacgttgaccaccagtcaaccaacaaggaaaaactccactcgggactgggcccaccagtcagtgactatcatcaccaggttaatctgagaagtaaacgcggtaaaagtaactaaccccgcagccggtgtccagcgccgtcctgaccgcgccgccgccgcccagcgtgatgccggccgccgcggcgatgtcgtcgatgtaccggtcggcgccgtgcgggaacatggtcccgccgccggggaagcggagcacgtcgccgtcccgcctgatccagttctgcacgcccttctccgtcaccagctcctcgtgcggcgcgttcgcgtaccacgccgcgtcgcggctccgcggccaccggagcggcgcgcggtagccccgcggcgccgggacgaggcaccgccgccgctcggccggcggggggcagtgcctctccctgtacgcgaaccgccgccgcggctggcgcagcgaccaccgctgcccctcgcacggggtgtgctccgagtaccccgcgtcgcacgccgggacgcggcgcgatggcggcgcccccgcctcggccgcgtcctcctcggacgcgccgtggtggatcgagaagtcgagggcggtgtcgttcttcgaggccgcgggcgccggtggctgccgcgtgttgcacgggacggcggcgagggaggaggcggggagcggcggggcagggtgcgtccacacggcgaggaggtaggaggcggcgcagagcgccacgacggcggccatggcggggagcgggagcttcatggtacgcagcagcatggccgctgacttctcctcccctttgccagctactggaaatttgggaataatcactgaatcaatcaccgatcaagaactgaaatttgctatctcctcggtcagatagttcagattcgttcactgttgtgcaattcagatcgtgtggagaagggaggaagagaggggaggtggttgaaaggtgcttgcttgagatggaaggtggacacctgttgcaaactgcaagatgtcatactgtcatagtgtcatggatgctagtgcttggtgagctcaatagctgattgccattaccatgtgcaacaacacagtgtcactgtatcctgtcaagtgtcaagaatggtttattggcctggttttgttgctcttattcacgcaaatcttttgtgttctcgttgaaaaattgctgctcatgttcttgttgatttacagaatgacagaccacaggattgtacttgcacgaatggtgttttttattggatgggtgtgtgcgtttgtcaaagctaatacttttttttttcattcttttcagagatatctaaccaggtcagtgacaaacagggtaggcaacaaccggccaacaagttctgaaactaactacttctacatgacaccaccaaccatggtatgtatgtaagaatctatccttgcaacaacaaaaacagctattttcccaatctgacaaaggctggttcagatctgcaaaaagtctgaatattttcttctatgaatgcacaagaagactctggatatcgaaatgtttctggggatcagtccattgtgattgtttaatttgaggttaggctgtgtttagttcagcgcaaagtttggattttgattgaaattggagatgatgtgactgaaaagttgtgtatgtatgacaggttgatgtgatggaaaaggactgaaatttggattcaaactttggatctaaactcagccttagttaaagaagaatgccttttctggatctacatctcctctacctgtgtttcacaagtggacaggaggattactgtagttgttgttcaagcctaagcatttagctccctgtgacctgagctgattagtccaaactaagtctggttagatttgtttgtgccttttccagttgcctccatgtgtttttttatactaccaatgatattctgacttttctaatcctctccatcatgatagttttcactgagatacgccaacgagataccatacatcatgtgtcataaaaaaatcagtctgctgaattgaagtaaaaagaaaaaagaaaaagtgagaactcgaataacacttcttccctttcatattattatacaactattataagagagagagagagagagagagagagagagagagagagagagagagggagtgctataatgttaagagctaagcaatggagtttatatgcttaaatcgcttatttttctttatatatgggtacctaataacgcgaggttagtgggtttatgagatggcaagtgtaagaaacaattggtaactagtgacaacacttggaaaacgatatattgtctcatataccttgctagtggaaatagtaacaattttctttaaaaaactcacttaactctaatggagagaaacgtggaatttcactgaaaatttagacatactctcagtttcttctaaaatctcagcttccctcgcaaaatcttcactgagcctagctagagagatagctagccgcttcaatcaagtggccatcacggtacaaactaaaggtttagcttaatcagtcaggagttaagtagcccaagatatgcaaatgattagttcaatcaactggccagcagttgagatgtaatctctatatatatatatagcagagaccgaagtttaagttgaatcaattcgtttgttctgttttttttggtaaattttacgcatgataatgtgattgcatttcttgagttggaacttagaactcatcagtgatccactggttgagagcttgtttctgtgaaatcatatcaaatttatttctgtaaagatttacttttcactcgcgctgcagttaaccctcagtgttggctgctgatctgaagtataagtcgacgattttatcctgggaaaaatcagtgaaatatcccttgccgacggagaggccctcgccggcggcgagccgctccaccatgccctgcacctgctcggccccgaccctcgccgggtcgagcaggttgcaggcgacctccacgacgccgccgccgtgcgcgagccccatcgcctgcacggacgggagcccgccgccgcgctcgctgacggcgcgggcgatccgcctcgccgcctccacgtcgccggtgtggacgggcacgttgtagttgtcgacccagctggtggcgccgacgaccaccacgcccttggatctcggcggcctctccggcccggcgtcaggggcgacgggcagggcgtccgtctccggcgctccccgccattggtcgccggaggagttgggcttgaagtagccgagctgcctcctgatggaggccagcgtcctcccctcccggtgcgccgcgccgtacagaaacgtcggcactgcggcctcggcagcggcgagctcgccattagattgtttcttgaagtgaaaattgaggagaagaggagtggagagcagcaccaaccttggagctcgtctccgatgtcggcggccacggctccggcgaggtcggcgacgtggcggagggaggcatgggcgagggggtggaagcagatgtggtcgacggcgccgaggcgcgggtgcgtgccggcgtgggcgccgaagtcgatggcctccagcgccgccctgaccatgccgagcacggcgtgccggagcggcggcggcgccggtgagggggtgagcggcgcgacgagcgtgtagcccacccggttgtaggcgtcgtcggtgaagcggttgacgacgacggcgccgccgccgccgccgcgcgccgcctgctcgatggcgcgcagggcggcgtcgttgcggctctcggagatgtagagcttgcagcacgccagcaacgtcgtgggcctcgccatcgtcgtcgacgtcatcatcgtcttcttctccggcgatgtggagatgacacgagaccagcgtttgttgtgtggacagaattcagcaaggcatgcagcctttggacttgacgaatttcggagaaattttacgaagattgaggccgtgtttagttccaaaggtttttcttcaaacttccaatttttttatcacatcaaaacttttctacacacacaaatttctaacttttccgtcacatcgttccaatttcaaccaaacttctaattttgatgtgaactaaacacagcctgaagtaattagtgagaaaatagtttaagatttcacaggatcatcatcgaaattagttcgattctcacaaaacaaacactgaaaattcatccattcattccaatgaaggttttattcagggccagtcctaacttcttggaagcccttgggtgaaataaagatagaggccctcataacttttttttttgcaatagtgaatataataattcattatattattgaacaaaaacatccgtaagtcatactaactgtcattccaatttccaatcgcctaataatacttttcataagttgaacacaacaaaaaaaacaatattttcttctcttgtaggccccatttccactaaaactagaaaatcatgcgcacctggcgcgcatgatttatagcccgtatatattatttttgtgttattaattagcacattgttcataaaagtttaaaaaaatcttagttgaatggaattttttgagttccagtttaacgtaatagatcatattgttgagaaaatcatcaaattttctccctttttccatccatgccattagttattcctttgttttttttaaattacaattaagttattaactcatgatagatttttttagtagtgtccattgaattggttcgaagagataaaatagttttttttttcatttaagatatgcagctcaatatttcgaaaatacttatagagatatatatgaatatgagtagttgtatatgcattctaacattttttgcaaatgtactatagaatactctatctttgaacatgtacatgtagagcaagtgagctccattgacagaggcatttgctccttcccctgatatatagatacttccagattatccttcctctgcgtgagaggactggagctgccacagccatgctcttccctcgtactcctagacacacagcgaacgtatacattttgagcaggtggccaccattggctccattgacagaggcatttgctgattgcctaatcgatccttttagattatcctttcatctgcaagggaggattggagccagcggcgaatctagaataaaaattacccggggtccactacattactcgaggtccactacatagtagttatctaattattcactagtatactaatcaaaatagcataaattagttagaatttaacaattttacccggtgtcctgtgacaccggtaagttatatgtgggcacgccattgattggacccacaaccctgttttttccttcgcactcgacgcacaactgcccaactcttggtatcattttttccccttttggtgttctccagatttatctaccatgtgagagaggacacgtggcccaatcactacagataaaagcaatatttatatatttaaactcatgctagcgtataacatcatctataatttatttaattctacaaatcaacatgtaagtatatctaatcatcatcgctcacattattttaataatattttaacaaatatacctattatttttataatatttaacatatacttatcaatattacggttatcatttgtttgttttatgataagtgttgataaaacctcatgttttaatattttcttttctttttacctctcagctcgacaacctttggggaagacgacacttgcgagaacaaggattggcacgtcggtgctgggagaaaggcgacaaccgttggggaagatgtcgcttgcgagaacaaggccggattgccgcgtcggtgctgggagaaaggcatgagcaattgaggaagatgacgcttgcgagaataaggagaaaaagaggaagatgatggtagcagaggcaacatcgccctcgtcccttgatcctccaaatctgggtatcctcattgggcccttcttcatccctctctctttctcctggatgtggtcgagctcgaggtcgtggtcgttgctaccgtggatggcgtggacgtgttcgacctcgacgctcaccggctggttgatgcgtccacactcgcggaccatcacagctggtacggctcgacgcccttcgcttgatccgttgagtgagtggatcttgctcgttggaaatagcttccgtggatccggaaaatactgttgtagatgtcttcctcgtcgccggtttacgacagctaacatcggctcgctgtttatattttttggaaaaaaaaactttcaaatattactatagtatagttgcagtgtaactacaatatatagtatagtatagttgtagtttccagcgagttatgaaattagttttctcattcgtgtccgaaaaccctttccgacatccggtcaaacgtccgatgtgatacccaaaaattttcatttcaccaactaaaaaggaccttatatacaagttataatattgttatagtatagttatagtggaattatattacaattatattatagttagatttaaaaaaaattcctttaaaaaacttggggcacttttttagacacttttttttcttctccattgtttcctcggtatgcaatctttttcaccagttctttccgtgttttggtgtgattttcaaccgagtttggaatgctctggatttttcctttgttttatctagagtcttcacagtcgtgcggaatggaacgtgctcttctggacacatggcacattttaacgagatgtgagcttgcttttagctttggccacgtggcccaatgattcggtagagattgcaccctgaaatcggtatttagatatctcctgctttattatcaagattaccccaatttcttggatcaaaaattcaatagcaaaagttggttgttcatcaacacccacagaatttgtatcagccgaatcatgttaggtttcatgctcactcaagttattgacatcttcattctgattgatgctattgccttattggtattctctagaactgtcattaatttgctcgttgaaaacaactaaagccaattcatcgggatttctaaaggaatcagtattattcctaaagaacttctcgattgctcccattaagattcagttaactcatctactcgtttccttttttttttcctttttcacttctagataaatacttcctgactgacataataccaagaacagtagtacaaatgtacaatatagtagtaccttgatttgcaaattgcaaatcggctggaatctgaaaacgtgtcaacgaaacatgaagaaggcaagctctaatctcttaaaaaaacacctaaaaatatattatatagtctttagaaccttgcaaggcagcaaaaaaatatattaggccgagtttagttccaaactttttgttcaaactttaaactttttcatcacatcattccaatttcaatcaaactttcaattttggcgtgaaataaacacacccttagttgtattgtactcctatgtaataatcaagaaaatcataccatggttgtctgcaagaatcgccgatctgaaccctttctcttaaactctctcctagctctaaaacagatgtgttcatgtgtaggagaggccaacaggggaaaacgaatgctaaagtcagctgtcagcaagtctccaactcttggttctgttggacggttggttggagtcgccggcgcggcgctcgtttcgtctttcgggaaggattgaagggaaggggattggtgaacagaaacggaacaggcgacgcgcgtgcggctggagccaagcgatccataatccatttccccaacacaatctccttcgcttggaacatcttatgctcagagacatttcatcgaacgccctggttgcgcccccagaatggcatgagttctaataagcatttcgtcgaacacaccgcatacaggcaatgaccagttgatgtattgagaaactttttacttgattcattacaggagtacatgtcaaaccagaacaaataaaacaagaaaccatacgaacactttgggagaacatgtatttctactttaatactactatggcagtcgatgtgatcagaagtcctcgtcgatgctgaagacatggttgcaagaagcgccgccgttgaggctggacattacggacgccttctggtagtcgccgacgcgcttctcgaagaagttggtcttgccctgcagggagatgagctccatccagtcgaacgggttggcgacgttgtacatcttcttgcacccgagcgccatgagcagccggtcggcgacgaactcgatgtactggctcatgagctcgccgttcatcccgacgagcgcgacggggagcgcgtcgcagacgaactccctctcgatgtccacggcgtcggcgacgatctcctggacgcgtgactcgtcgagcttgccgcggaggaggtcgtagaggaggcaggcgaagtcgcagtggagaccctcgtcgcgggagatgagctcgttggagaaggtgaggcccggcatgagtccgcgcttcttgagccagaagatggcgcagaatgaacccgagaagaagatcccctcgacgcaggcgaaggcgacgagccgctcggcgaagcgctcgccgccgtcgatccatcgcatggcccagtcggccttgcggcgcacggcggggacggtgtcgatggcgcggaagaggcggtccttctcgacgtcgtcgcggatgtacgtctcgagcagaagcgagtacatctccgagtggatgttctcgatggcgatctggaagccgtagaaggcgcgagcctcggcgacctgcacgtcggacatgaacctggaggcgaggttctcgagcacgatgccatcggaggccgcgaagaaggcgagcacgtgggagacgaagtggcgctcgtcgggcgacagcgcggcgtcccagtggcgcgcgtcggcggagaggtccacctcctccgccgtccagaacgacgccaccgccttcttgtagaactcccagatctgcgggtacctgatcgggaacatcgagaagcgatccgacgactccgccagcagcggctcctccatgtcgccgccgccgcgggctggcaccagcgtcttcgccgccgccgccgccggcatcctcgtcttcctcctcgcctccgccgcggcaaccgcgattcgatctggtggtttggggattggagttggctcggcgagtgggtgtggaggaggaggcatcccctcctcgcctttatagcggcgggcgcgcgcgaattttggatttcgcgccttggtggcggcggcggcgggggtggcttgcgagggaaggagcaggagggcgccgtgccgggaaagatttggggggaaattttggatttctcctcggctgctttgaaattttcgcggggaagatgacgcgtcaagccagccgccccgtgaattggggaaaaggaggttaaatgcgccgcgatccactctatatgggccggcacctgtcgcagatcaggcccaacatccagttgtgtagtgggcccaaattccaggttgggccgcgtggttagagctaagatttgagcgggccgggattgtgggccaacgtacgaccggcgataagaagacctgtaataaagcctgtaacggaataacggctattgctttggacctcacactttctccggttagctaggggtgtgtttagttcacgccaaaattgaaagtctggttaaaattggaacgatgtgacgaaaatgttaaaaatttgtgtgtgtagaaaaattttgataggatagaaaagttggaagtttgaaaaaaaaattggaactaaacacggcctaggtaaagcaaattagggtgtgctcggtaaaatggttggaaacttctcgctgcgcatgtcaaacagaaccattcattaatgcataataaattaagtattatataaaaaacttaaaactaaattaattttgttttttaatatttttctatagaaaacctttataaaaacatatcgttcaataattgaggaaatgcgtacatatgaaacgagagaggagaagttaaattcttattagtataaaacacacatttaggaaatgtgcctttaagatttcgatttgaagatttcaagctcgcgccaggaataacatccgattgaaacttcatttattgttaccataatgttcctggatggtactgctactatacgtcctgttagagaggtgctgtgtgtatgaaatacaaatggctctttggatatgaatttatgagtaactccagtagttagacgtggaccctatgaactgcagttgtggatttaatctcatgttttcttgccggttcacatacattgtttgaaaaaaaaacttgaaataaactactctgttaataagcaaaccaacgtttgtttatagcgcgaactacagtgtgaaatattacatgtagttaacctggtaattgaatttacgtccccgacgtctaatgttaacatttagacagcaaaatatcatgcaaatcaaccattacaggcgtatatgtacgagtggttcatagataggcaatactaatgttgccatttaggagtagaagctagggcaacgcataacggttgtactaaacagtcatttcaattgtaacggttattgtacagcttgatccgatgctactcatcaccgtcgcatttcttgtaatttccccacaaaattttcaagtaagaggaagaaacaaattaagactcaaaagtggtggcacaacacaatgatgcatttcaagatcaaaacaaacccaaaactcgagcttacttagtagccacaacaaatataccagcagctaacccagctaatgacaatagctgtctgcaagtaaaacacccggtattttgtcacgtaccaaaatgacacttttttttctgacagcaatggcacatcattaactgagccccgcattgacgccaaaacacgggacacgcatgcgtgcgtacgtgtcccgatccgacggtggcaaacacacaaacatcatcatcaccagacacgcaggatacagccacgtagtacgtcgtacagcacaccgtaccccaccctgtacactagcctgtacgtacagctcagcgtccgttgccgcgctgacgtggccgcaccgcgtggcgtccggctcacgcgatctgggccgtcggttcggcgcgggggcccacgcgtcagacacgcgtgtcaggtggtgggagcccaacggtaacaaaagaacgggggcgtgctgcgtgaccgcgtccacgcgtgcgtgacagcgttagggggggtggtcacgtgcgtcgcacctgaccgcaacggtcacattgaccagagagggggggaggcaatcaggcaacggtcacatcccggaccaccccatctcgcaccgtccggtcgcgatccgacggcgtgggagccgcctcgagattcgcgcctcccgcactcttttcctccccttgggttgcccctcccggcctcttcttcccttcccttccaccacaccggagaggtgagtgagagtgagagagtgagagcagagaccaccaccaccggagaggttagtgagagaggagtggtaatggtgaggcaacaagagtaggttccatttcatatcatcactaggatagcgtagtttgtaggctgcatctccatctccatcgccattgattcgcattgcatccatcattttaggatgttctactagggttcttgatttttcttttggtttgttgttttgacgaatggaggtattgttgggattcgccgcctgctgctcgtcgtcgtcgtcgccgatgaggaggccgtgcgggctctgccccggcatgtccgatcgttcgtgatttgttttttctacatgttttagggcccatttgttcttgatcctattctttgattcttttgtactaagcattctaaggcgaagccacccattctttcctgcatatatacttacaaacacatagcccccatctgatctcacaaacattatttctctctctttttttctcagttttttctttgttgatttactgaccaaattctttggaagaacaacaagatcatctggtttttatctgctcattcttttgtacatcgaatcatatacatttccattccaccaaagccttagccagataccacagagagagtgtgagagaaatcagagtgagaaacagaggaggaagaagaagaagaagacgaggaggaggaggaggaggagcaggaggaggaggaggtctcttcttggcacgtcgcgttccggcgagtgacgtgtctccgggatgttggcgggttgctcgttctcgtcgtcgaggcatcagatgagcaccgcgcagcgtttcgacatcctcccctgcggcttctccaagcgcggcagccgcggcgacggcgccgccccgcgggtcgccggcgacgccaggagcggcgccaccacctgctccttccggacgcaccccgcgccgccggtcacccagtccgtgtcctggggcgccaagccggagcccggcggcaatggcaatggcgcccaccgcgccgttaagcgggcgcatgacgaggacgcggtcgaggagtatggccccattgttcgcgccaagcggacggggatgggcggcgacggcgatgaggtatggttccatcaatccattgcagggacgatgcaagcgacggcggcgggagaaggagaggaggcggaggaggagaaggtcttcttggtgccgagcgcggcggcgttcccgcacggcatggccgccgcggggccatcgctggccgcggccaagaaggaggagtacagcaagtcgccgtccgactagtcgtcctcgtcgggcacggacggcggctcgtcggcgatgatgccgccgccgcagccgcccgagttcgacgcgaggaacggcgtgccggcgccggggcaggcggagcgggaggcgctggagctggtgcgcgcgctcaccgcgtgcgccgactccctctccgccggcaaccacgaggccgccaactactacctggcccggctcggcgagatggcctcgccggcggggcccacgccgatgcaccgcgtggccgcctacttcaccgaggcgctcgcgctccgcgtcgtgcgcatgtggccgcacatgttcgacatcggcccgccgcgggagctcaccgacgacgccttcggcggcggcgacgacgacgccatggcgctgcggatactcaacgccatcacgcccatcccgaggttcctgcacttcacgctcaacgagcgcctcctccgcgagttcgaggggcacgagcgcgtccacgtcatcgacttcgacatcaagcaggggctccaatggccgggcttgctccagagcctggccgcgcgggcggtgccctccggcgcacgtgcggatcaccggagtcggcgagtcgaggcaggagctgcagaagacgggagcgcggctggcgcgcgtcgccnccgcgctcggcctggcgttcgagttccacgccgtggtcgaccggctcgaggacgtccgcctgtgaatgctccacgtcaagcgcggcgagtgcgtggccgtgaactgcgtcctcgccatgcaccgcctgctccgcgacgacgccgcgctgaccgacttcctggggctagcgcgcagcacgggcgccaccatcctcctcctcggcgagcacgagggcggcggcctcaactcgggaaggtggaaggcgcggttcgcgcgcgcgctgcggtactacgccgcggcgttcgacgcggtggacgcggcggggctgccggaggcgagccccgcgagggccaaggcggagtagatgttcgcgcgggagatccgcaacgcggtggcgttcgagggccccgagcggttcgagcgccacgagagcttcgccgggtggcggcggcgcatgaagaacggcggcgggttcaagaacgccggcatcggcgagcgcgaggcgatgcaggggcgcatgatcgcgaggatgttcgggccggacaagtacaccgtgcaggcgcacggcggcggcggcagcggcggcggcgaggcgctcacgctccggtggctggaccagccgctgtacaccgtgacggcgtggacgccggcgggcgacggcgcgggaggcagcaccgtgtcggcgtccacaacagcatcacattctcagcaaagctaagctgacgatgaatggtgattaggtgaagagaaagaaagaacaaagcctttttttacagtgcttcttttgttaatgatgattagttcatacagtatgacaattcttttatacattcagagaaaagaaagaagaaagaaaggtgtagttttttgttttatagattgataggtggaaagattcaattaaatcaaattcaattcaatttttagattgtaattctttataaatattcttttggctgttgagagagagtcccctgcaaaatgtagctgcatgtagaagaaagaaagcaaagaagcagtagatagattagcaggggcagcatctctcacagtcactattagtgtctccggctgttattatacaacattattattacaatcaaattctttcatcattcattctacatgtaatctctgttcagaatcagaatgaaatgaaacatgtgttatatttctccatggatggtgaagtttgtgtcatctgaaagttatacttccatctttcatctgttattttgctcttgttttgatggtatccaattcaaaactgaattgcattggttgatgtgtcgtccaaaagagatgttatagtttgcttcttcttcttcttctttttttggctctctctgaagagcttcagttttggcgtccgctaatctgaattgtattccacggtgctattaggcctcacgaaatgcagcccatccagcccacccacatctctaaaaggccggcccggtcaggcccatcttcaaggacacgcggcaagccgcgtcaggcgccggcgacctcgtcggtcgccgccgcgctccacacgcccccggccggcgcggtcaccatccgcttcttctccaaacgcccacgcgcttctcacctctccagctcctgcgccgcgcgcaccccttgcccttcgccggcagccgcctctggttcctaaaccctaggcgaagaccttcctccgctaaccggctctggctcctgttcgtccccggcggcgtgcgggctcgctcgctcgaggtgctcccaattcccaaagttacactggtggcgcggcgtcggtttcgctcacacggtgctcgtccaaatgcctacccggcttgctggcgcgtagcacgccctggatgatgccatcacgcactccaaatctccagtattccaccaggtgttgctcaaggcctcatagtacacctatt

SEQ ID NO: 35528 - DNA, 7064 bp, Oryza sativa
  unsure (1)..(7064): unsure at all n locations
nnnnnnnnnnnnnnnnnnnnnnnnnnnnnnnnnnnnnnnnnnnnnnnnnnnnnnnnnnnnnntgaatatctttgtatctagacttattgtactaggatgtgtcacatccagcactaagtttattttggatcggaaagagtacgtttgtagattcacccgtccattcacattctctgttattttcctagcgagaaccgtaagagtagtcatactgcactgaagctggtgcaatcgtggtgtgtgtgtgtgtgtgtgtattatagagttgagaaatcatggaatgccgatagtaggtgaacagcaccgcacttcccaccatattctagtagcatatgctagctcatgacgatgaatcagaactgtttatacttccaatgaaacaatatataatgcagtttatattatccatgtttcatacaggattacatgctgaccgtattgtttcattttccctcaaagcaaaagtaacatctgaatttcttactttttcctgcaaggttcttgtgatgattaaaggctaaggtgatcctgatgttacctttacaggtaagtggaatcatgttcagactttaactatttctatggacgatggctactgtctttcaattcagtgttggtttcagaaattcagttcatctattatcataatctgttttctgtcaccggcaacaatttagcatgcaccaaataactttacttatttttgtattcggtacaccttgtagtatcatcttccttgtaacatatggacattttctttttggtcttcattttgagttgtttaaagcctctctgcatggttctttgatctttgcatcctccttaagatgattgagataccattgccggcggtactgtggatgagaagaaacttggctatgcacttgccactggacacccctgtacagttataccttccgcaatggggcaagaagctaatggacaaccatccaaatcattaccccaccagttcaaactgattttctctagtcctaggcataaatatagcaagacagccatgaatgccaaaccagcatcaagggcacctgaaagtagataattgtgtctctcccaccagtcacgacggtacttatagaccacataacctgacaaaaatgctacaaatatccatgccgtgtagttgactgaagtggcaggaggcatctggctgattccggcgatcagcacaggcatgttgacaagtaggatccatttctgacctgggaatgccttgtgtgcaaaccagacgaggaggggagcaatggcaccccccaagaagaaccagttgacagcagaataagtgcctaaatcaccaaatattctgcgtgggccaataaggccccatatgactgatgcatcatagaataaatgatcataagggcaggtccaagggctgcctggggggaggagctcggtgttgcatatgttagggattgtatccatgagccaccatgctgttccaaggtacacaaatgctgctatcaaagtgcccaccacctgctatttttgaattgctattagggacataatcaacactgaataaaatgataatctgcttatcctccttttttacaagcaatacacccatttattcatgtgactagtgaagctgacctgagccataaacatggtccttggtggaatcttcatgtagtgtcccagcttaaaatcttgtaggaatgctagggcttgctgtgggccaatgtaaccatataccttgaagcacatgtttgcgacaggtcgtccaggatacaagtaccccatgatgtattccgtgatgatattcaagcctggagtctgtcacatacagtataataagctgaagtgctacacttggatgtgtgcattagcatttgcctttatgcttttacttcttacctggtttgtcgttgctgtgacgattccaattggaagggtgaagaaaattgcaagggcacatgcaagtagtaccccccaccagggtaactgcaattgttctatgtaatactcacaagtgaacatggtgattgcaacactggctataaggatggagatgaaccaccattcaggaacctgtttgtacctcttcataagctttgtatgtatgtccatctttttatcttgaaaagctgatctgcttagctgccaaatttcactggacacaggtgtcacaaatttatctgtgtatctaattttacataatagacctagagggagaaggaaggggaggataccttccatggaaaagaagaacgtggacaactgttgcagtaagacatgcaaaaccaagaccatagctgatagaaaagaaggtgctgatgtataatggtccattcttctcataggcttttgtatcaaaatgaaactgtgagtctataatggtagagatgttgtacttctgtccagtcactgtgaaaaggccatctgaaaagatagggaagttttgtgccttgtagagattaatccagtaggcgattggtgtgattacataaatgtagatgaagaagccggcagcaatgttggcagtggcaaaccatgggctagccagtgggcttccgagatatgacgagatggatgaccagtcgagtccaattgcaccaatgccaaggccatggagacctgatccaagctgttgtgcgagcacagatttgggaaagatccaacaaatccaggagagggaagtgagcatctggaataggtagcctgggaaaatgtagtaggcaaagctgcacacaaatgctaccaagaagaactgggtgcgtgtcatgccgcctttgctcctccgttccttttcatgaagtgccctgatgaacatgtgcagcaaatctgttattcacttttctatggtagtttttttttagccatcctttgactacggagaaagttattattttactgctaatttgattctgcatttgcaagtgtgtccagtatggctattaagctcacttttcagattgccactgaaagttttagatgaattcactcattggcagagcaacacagatttatgccttattatgatttataagtgtcatctcaacaaaatgctgaacctttttttttatttgcagacaaattgtatccatgtttttctgacaaatcattgaagcctctagggaagtaaacatcttgttttaaaatgtctagtcgggtttactcaaatgaatcttgatattgtataaggtttagttgatgcttgttgctggttgtaactgatcttgtttccttggtcgtaaatggaaaattgttatgccttggtttgggacgaaaaatcttgttatagttttaatagctgctcttcgtctataattgaagtgatatgatattttatatatcttgttttctttctttgaattttatctgtcaaaattgattgactgcttcttttattactcaggatatctccaaatacacggaattctggttttctgcagcagcatgcacttgcatagctgagtgtccaagtcgcctaaatctcctaattgttgcgtagaattcagatgaagatgatgctgggtgggttttattattgaattgactggtaaatgattcctgttcgcttgagtcattatgtcaatatctactttttagacaattcatgatgtgccaatatatctctgcttattatgaatgaaaatgacaaaaccatgatataggacagataatattttttatataattagcatattgctgaatagcagtgccatcgtattcagtgctgttcacacaacatacgacttgaacaccagcttaataaaaacccttatttgtccttcaaagttcaaagtatctttttttttgttgacgttggttttgagatttgggaaggtggttggttggttatctttgggtagtctagcacttagctgtaccttattaacacatcaattgcaagcaactggctgcacacatcatgcgacgcaaaaaaaatgtattctactggtggaaagattactttacaagtggcaattcaactccttttaaccaatcataggcaagctatatctgaataatcagatttataccacatgtggactctaaattatcccgaattactatttgcttattacctgaagagggagacctgcacgaggttggacggccaccacatcgccgccggctccaccagataccgccggaatattcccgcccacccgaatcccagcacctacaaaatgaagctcaagttcatgaacatgagtgtacatgacaccttgtactgttattactgcagcacgttgatgtcacctctacctggctggtgaggacgacgaggagggagacgaagaaggagatgcgcttcccgtagaagactcggacggcggtgatgacgttaatggcgaagacggaaccggcaccggcgttggcgaagatggtgatgagcacgtgctccttgacgttgaacgggccagggttgagggtgaattcccacggccggccacggaagaagacgcgctccggcagcgcggcggccatgaggcggccgagcggcacgacggcgatctgcgccgagatggccgtgacggtgagcggctccttgcggtaccagaagaaggtgttgaggaaggacagcacgacgcaggacgccgtgcccagcacccatatccggaacgtcagcaccggcgtcgccgggtcgtcccccaccggcaccgtcagcgccacctgctccaccggcgagttctcctccggcgagccgagccgcattgaggatcgcactgcacgagaagaactcatcaggcaacagaacagtttgctttcttctagtggtgttccatggcgggaaaaagaaaacagctgagacgactaggctttgccgtgcttacacagtggagaggtgatttggctattatcttgttcctcttcctctccatctccatggccttgctcttgtacttcttggtgatgggaggacgccatggatggataatgggaggagttgggagctgtgccagtgtgccagagagccagagtgcctgcctttgtagctagtagccgtggagtagcttatgtggactcttgactttttgtgcaaaaatctgcctgcatctgcaaagttttggttcagtccatgtccaaggtgcggcaaattttactccggacctgtaggcatcagtgagaaaattgagacacaggtacctaaccttctgtttatagatagattgtagagtttctttttcagctaatggacgaatgaaacggcagatttgggagaattgcgtcgctgtgaggaggacaattcgttcgatccaatgctacaagccttacaatagaggcaagcgggccgtctctttcagcattttttatggctcgatggtatcttttatttatttattatgtacaggataacacggttgattgatgcgatcgtcctgctccatgctgttaggccctgtttagattctggcaaaattttaccttccgtcacattggcaaaattttaccttctgtcacgtcaaatgtttggacttatgcatgaagtattaatataaacgaaaaaaatcactacttacacagattgcgtgtaaattgcgagataaatcttttaagcttaattgcgccgtgatttgacaatgtggtgctacagtaaacatttgctaatgatgaattaattaggcttaataaatccatctcgcggtttacatgcggattttgtaatttgttttgttattagactgcgtttaatacttcaaatgtgtgtccgtacatccgatgtgacacgccaaaactttatacccctgaatctaaacaggcctaggccacatagcccacatcaagcaaaatagttcaaaggtattcatatctaaatttaccacataattttggaggggttttgtgggaattaaactagtttcagcaaaaaacatgtgaaatttctgagtcatggaagcagctgtaaaatttctacctttcgctccagaggaggcattttagaatctccgagaggattacaagtagcaaaacaatgtaagcatgccgagtcgtgcaaatcagaaaccagaacagactactaaatataacaccacgcggaagggagataatatgttgtacacaaatatgtgatgtgcaccaaaattctcccaacacgcattaatcggcaaaattgtctccagaagtatatatatatatcccaatataaccggccataagcatcacatctgcacgatgccacgaattgttttcagctttgatgtttaataactagttaatgtcagaaagcatctcacaaagccaaggcaccaaagttggaacttggaacaacagaaggttaccaatcctagcactatggagtaatatatctagagcgaccaacgaactatcatcatttcacttgaacattcgatgtgatcatgcctacaaggtaggaaaagcgattgactcatgttatctggtccaccgaagaacttgaggtcaagttgtttctaaaaaaacattgagcagccagagttgtcaaatcacctgataaaaggacgaacaacttaacgcctaacacgaccaccaccaggtcctgaacctcccctggggccagtaaaacgagcaaactggagccgtaaatggggtgaattgcgatcatgttcatcgaatttgtagcctgcaaaattaaccatgaattttcatgatttaaaacatggaaattaagcaatcaaacgaacggttcaatgaccagtcaactaccatgtaatttctcactcccaagacaccacagagaactaactcattgcaggtgcgaattactctattttcgtacatgaccttgaaaagttttagatggccactgacaggattactttgatcatgctacaaaaaataggcaatagatgcctgacatgatcatggaacagctattcctttttacaaacaagatctaacagctacctattaggaatcacagtaattagaatacattgacaagcatcataagtggatcataaccgtactgggaattaatatagcttgctaaagttgttgtcaagtgaaggggaaattaccatttgagaagcaccagcgagctactagtaatatagatagatggtgatatctatgccattttctgccagagtgtttccacaggcctagtccccaga

SEQ ID NO: 35529 - DNA, 3536 bp, Oryza sativa
aacaatgtgaagcaaaaatgttcaggtgataaattaggaacagacaagattttcacagcccacttttagctgcttggcccgaaaataactcccacaccaattttaaggacaaatacttcagtcgaatgagttctattcaaccataaagaaactgactgtcggcttttagcaaaataccccaaattaccaaccatcacaagcatctatcagatcttggtaaacaaagcatccaaattataagcatgcatgacaatgagataactaaaaacagggaaaaagatagagaagaaaacacacaagttcaatatcatgactcataagacactgataggagagatggatcaacagcttcacatggtgtacccacagctgtcagatttaattgggcattacgcagccaaaagaaatttgagatcaaaaggtgataaatggctcagtgtcaacaaactatagttcactgactcaccttgcaaagcatccatagcaatagcagcttgactagcagtttcaaaatcaacaaaacagagtagaattggatccccaccaggctgttaacagcaaagcacttagatggatgaacaagaacgaaacaagagaccaggcgtgacagcaccaaaaagctcacttacatgtcttgcttctttgcttacaagtctcacctcacgaaaaccaacaaatggtcggaagatatcttgggggaaggtgaaggaccagcagctaagagatggaggcatattatgaataatttacacccacaatttgtgcaaatgaaagattaaagatagacagaaaaaggcatgggatttaaggatacgagaaacttctcgacgtgcacaatcagtaggaattccttcaatgaataatgtatttgatgcatctggtggaaggggaggctctggcatcccaccaccaaagccaatatttctggcttccatgcccccaccagccatcattggacgatcctcaactgggtatccagcattgccacctgccgcaggcctaatagattcagcaccaggtccagctccagctccagctccataggattgaatttgctgtagtacaaaaagaagaaaaaagtgtcagctgacaatgtgtttaaggaattgaatatagtatgtgttaagaacaggttttgataccccagtgcgcagaaaacgttcataggaagcgttaagagcctcagtgtctcttgcaggacgataccctggcctttcttcatcacgagagtaatagccagccatttcaggagcaccaggtacatctatgcaagggaaaaaagtggtagtagtaaatatgggcctcagtcctcgagacactactgcatcctaaatcattgcacaactagctagtactaaaatataactgaaacagcataggacaagcagaattgttgataggtgtcatcctaaatcgactaaatcattccacaactagtactaaattataagtgaaaaatggtataggacaagcaggattgttgataggtgtcatcctaaatcgaaatcaagcacacgcaaaatccaacagtgtcctcagagcgacagtgctaccaaaaccgagagagcgtgcaattttcatggacagcttcagtgatagcgaacaaatgccactgcatcgtcgggagatccactacagtctagcgaagaaacagtaagtacgaaatgcatgatacgatatgcacacgcgatatcacgcaagtgagacaacccagagacgaccgaagaagaacagccgagcattgcaactgcgagaccctaaaaccctataaacagtgaacacccgcgccggcttcagagccgagacgagcagctgccagcgaggagagggagtgaggtgtggcgaggcgaaccggagaagtcggcggggcggggccgcttgagcggctgcccggcggcggcgacctgagaagcagcaggcggcggggcgggcatcccggcggcgggggcggcggagaggggcagctggtggtggtggtggtggcgcgcggcgtcggcggcggcggcgtacctccagtacgcgtcggccatggcgacccgtgggggcgggggccctcctctcctctccctctccttctagaaggttctggattcgcgccgagaagagagagagagaggaagtttgcgtggcggttgcggatggcggagtggagaaggaaaggaaaggaaggaatgacgtgttgggggagaaagccaaaggaggaaggggggaatctccgcttttcgggaccctggtggtgctgcactcagcgctcctctgcacgcaccacgcatgaacggtccagattgcatctgtcttagggccctttgatttgtatgaaaagtagaaaagttggaggatttgaatcatatgaaaaatatttctatggaagcatttgaaataaatgattgaatcctatcttatctttttaaattcgtatgtaatgggtaatcctcagagattttggaggaaagttagcaagatgtttaacctcttaaaaaaatttctttgagtctatgtttctcatctcattcctgtgtttttcctgtggtgcaatcaaacgatcattcctgtgttttttctgtatttttcaatcatctactccctccgtcccaaaatataaacattattagcatagtgacaagtcaaacatttttaactttaacaattaatagcaaaaaagaagatcaaccatatttatcattaaataaactatcataatatgcaactctttttatttaaaacatcttacttttatagatattgttggtcaaagaagcatctcgaagaccgtgtcaggtccaaaaattcttatattttgggacggagagagtattttacacttgttttttcttattttttttagagaagggtattttttacccggcctctacatccaaccggatatatacggccattgaaatagggaacttagccccgcaaacaacccaatctgaaattcgctccataggagaatttgaactcaggaccttagggtactacgcaggtccctgcacacttgtatttttgtcaaaatcctatgttttctctattcctccgtttttctattgctaagatgcaaatggaccctttaccttaccacgacatccgtgaacaattggatataaccaggagtaaattttataaaaatatattttatttttttagaatgcttgatatagttttcgggcacttgtagttaccgttctgcagcggcaagaccagtaaacgcgcaagggaaatcctggatcgtctcctaaggctgcgttctataccaccaatggttcacaactttcctccttttcaaactgctaaataatacttttttaaaaaaattctatacgaaagttattaaaaaaatcatattaatccatttttttaaaaaatagcaaataataaattaatcacgtgctaatcgctgctccgttagttcacaaccctaagagcccaagtaccttttggaacgtatcaaactcattttaattccacaaatttcctgtgaattttaataactgtgtgcagaaaatcccgactgggtaccgagctcgaattcgccc

SEQ ID NO: 35530 - DNA, 16952 bp, Oryza sativa
  unsure (1)..(16952): unsure at all n locations
ccccccggcgcgcgaccaccaccactagtactacagtactactatattagctagtagtctactactatagtactataactactacttatactactattactagtactactactagtatactactataaaaaaatatataattttatatgtatattttttatgtataaaaaaatacacacatacaaactttatatatgatgtgtacaaactttgtatacaacgtgtataaactttatatatgatatatacagactttatataacgtgtacaaactttgtatacgtacatattaaaaaaatcaaaaaaactaaaaaaaacatcacgtatattcgtatacacatatacaaactttatgtacacgtatacaaactttgtatacctgtgtataaactttatatatgtgtatacaaactttgtatacgtacatataaaaataaaaaaatacacgtatataaagtttatatacatgcatataaactttatgtacacgtatacaaactttatatacacgtatataaactttataaaaaccgaaaaaaactgaaaacgataaaaaagaaaaagaaaccaaaagaaaccaaaaatacggaagaaaacaaaaaacgaaaacaaagaaaaagaaaccaaaaatacggaagaaaacagaaaaaacgaaaaccaagaaaccgtacacgcgctggaagaaaacagaaaaaaacaaaaaaaaaagagtaccgtacacgcgccgtccgccgctccgcgcgacttgtcgcggattagcgttttcgtaagatgtgacggtggttctcgtttcacaaacgggccaaaatctctagttagaagcttccaatcgttgggcctgcaaagtgaagaaaaatgaagtggccgaagaatttcagcccatgataagcaggcctaatttcaaacagcaaagaaggggtgatatgactttgggcttcacatctcaactccagataggccttgccgcctgggccgagctgtatgcatgcatgttgatgacataagcatgacctactaagcacaaggcacgtactccctctgtttcaaaatagagaaattgtataatcctttaaaaattatctcgagatacctatattttatattttttttacctcaaagtacatagtagctgtagtacctggatgcatcaaattttacattagaaagtatgatacttcctgacacattctcaatgatagtaaaattgtccttcaaaataaatcaatcatgatggtaatgggataaaacttaatacagcaaatctggatagattgatttgtttagaacgggagtataaaaccttccaaaaacaaaagtaaacatgtgaaaaaaaataaaaaaaatgagtgataggaaagtcagatgcagtaggtcaacggcccaaaggccaaggccaacggatccattccacaacttacggtgtgttttttttttttcaaaaagtgatgaacaaactaatcctacccactaatcacacacatcagcatctcagctccatctaatcacatcacgtggcagccacaaccgaccgtgatcatctacttactccccaccgttgacattccagcgaagatcattcattacacacttactccgaggatctgacaggtggggcccactgcgtgttcacagacagctagaccagctaagcgccaggtggcgacagatgagtggtcaacgtacggtgtggtttcgtggctagcggagctgatgattgtaccgatacctctgagctggtgtcgtctactctcccaaacgagaaatggtttgtttagagtacaaggtacaaactctttagttagagcattgcattcacatatcatttgccaaagttaaacctaggacaaactagtgtcatgaggttttggacagagaatttatagaaggagaataatcttgggtgtgtttagtttctgaaaaaagttggaagtttgaagaaagttaggagtttggaaaaaaagttggaattttatgtgtgtaggaaagtttttgttgtgatatgatgtgatggaaagttgagaatatggggaaaactaaacaatgcccttatcaaatacgctcgatccacacaccaacaaagtgtattaaaaaagaaaacatgttacctgctgaaatatatcctgcacgagatcgacatagtatttgcaaagtaaagcatatgataagttagcatgaatgtcgtcctaggtatcccaaacggtatatttcattttccattgatgaaacaatgtgtggtaaattttgtggtgaaattctcttttttttcacacttcaatactaaggatctattcggtttgtaggattttcatagaaattttggaggaattaaactgttttctctgaaaatcctataaaattcccgtattccgaagaagccctaagttgagttatgagtttttttttatgcaacaagtttctaaaaagagcataatcccattgaatacgccaaatcgatacggctttaacggaatgttatcaacaaaacacatgttaccgctcaaatatattatccgttgatttcaaacggatggtttagatagaaataatgtcacgtagtgacattgctacgtcaagccagaggatacgaatccatccatgagagcacgaagaaagatacacacattatccgatggagtagctttaacaaacgggcataaacaataactctctctcacacacacgcgtacccattactagcttttttttttttccgtgcacacggaaagcctccttgatttggagcaacaaagaatccgggctaaccttttgggcaaagctagctaccagctcgtgtgggaagcttcggctagtggttcacctagtgcaaaatgcaatgcaaattgcaaccacactggccatataattccagggtccagattccttgcattgcattgagcctctctatctttaatttcttaatcaaaaaacggtttaggagataatgatggtgttgctccactttggaccccgaccaacactcaccaacgtccaggatcttagagacaccatcatcctgcagcccaccaccagaattgttctccggcttgaaaacactagtgctacgttgaaactttgcatgattcctctcctttttgagtatgctatatatgccgtttctttcatgaataagacctagtgttgtcgctatcatttgtttgttccatatatgttctcttcttgcttgtattagtagccatgttgtggagttaatttggctaacggctcatatcccatccataaacgacacattcatcaaattcaacttttcatggttcttcctttgaactgtcgtatatactcacgcatatgtagatgcacttcaacattatccttgttaggttactctatccttgatcttaattgccttgtgttgggttttgtcgcggtagcttaagttagctatatattggtgtggtgttgcagttgtggtttttgctcactttctctaattaactgagcactaggttagtcccacttacctcttaaaatggggcaccttcttctttatataaaatatcagcaacgggtctgaccgttaaaaaaaatcttaattggttaagcatgattagcaacaaaaataatttatgcgtaaatctttaagatatgtgtacttagcaacttttaagaatcaactcaaatttaagtttcaaattttaatttttggctacggctagctggtctgactagggaatgtgctaattcatttttccacctccgaaatggacgcaagcaaacgaacccgttgaaaccagaaggaagcaaattaaatgcagtgcatctctctttcgccctcctgtcgctttcccactctggtaggccagccaaccacacaacattgcattagatctttctttcccctgatcaatcacttgcaaaacagaaagaacaaggacaaaaaataataagcaaaaaaaaaaataaaggcatgcaaatggcattgcttaagaacaattatttgtagccccactagaggcacaacttgtagtgctccttaaaccaatccagcaaagagggcaaccatcacacatcggcatgatcaccacattaactaaacaacaaatttttaggagattgggccctttttgtgtttactttctttctggtttttcttttgcttctgtcctactttgcatttgcagttttttgggactccttttgcgacatataattgggtcgacattggaaaaaacagaaggaattttttataaacataagattattttttttatagaatgaataactttgagtgatttgtaccaggatgcgctagctgcttgcatatccttactgatttgtgaaggttcacctatgtttttgcgtgagttgtagaaagagtgtcactacacttgagtgtatctcaaactaccgggtcaaattgcacatctcattttcttcagtctttaacaactttacatgcattgacatactagtaccttatactactcctatgtgctaatacggtcgcagggaaaaaaaatactcgaagtacagactgcatctgtattggtgtctaacggtctgtacccccccccccccaaaaaaaaaaaaaacaaatcccgaaacgcataatttgtacttcgaaaaaaagacaagaccttaccacaactgctgcacctaattcaaaccaaccaaacacattagaacaattcaaagtctcatacatcatcgttcatacctcttcctaactaaccagtctggcgaaaatcatttttttgttctagagtcaacaacaaatactattcactctgttagaacaatcatttaaccaaccaacataaaattgatgttattatatctacatttaaaagtatttgcttatgatcgtaatttgttactatataaacaaccaacatattagtagaacaattgtttatcaaaatcttatcctaataaatcgtcttactccatcctaagattattatgtccagattcgtagtctacaatttttatgcggagggatgagtagagtactactgctcagggttcgacttaccgccggtaaccgcgcggttaccgggcttaccgcgagggtacggtaatataaatactgcggtaacctccttaaattcaaataaatttaaaaaataaattaaaattttgataaattttgcatggttttgtacggtttttcacggttaccgcggtaaccgttgggaaaccctgctactgctccagttagtaacaaaagcaaacaagagcaacaagtctctaaggtaaactccaaagccaaacctagagcaatttaaaataaaacctagggttaagatgaacaatgatttaattaattaattaatggccttgttattggatgctcatttctttctcctaccacctatcaaaaagcaaaggcttccccctccccccaccaacgaataccctcacccctctctctctctctctcgccccacccggatgcctcgcgctgccggaggctgacctcgccgccggcgactccgctcggccgccggagcagccagcgcgcgcgggtaagtcgactctcccccctccgctacgtgctgtcggacgttttgtcgggcggttttggttttggcttctgcgtcgagcagcaagggtgggtgggtgctcgatctgcgcgggctcgagtcgcggggagacttgctcgtggggagcgctctctcaccggaggaggaggaggaggaggaggggttcctcctccggtgcggcggccgcgtggtctgcgggttctctccctggtgggaattttgaatttcgcggcgctccccccatctcctgaatccacgcggttttattcgttttgtttttttttccggggaatgatctcggtggggatttgtatggaaaagcccgcgattttggggtttcgagagcgctaaaaagctttggattttctctgctcggtttgtgttcgtgcccagattcagtggccgaagaagcaaggatgatgcactgaggtgggggggggggggggggagtcggtgagagatttcagcggagaatctcgtctgattccagcgtgtgggacctccgggcgatggccgccgctggcggcggcggcgacgccaagtacaactcgtacaaggcggcggggctacgcggcgccatactggaggcggcgcacgtgtcgtgcctcgaggatcgctacgcgctggggccccagctcgggtggggccagttcggcgtgatccggtcgtgctccgacatggtcaccggcgaggcgctcgcctgcaagtccatcgccaaggaccgcctcgtgtcccccgacgacgtgaggggggtcaagctcgagatcgaggtcatggcgcgcctctcgggccaccccaacgtcgttgacctcaaggccgtgtacgaggacgaggcgtccgtgcacctggtcatggagctctgcgccggcggggagctcttccaccgcctcgaggagcgcggctgcttctccgagcacgaggccgccgcgctcttccgctacctcatggaggtcgtggcgcattgccatagcaaggggatcgtgcaccgggacctcaagcccgagaacatcctccttgtcagcaaatcgccttcttcgccgatcaagctcgccgatttcggcctcgcaacctacatccagcctggtataattgggaattcttgagcaatttcgtggctgctctctgtcaaggctggtgtttcgaagctgaattgggtttcggttttgtcaggtcggagcttgagtggcatggtgggtagtccattttacattgcgcccgaggtgctcgccggtgggtacaatgaggctgccgatgtatggagcgcgggtgtgatactttacatcctcctgagtggcatccccccattttgggggaaaaccaaatcaaagattttcgaatgtatcaggtcgactgagctgcggtttccttctgatccctgggacaaggtttccgattcagcgaaggagctaataaccgagatgctgcggcgcgatcctcgacagaggctcacagccaagcaggtcctaggtgagacacggcctcaatcttttcagaaaccacacactttcaatttcctgtccttgttctacatcactagcatcatattgagaacttggaactgcctttttttttttaagatggaaaatgctcactgactattaatacatgcatgtaactggaattgtaaatcgaaattgatcaaaattttcctgatgaggttagccttgtttactttacatattgaataaattaacaaaacttggctgctaagtactgagttagtgccagcttaagttggtggtctaatttaaacttgcacggctgggggaaaaagctgggttgcatcacagtttgttgtagggtcatgttctggtagatccactgtggtacagatgaactttaaaatttcttggcacttcatcaccttttgtctattgtagccattcctttagttgtgctggttcattctgtcatccttcgtggaatcttttgtttggttgtcattgcatcattcccggaccttactgtacagatcagctgctaatgattcctttccccatttttttgtaatgcttgccatgtggagtaatctaaacaactgttgttacacagagcattcctggatacaagatcatgccgaccaatcccaagattcttgtggacattgccatgagatcaatctcagaggagaggacgccggctcatgttcgttctcgacgccgctggcgtcatgcagccgcgatgtgagcttcaacaccggtggcccggtcgcctgccaaagcatgtctgaagaagcgtgctcccccacattcgcctgcagatcatcgttctctgcatttgtcgctgagaatgctccgtcgtgcgcgctctcggggttctccttcggtggcgtctgcgaaccctgcaacgccgtgttcccgtccccggtcgcttccatgccgagcttctccttcttctgcggccaagaacccggcgagcctgagtcgtcgcctgatggtgacgccttgggcgagaaagctcactgcgacgcgacggtggtggccctcgtctcgtcctcggctccgaggacagcggaggtcctgagggccgccgtaagggcgaacccgtcgcgcgccatcggcatgaacagcaggaggaaccacaccatcggcgccggcgagcgcgagcacctggatgtggcggtcgccgagtcggtgatacggtgggcgtcctgcaccaacctgtcgacgacgcactcgctccgggcttcgctggtgtgctagcattttgtttatctgtgcaattcaccatgtgtcctgtggctgtgagagtgcttcgctagtctcttgccttcctccttgcacctgcgatgcaagctgaaagataagagtgagatgagtgatgagatgagatgagagtgtgagtggtagaatgtaacgtggacctgatgatatataatgctatagtagattaccgagtagtgtgcttgctttctgtttgttgaatgtgttccttatttttggtctcctttgtgcacttgtcactacttatcactaataccatccatcaacatcagcttggtgccatgctctctcttgaatgcttgcagacaaacttaaaccgaagttgacccccatgtaattagctcaagaaacatttcaaatacctcattatgaaaagatgatcgaataatatagtgattattggatagagatgacgtatttgctactataaagcaaagaaaaaatatggctcaagagatgatatatttggatcaagtgattaccaatttatgatcaagtcccctcttccagtcttccagtatctacaaatttgtgatcctatgggcctttgggcctggtcgctgacccagcccacggcccagccaagtcgtcgtcttcctcgatgccgctccaccgcttcttccacttcgcccgcgccggcgccgcccgtcgaacaccatggctgccgccgccgccgcagcagcagtacccggcgacgccaagctagactccttcctccaatggctccaggttgctcctcgtccctcctgcacatccccttctactcgcgtgcacgccaaatccctaaacccctggctcctctccgcaggccaacggcgccgacctccgcggctgcacgatccgccgctgcggccgcgagggctacggcgtcttctccaccgccgccgaggccggcgccaccgacggtaacatttgctattccacctcttctctcggaggttttaggagctcgtcctccgcgctgactcgcgcgttggctgtgtctcgttgcagaggtggtgatggtggtgccgctcgatctcgccatcactccgatgcgggtgctgcaggacccgctcgtcgggccgcggtgccgcgcgctcttcgaggaaggtggcgtcgacgaccgcctcctcgtcatgctcttcctcatggtcgagcgactccgccctagctccctctggaagccgtatggtcgcaatccacatctctccatgttaaacaacttgatcagtgattgaattttggtaatttctctaggtatttggatatgcttccaagcaccttcggaagctccatttggttcaccgaagatgagcttgctgagttggaagggaccacacttcaccgggcaaccgtgatgcaggttcatcagtagtgcaaaccttttctttcagttccttggggatattttggggagccaagagcaaattcgtttaaacgaacatgctgcaattttgtttcagaggaagtcattgcaaaccttattcgataataaggttaaaggtctggttggggagctcttaaacgtcgatgaatcaggaaggtttgtactgatttcgcatcattttccagcgctgctgcaactttatcactatatttctgtatcaagcacacatgcatagtttcttttacattttagtatacacttctgtactggggttctgcgatacatggggattgcaccccaaagtatgatatgaagaatagcttctcatataaagtgatttggggtaacgcatgttccatatcttcatgtgtatgagtgcaccatttgttgtcatctgggatagcgcctatgtttttatttaattttatagaaatgagaatcaccaagatggcaatgctgcactatgagataaattgctacttttattttacagaacatttatgaattttgttgacatggcataggtttaacttataaatacgttagaaatcattttaatgcactgtatactgggctttgtgtacctttgaaatattttgatctgaatattcttttcagccaaccctattaaatgaatattttcttgtgaaggcttctagtgctaagtagagtgtatccagcatgatttttgtttattgattctgtgcgtacttaaaacccatgaatccacaagcaatatcactcaaatattgttctgttatacatctgtatgcccacctaccgagtttgtgatttttactgtctagtatggcaatgatataccaatatggctaattctcatgactccctatcatatgtttactgacaaagaaattcgttttatttaacagtaatactatcaaaatattgtttgcagctcaattgaagtgcggttcgaagacttcctttggtatgtataattatgctttgcatttgcagtgataatgtcatattataaggcttacatttttttggggggaataatataagccttactgatactgtagtttcatagtattgacatggcatatcatgttaatttcgtgtgcaaaagattcagtgtgctaatttttttttggacaaattaggcattagtttacaaaatggtggggatgtttttgtacctagcatcaactaacctttgctactattacaattttcaagccatcaaggtggaaattagctcattcataagaaaattgtacttaattgggtgatggctttgatttgcagctccttcaataaatatcttggaacaacagttttatgtcaacaaatgaaaaatgcaatatacacatatgatgcagggtccttcacatagttgctggttcagttccctgctttctttgttttatgtaactcagcagcacgactctatggcagggcaaactcaatattctggactcgagcattgaatataccattgcctcgtttttatgtttttccggaatcactagacgaaaagcgggccaacattggtgatgattgtggtgattctagtctcagtgcccctcaggttaattgcattttttctgaccgcagatcctagcttcagaggttcttctcaattgttttatttacttattgtgtgtggcttaattttttcccctcgattatatgtggtcatttaggtttcttttttgctcatgtacaacctatctgaaaagtgaaaaagaggttaaacattggttacatgactttttcttgtcatgaaagagtagcataggaccttgaatggaattttgttgtcaagagagaggaacatcgcataggacctttcttggccctgaaaatttttcataccaacagagaaattctgttactgaaggcatatagtggtctcaaggtatgtgccacaaaaaaaaaaaaagaaactgaatgggggcaagaatatgtttctgttgaacaaactagttgcataactggatattataacacggaaacagggaaatgacttttatattataagttgtggttttgttaattacagcagtaatctacaattatcttaaacaaaatatacttgtgacatgctacaatttgtcctcaaggaaacgccatatacttttgaggactcatcatatactttgccaatctcgtgaatatagatccaacttatctgacaaatcattgtttataattatgccaaattgtatttgtttttaacatctcaatacttcaattaatttgttcacccatatcttcttgttccaaattttaacatgctaactgtttgtttccagggaactgggactgccattacagctaagaatatcagtggcaatgataatcctaaatcaagtaatacagagtcaatttgggttgagggccttgtccctggaatcgacttttgtaatcatagtaagagttctaataaaagtttatgaattatgtagtatagacgaaatatctagttggcagatcattctatattcaacttttgacaaaaaaaaaactgtaggcgaatttgcaaggatttacataaaaaaaattgttgtactgaaaataaatactcattgaaaaaacatgttattttcagtcttacataggtatatcatatttttcagatgtaaaggcgctggcaacatgggaagttgattccatgggacatgttactggatgtccttcttcaatgtaccttgtactaggtacataagtagctccagtttccttttgataagagaacctcatgatctttcctttaatcaaatattttgatataagattatagttccaatttatgactgtttatttttgtatctccctctagctgataaaagctttgtgaaggctgaaacagagatctgcataaattatggcaacaaaggaaatgaggtattactcacatagttacatatgtgcagatctagtctgactagtttataagcaagtgtgttatttttctcaagttgttgctcttagttttatcgtacttgttattgtgtgacttggattgatgtcactgtttcatattttcgtgtatactcattctgacttctctgtcacgatttctctatatactgatacgggcattattgatatatagccaaaatagaactacccacaagaagattcttttgatttgtgcatttagatattggttgcacttcagacaaacaatccaggaaagcttcattagtgccgtcaccctggccattctttttttttaaaaaaaaaagaaaagaagaggaaggacatatgacggtgatgaacttcttggagctctatggccccctttgtttcatcactgggcctggtttgatttgatttcttcatggattcacatatcctttagttccttatggatttgcattaaacacacttgctaatgttctgaagtataaaataatcttactttggggcttctaactgatagatgactttgagactcaatagtcaacgaaaagaagctgcagcgctgcagtcttttgttccgagaaactacaaaatgattaaatgtcatcaaatattcataccgtttatgattactgaaatatagttgctgatgaaatgacatagttttgtttacttgcaggaactactatacctctatggatttgtaattgacaacaatcctgacgattatctcatggtaacactcagtaagagattacttttagcaacaggtgtttgtcaactcagttttctttgtttagcatattccctgccagatattctctttctgtcaaacattatagtggcaaagcacttgtctgtcttgaaacattgtaggtagccattacttaattgttctccagctaaatattgtaagtgtaactctatcggtgttctgggatacataaaggaccaaacttttagttaacattttaaaagataagaaaaccattattcactgagaatatctcctttcttttagttcaaattatgaaatcgtatgtacccaccctttttcattatcaaagttgctgattgtttgaagtgctccacatgttcatagtgataagatggcttatacttgatatttcctccgtttggcgtacttccttaagaaagtagctacttgtttgaaataaaaactagagctaacaaacgttccaaatgcagattcattatccagtagaagctcttcgacaggttcaatctgctgatattaagatgaagctactggagatacaggtagcaacatttcttagctctagtttttatttacgatatgaagaatgttgtgaaaaatttaggcccaacaagtatccttggacatcacgggtctcactttccatatcttctgtgtttacagaatgccgaattgcgatgtcttttacctcgtagtttgcttgaaaatggattttttggtagctgttctggtgaaaacaaggagaacaaaaataatacaagtcctttttctagttatagctggagtggtcaacgcaaggttccatcatatatcgagaaaattgttttctctcaggaatttataagtaccctgcgtacaattgctctgcaagaacatgagcttgagcataccgcttcattgcttggagaggttagtgtttttcacactctgtaccatgtgttcaaaggcatcagttgcatatgtgacattgccttgccctgtcctttttttttttcctttttcctttgggacattttagtaccccaaattttacatgacattgttcgtaaccatctaatctgttgagaagtggttaatatctttttcataaaggggactaatgcctggggatactggttaataagatattaaccacttctcaacagaccatagagttgtcttattaaccagtatcctcctgtacttgtactgtaagctggcaaacagtatttatgaaaattagcgcatttgctttcaaactaaaatattatccatgagtccaaaattttatcacacatggtactaattttggcagcatcatcaatcataatttcttggtgatataaaaaaggttgttttactcatctaaaaggattaagaaagcttctcaagaagcatttaggctatctagtttcacattttctgatatgaccttaatattcacatattatttattttccctagttttcagcattattctgtatgagcatatttatttcatggtaaattgattgtagaaatcctttgaatctgttcgtgtagattggatctaatgaagatagagatgatgagctccggagtgctatatgggaggtcagtggtgataatggagcactgagtttgcttgtggatcttcttagagtcaagtaacacacccacaacttgagaaattcgatgtcagtgtacctgtattttttctatggcgttgtcaataatttattgatcaagcccttctcttttgcaagaatgactgaacttgaagagggcactggaactgaagcatctgacagccaactacttgagaaattcgatctcagtgattcagaagacgcaacgaggtagggacgtagggccttttgacgttgcttaatggatacttttttctgcatattagcactatcatgcttgacatttccatctgtacacctcttgtttttgtgtttcaccattactctcattgtctttttcacagaagtgacgagagcaacgagaccaagtcaaaagtaaatattaggacgtgcatagtgtaccgcagaggccaaaagcagctgacaaagttgttcttgagggaggcagaacatcttctggagctgtcgtcaaaagaagagaactaaagaaagcaaggaatgaaggatctcatcgggtgcgcatttccctttcatgctctctaaattacagccgttagccatagccaatagttatgctaccaattcagctgttttcttctgtagtagtagcgtaacccttttcagtgattttactgaaaagaaaaggcgtgtgttactgtagccattatttcttggttttcagaagctaattcaattaagaaacagaaaattgctactactaataaaatgcttcatgtcttctgatgaactaattcagaatgtatggctgtacattgaagtacaaagcatagactttcagaggtgaacctcactataaaatactactacctccgtttttcaatagatgacgccgttgactttttttcacatgtttgaccattcgtcttatttaaaaattttatgcaaatgtataagatataaatcacacttaaagtactataagtgataaaacaactcataacaaaataaattataattacataaatttttttgaataagatgaatggtcaaatatgtgagaaaaagtcaacggcgtcatatattaaaaaacggagggagtactaaggttgtgtttagttcccttcaaactttcaacttttcggtcacatcaaatgtttggacacatgcatggagcattaaatatggacgaaaaaaacaattgcacagtttgcatgtaaattgcgagacaaatcttttgagcctaattacgccatgatttaataatgtggtgctacattaaacatttgctaatgacggattaattaggtttagtagattcgtctcgtagtttacatgcggaatctgtaatttgttttgttattagtttacatttaatacttcaaatgtgtgtctgtatacgccaacgtttttttgccaaaacaactaagggtgtgtttgcaagagcaagttctcaacactcccctctcgttttccgcgtgcacgcttttcaaactgctaaacggtgcgttttttttttgcaaaaagtttatatacaaaagttacttaaaaaatcatattgatctattttttaaaaaaaggctaatggttaataatcacgcgttaatgggccgctccgttttccgtgtatgggaatgggttcccagcacccacctccaaacacagcgtaagtccttttctcttaataactatgctgctgaagactaaaatttcgctactaactctattctaaactataataatctctgttttaaaatatactaacctattagggcagtcccaacccatagtgtccataagcggtatctatggtgttatgtcaataagacatcacaatagaaactacactctacaacctatggtttcttaaagtgggccattaataaatacatcatctctcttctctaccaaccatattaattcttcatctattatgaagacaatattctcttccaatacaaaaaacttgatagtgtctggtacataggttctcgtgttgaagctgtgtcttgcatgagacccagtttcttcctctcttcactctctctcttaattaatatagtgccacataagctaaaagtcccacatgtcaatgtagttaatgtcatagacatcatnnnnnnnnnnnnnnnnnnnnnnnnnnnnnnnnnnnnnnnn

SEQ ID NO: 35531 - DNA, 3134 bp, Oryza sativa
  unsure (1)..(3134): unsure at all n locations
gtttatatacaaaagttacttaaaaaatcatattgatctattttttaaaaaaaggctaatggttaataatcacgcgttaatgggccgctccgttttccgtgtatgggaatgggttcccagcacccacctccaaacacagcgtaagtccttttctcttaataactatgctgctgaagactaaaatttcgctactaactctattctaaactataataatctctgttttaaaatatactaacctattagggcagtcccaacccatagtgtccataagcggtatctatggtgttatgtcaataagacatcacaatagaaactacactctacaacctatggtttcttaaagtgggccattaataaatacatcatctctcttctctaccaaccatattaattcttcatctattatgaagacaatattctcttccaatacaaaaaacttgatagtgtctggtacataggttctcgtgttgaagctgtgtcttgcatgagacccagtttcttcctctcttcactctctctcttaattaatatagtgccacataagctaaaagtcccacatgtcaatgtagttaatgtcatagacatcatcctaggtggagggttgggactgcccttacagacacatcatttgtcccttgtatgccttgtttaaattcatagtgctaatactgggttgtttgagacggattgaaaataccactgttaagagtattctccggagtgacgtggcaaagttgacatggtcgctgccatttggccgtgacggtgactcaacatgagcgctagctggctggctggaccatatccgtatccagccgtccagcgacgtgcacaagattcacagaatcctactcctcctaactagctagcgccagcgccgacccccctaagaccttaacctttactctactgtctaatctattacaattaggattaccacctaaacaacaattctggtgtcaatcgtgcagagttgcttcctgcttcgtgacatcttgtcgtcgtcgtccgctgcgccgcccgcggaaacgcgtcttaattcagcgatcgattagggccggtgtgtgtgtgcgtgtgtgaccactaatctaatcgatggattacctactataattgataattaattagaccgtgcaatcatccgtcgtcacatgatgtaatcactcgcacggctccccgtaatgagtatcttaagctctcggcaacatgtgccctttactattagggttacattagtactcagcacgtgccattgccgagtactcgatcgtatgcacggacgtatatatacagccatatatataagcacggacgtatagatacgaggtgtttttgcaaagtactcgtatgatactagtacgaggaaaatatcatatacagtatatagtacttattctcgtaggcgtaggcatcgaaccaccatcaatctggtgcaactatctctgcttctccagctagtgcgaactgatccgaagcttaaaaaaaaggacgaagtgaccttcccaacgtcctgaatttaaatatatatagaagcgaattttagattgggttatttaagaaataagttttctgattgataggctaatttgctaatttaaaaaggttgcatatatgaggccgagtaaaaacacccttatctcaaaaaataaaaaaaaaggacgaagttttgatccagtaataactgagctgcgaactacagtttctaactaattgtagaccgatgatagcatgataaacaagtgctcaatctcacttaaaataaagtgaaaccaaattctagtacttacaagtactgctaaattttgtctgccaatagcatatatggtacacccattttcttaattattcttttataggatgatgaatgatctcatttattcagataagcagtagcactcactaatttatctggagctttcatttgtcttaacactccaaaaaaaagtgaaaatctgaccataagcagagctggcattttattccactccacacaaaagagagagagagagagagagagcatagcaattatacttcttttttgcatgctgtccctcgtagtagtattacaaatctcgtaatctttatttcctccttctagaactccctaccagctcagccattttatcttggaaaaaatataaaaaaaataaagaaggaaaaaatctccattaatttctcctacagtatttagctgtataggaggagcaaagctggttgagctcaaaactgctagctccaactcgcgatcatcagtagctccagagtgtgacgtcgccgccggcgtagccgccggcgacaccatcgtcgtcgccgtccatctgccagctatggtactcgccgcggccgccatccccgtcgtagtagtagaacggctggtcaaagtccatgttgccgtagtacgcgtagtcgtagctggacggcgtcgccgccatgtcgtcctggtactgcatcatcatgcgggcncgncgncgncgaaggcctcnacgncgncggcggagctgaagncgncggcggcgncggcgtcgtgcgggcatgactcggcgagctcgatggcggcgcggcggatgtcgtcgggggtggcgagggtggccgggtcgacgcggaggaggcgggccgagtcggcgaagttgaggcacgcgccgcggccgcggagggcgagcgcggcgacgtcgtgggcgcgcgcggcggcctcggcggtggcgaaggtgccgagccagatgcgggacttcttgttgggctccctgacctcgcacacccaccgccccgcgggcccccgccgccgcacgccgcggtacaccgggtgcctcgtctccctgaacttggtcctccccgccggccgcttcggcggcgccgacgtcaccgtcgcgtactcctcctgctcgtagtactccatgtcagtagtgtgtgttgctgctgctggaagaagaagaagaggaagaaggtgttggtgtttgagtttgagcgggaaggggatggagaggaagaagtttatataggatttggtgtgtgaattttgatttatttatagaaaaggaaaagaaaaggagatttggaggagggccggcgcgcacgtggcgggagaggggagggcggcgagagctgagctggaattggctggagatgtcggaggg

SEQ ID NO: 35532 - DNA, 5023 bp, Oryza sativa
  unsure (1)..(5023): unsure at all n locations
nnnnnnnnnnnnnnnnnnnnnnnnnnnnnnnnnnnnnnnnnnnnnnnnnnnnnnnnnnnnnnnnnnaaactggtgaggtgacagcgttaagcaatagtatatgggggtggccacgtggagatggcgacaaaggcaagcttttgggcggcggctgaccacttctgtgtgtgtatgagatgcggatatttctaccccttcgttccgtatttatgagttacttcctctgttttataatgtaagtctttctagtattgtccatattcatatagatgttaatgaatctagatatatatgtgtgtctagattcattaacacatatatgaatataaccaatgtttgaagtcttacattatgaaacggagggagtactagaaaaaatatcgtgcgttgcaacgggtgaaatctattttaattatatagtttagttaagataaaattcactgtgggagttcacttggatatatatatttttagaaaatcatgagctaaagtttggaatccgatcgtctcaatttagcatgtgagttattttaaacagatttcttatatgattccttttgtatcatacaaaagtgaacgatcttacaaaccaactcaaatacggatatatattttcaaaagcaaacaaacttaaaaaccgactcatacacagatgatgtactagaataccggcaaaaacatcttcaattttataatagtagagatttttttaagtcaaactttaagcaaaatatagtaatgttttttaatataaaataaacattatattaaaatatatacaatgttaaatttaatgaaatttgatgttgtacatgtttctttttttctatatatttgatcaaacctaataaattttgactaagaaaaatatcaaacgatttataatataaaacggaaggagcactattttctatttttttttaaaaaaaagaaaaactattttccatttcctcccaatggagacgtggagtgtgcggctgcagtgctacagtacttatgccttcttccttaattggcaagtggcaactgattgtctctataattaattaattgattaatgtttatttaatccagccgcacgtgagggagtagctggttggtctctggcaagttcaatagtatagccaactaataactaccattcatctatagccaatataatagctcattcatataatagttacatattacactattaatatatggtcccatctgtcatacacactgtgtcttgaagtccgtgctacagctggctataaatctgtagcctgctaccattctctctccttatttatttttttaaaatatgtttgtagctggtttgtagcctgctatgctatggtacctgctctcaggcagcagcagtagcagaggcagacacaggcagtacggactacggagacggaggcagcgacggttgggttgggcggccgcggcgccgcccgcgcaaacgcgtcgcctctctacggagtaggagtagtggagtacgtgggccggtggccttgcgcttgcgccccggatcggagccgcgcggcgattcgccgatggattccttcccaagtcccaacgaacccatcaaacagcggtggatctctcgcggttttgggcataaaatcccatcgactcctttccactcgctgctgtgcctttttttgttttttttttttggtgattgacacgcgctcctacttcaaaccctagcacgtactactactgtacaagttctttcctgccacgtgaccatccagatgccaagggaagcggacaagcgggattttttttcccttttacctgttctagttaattttttttcttttaaagttttgagaaagtaattggcaagtgaggctttatatgggtagtgagattgtccacttacatccctacaagacaatatcttatggtctacgtgacacaatataccttgttgagtactaatcaactgaaaataattttacatggagatttttatactactattcttattaatgaattatacattgggctatattttattccagagcttcattttggaccatctattctagaaaatgtaacattccctagttttaaagtaaaaaccatgaattaagaggtgatctaaagtaaaactacgataacaaaaaaaaagatactcagatcaaggtgcaattcactcttaacacaatttaactaaagcaacaaattaactgaggatatatgcgggctactagcgaaaatatcaaagctgtttagtactggtattacttcttctagtatgatactgatgcagtactctcttcgtattttaatatataacgccgttaactttacaacgcttgaccattcgtcttattttatcatttattttattatgacttgatttatcttcaaatgtttttaaagcatgacataaatacttttatatttacacataaattttgaataagacgattgatcaaatgttaataaaaagtcgacggcatttttttgttcctagtaaataatatgaatagagtactactttaggtaaacacatactccctccatcccataatataagtgattttgactttttttacactgtttgaccactcttcttattcaaaaaatttgtgcaaatataaaaaataaaaaattatgcttaaagtactttggataataaagtaagatataaataaaataaataataatttcaaagtttcttgattaagacgaatggtcaaacaacataagaaaaaatcaaaatcaatattacggggcagagggagtacttaaacacatggagtgctgaaagtagtagtagtacgtggggcggtggccggtgtgcccacgcgccgccgctcgtcgctcctccggacggcctctccatttccttttgtgtttgtttctgctgacggcggcagcggcagctcacaggtgtacaacgccactgacacgtgtccgtggtccaggtgagacgccgtcgcctgccggtggccacgtggcgtatgctacggccgtcggtctctgacgactcttgttgtccttgtgattggttttgcgagagcaccagccaagcggtcgccgtatctgtcacgcccggaatttctatccaaaattccaaacgcttacatgtgtgtgaaccctcgtctaggaatcagccgaggcacacaataacaaattgataatagagtacaattattactttaattaataagcgaataaaatgtcattacagaggtagatagttcctctcaaacaataaagatctaagcagcggaaaaataagataaacggcgcagacggctccactccacaggcagcttgaccaaggttacacctaatcctccacaccatcagccttattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttaataaaacagttaagtattaaacaatattaatccaacgctatacaacataccttgttgtataggcccaaccattctgaacaaccatcccggctgcacagttctatctccaaaccaggaatgtaccattccaaaccaggagttaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcaccttcctgaatcataatcacccccttataaacaatgcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccgaaagtgtgctaatgtttctaagcatggctaagcaatcatacctaatatctagttgaaccaatatatataaagctcaactagtccaattataataacccaaggtatcaaggaataaagtaatcaagaacaaaagggctataacaaacaataggttaattccacccaatgacattcgaaaataaatgcaatagttgaatagaaaccatagctttaaatgggatcaacatgctcaaagggttgtttgggatctgtgtgacttgccttgctggccttggaactcttcaaactcttctccggtgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttaaattgattttaattgaattatgacgcaataataaattatttttgaaaaggaaaaagggatttattgcgtcagcgggctagggtttcggtggaccgggcgcacggcgacggttcacgcgaacggacggccgagatcgacttgatccaaaacggatggccgagatcgaacggtccacgaccggttcacgggagagggcgatgatggcgtcagcggtgacgtcaccaccggcggcggcggctcggcggctcgggcttgcatgctcgccggcgaacgacggcacggcggcgcgaacggaaggc

SEQ ID NO: 35533 - DNA, 694 bp, Oryza sativa
  unsure (1)..(694): unsure at all n locations
tatgttcagtctcaatccacattgaaaatttcaaagtgataattatatgtagtagaaaaatatggttctaatgaatgctcataattgaaaagaagtatgtgagaatataggcacctttatatattgtgagcgtgtaatgacagcttttgggcgccgaacaaatgagaatataagtcncaatggaaggcaagcaattccaacaccaccaaatatctaccaaacaggaataggaaagttgtaaaaagaaaccagcatgattgcagcagaattggatgttgaaaaggatccatatttcaaattgtttctagtacagcttacactcaataaaagacataaagctatcggtcacatgcagaccagtagagtgaatagatgtagctatacagaaacggtgataaagcaaaacatgaagattgaagtaaaactcactgtgaagagaacagatccaacgatggtagcaagagcaaccacatattcagggaaggtagcgcgcattgtccaagttgtttgagagttagcaggtgcagtgtaagctgcgcactgaataaaacaaaccgtaaagcagtttagtcgtagataaaatgccaaaagaaaggtgtcgatcaaatgttgctattggatggggagcacataacatcatnnnnnnnnnnnnnnnnnnnnnnnnnnnnnnnnnnnnnnnnnnnnnnnnnnnnnn

SEQ ID NO: 35534 - DNA, 1095 bp, Oryza sativa
  unsure (1)..(1095): unsure at all n locations
tnnnnnnnnnnnnnnnnnnnnnnnnnnnnnnnnnnnnnnnnnnnnnnnnnnnnnnnnnnnnnnaacagcagtggtgaagcaacaacctcgagaaattcagaaatcgaccaacagattgagtatgacttggtgttcgctaggcagctgcaggcaatggataatctgacaattgagacacctgcagatgaagatgatggtatgcattcattctcgttcagtttttgtaagcacttgatgtgcataatgattttcagtcgtggcaatcttaatcttttcacctctgaaattttgttgcccatgttggtttgattcagatataagctgcgtaccctctccatctgactctgaaaccgatgaaccggcagaaggcaacaacgaagaggtgattatatgagctgtttcagaattgcaattattcagcattgttcgtttcagacttcttgatgcaaagatacacaattgcgtattcactaaaaagatgagctgtttcagaataaagcctttccaaatggataatgtataaacatgtactacgaaaagttgagattcctatcatttgtttgcaggctgccacacaggatgataacgatgatccagacaacatgacatacgaggttagtgttatattcacttgtatcacatttcttctgtaaaagaggtttacaccatctatgaaaaagttgctgattcttattctttctgtaatccagcaaaggcaggcacttgtggaatctgtaggaaatgagaacagaggtttatctgatctgcttatctcctacttggagacatggaagtacaaatcaggctttttcccaaggaaggcaaaccatgataagtatgtctaccatttcagttttcaatcaatcacatactgatttcttgcagaagataatccaagcatgtaactgatgacactctgattaaaatcttcatcatggcatgcaactgatgatttcctcctcttttttctcccaaaattgcagctgtcctatatgtctatccgctttcagacgccgagaaacactcattacattggcttgnnnnnnnnnnnnnnnnnnnnnnnnnnnnnnnnnnnnnnnnnnnnnnnnnnnnnnn

SEQ ID NO: 35535 - DNA, 560 bp, Oryza sativa
ccgtgcgtctcattcgcatgggtgttcatttctgttttgacacccatggctttgaggttagtctggtcattaggaaggccagcagctgccattagttgctttggctcgtgcatgttttgtactggaagttttgctgcagtttgcttgggatagctcttcagaccctctgcagatgaacagggaaaacattaaacatttcaaagcataaaaaaattgctgaattttacagggaaaaagggggaaaaacagctgcttcgctgttatcactgtattatctaaattggtatgctgttataatctagtatccagcaacaataataataatttaccaggtaatccttccatacggcaaccacacaccaccatagctagttcaaaaaccatgtttaccaagtgatatcataacaacaagtatatgatgttggatttggtttgccatggatatgcttttactatctagccctgtaagcattttccccaaacaatagaatatctctcaacacttcagaccaaaagaacttctaggcttatgcttattaccattttcatgcaaaacattg

SEQ ID NO: 35536 - DNA, 747 bp, Oryza sativa
  unsure (1)..(747): unsure at all n locations
gcttgatctctcatttcatcagacatccaagctgaatcacaaagaaggaaaagaaagaaaattcattcattagagctaataagtttgttgtaataatcgccaaataggcaaagcaactcgcaagttttcttcttctttttacctaaaacaaaacagctcggactctgatggcttgatgcaacacctaaatgtggcacagcaataaagtatttagatgcacaccaacccctgcactattcatttctgaaaggaatcaagcctgacagataggcgccaactaactcaagaacacagacaacaccaacaccaacaacaacaaggagaagaaagaaacaatttttttaatcataacaactaacaggaaataataataaaaagatttaagaattcatcatccacagtccaagtccatggcctctccccttatcaagaacggtatgtattggtatctgtatccatatgggtacaacattttctttgccttttcttcaaacgccaattggagaacaataataaccctttttgacttattcccaatctgaatacacttcaatttctctcttcccccctaatttcctctctctctctctctctctctctctttctcagaatatatgcacacaaaagaatatcaaacatttgatggtgaagaagaagaagaaagaaagaaagaaagaaaaaacaaaattaaannnnnnnnnnnnnnnnnnnnnnnnnnnnnnnnnnnnnnnnnnnnnnnnnnnnnnn

SEQ ID NO: 35537 - DNA, 379 bp, Oryza sativa
tccatcattttaggatgttctactagggttcttgatttttcttttggtttgttgttttgacgaatggaggtattgttgggattcgccgcctgctgctcgtcgtcgtcgtcgccgatgaggaggccgtgcgggctctgccccggcatgtccgatcgttcgtaatttgttttttctacatgttttagggcccatttgttcttgatcctattctttgattcttttgtactaagcattctaaggcgaagccacccattctttcctgcatatatacttacaaacacatagcccccatctgatctcacaaacattatttctctctctttttttctcagttttttctttgttaatttactgcccgaattctttgaaagaacaacaa

SEQ ID NO: 35538 - DNA, 1490 bp, Oryza sativa
gggtgaggatttcttgcttgaatagtcttgtgttcttagtagtcacactaattcagagcatttacatgaaatttggttgccatgacttcacttggcacttggcaggtgaaaagcaaacttgttttagcgtagaattagcagaccatatagccaactataacagttcaagagccatccacatttttttatgttgaagctagaaactgatttcgtgtgtttagatggcaggggtcaaaccagatggtattacttttgttggggtcatcttggcttgtacccatggaggtttggtgaatgaaggcaagctattctttgactcgatggaagcagagtttagtctgaaaccgagaattgagcactatggctgcatggttgaccttctcgggcgtgctggtctcctgattgaatcatacagtctgattgcgagcatgccagtggagcctgacgctgtcatctggggggccttgcttggtgcttgcagcttccatggcaatgtagaactagcagaattagcaatggacaagctcatccaccttgagccacaaaacacggcaaacctagtgatcctttcaaacatatatgcgtcatctggcaaatgggatggtgttgcccaagtatggaagttactaaaggagaaagaccacaagaaatcagctgggtacagcttcattgagttagatggtacgatgcataagttccttgttgaggataagtcacatccaagatttgaggaagtatacaatacccttaatagtgtcacaatgaccatgaagctggttggcttggaaaacctggaagaattgaaaggctaggttctctgtcagtctttggtgtagcctgtaagacaccaagcaatgggaataaaacgtgaccaagtagtacaagatttcttgtgaactatttgtctgatctttcatgttgaattggcatgcaaagggatgcaccaaggagacaatcagacaaaagacataatggcctggatgttgagtctctagcacatatttcaatataacaaaatggttctctgttgtgcttgttattcattggtataagactactaggcatattgcagctaaagcatgtcaatggcagatataccacaaggtaaatctcttcttattaatagtgaaatttagaactgacaatactgctttagtgattttccttatgttttattgcatggcatgaatcgtccaattccaatggttgtgtatttggtgccctatattatgcttcagacatgtgatggttatttcaaaaaccttaacttgtgattttaaattttctttgcatgcttgttgacttgctgtggttgagatcatgtttttttttatgcctgctattatatgtttgaaccatggaactgcaataaccctgacactatatacccaagaaaaactaggaacagtggccttaaccttttttttttttgggaaggttctctggagtattttagtcatattagttactccctccatttcacaatgtaa

SEQ ID NO: 35539 - DNA, 1953 bp, Oryza sativa
tttttagaaaatgacttgatgctagaaaagtagtctgatatgctgttcttactaactggaaggcattatataggcattacagttacagaaaacatgataaagcttttttgtatagaagctccccagtttcatggaaatggttatttagaattctcaggctatagaacttggtgcttatgattgttcagaatctcagatgtatgatgaggaacagatgttaatatccttgtggccacagtgctctcatggctcccctttgccatcattttcaccagtgacctggaaatcgctcgtctcggctgtgcgcaggggcaaataacagacatcagaagcctcctttagccctttgtgctctaactttatatttttgttgcacatgcttggaattagtgtggattacttggttctcttgttattataacatgaagtcatcaattggtgtgtgtgggacaatatgcagattttttttatgtgctcctcctgcgtgcatcaatctagatgctgaaagtgattacctgctaagttgtgatcataaaggcacaaagatgctgaaaagtaggatcagataggacacactccaagacatcggtctgcactcagatgggtccacagttgcgaaaaacacttccatttgggccaattacaaaattaggggcttagctaatagctattgaagaaaaagacactcaacatgacttggaagcactgatactggacaatgatgcagaagttctcatttccttgtttcttttactggaacaattcacagttgggtcattgctgagcatttgaacagatagagaattggttggttcaagaaatgtgtgcattgtacagcagattttcagtccactggggagaatgttgagcagacaaggcattagagctgtagtagtaccattttgttttcttcttgagagtggtccctttatttgcaccaacctttagttatttccttccaggtttttgtatcctggacattgctctcccttcgcttccttctacagtgtttggaagagtccctagccttcttgatttcttctgtgaaattaaaaataaacatgtggttcatgatcattgatactagcttattgcattgaagagttctcagttgggtggttgttctttctgaacgatcgtacaaaaagaaagataaggacattatgttggattggttcttgatgtcattaccttgtcatatattatgaaaattatttatgtacatttatactgggccactgggttagtaacatctattaaatgtttggcaagagttgtaagaaacaaagtacagttaaaaccagctctggatttacagtgcacatagaatatctctgatccttatctccatcagctaacagggggaaaatggatcgtcttgtttctttcaggttaaataaacacataaataaagaacaagaagctgaatcaatttgccaactccaacggcctgtattacttaatggttgacctgaacaaagtctttggccttctcttgcttgccacccaatctgttcatatgccgacacaatatcgatttacttggaaacttcgtcgtatgaaaatgacacaaagatttctttgacgaaagcagtatcatactatcatggtcggtggcttaaccacatgagaaactaccagacaattgctaattggataagagtgtgagtgtgtgtgtgtgtgtgtgtgtgtgtgtgtgtgtgtgtgtgtgtgtgttaaaatgttaatggccatgaaaacgattgccacctaatgatgtgaaaaaatattcagtgtctggttggaacctgcagattcccacattttataccaccagaacacaatcttcagcagatcatcagtggtaatcagtgactaatttttcttgtggatgggcacatggcatgaggccaatcatcactgggatgttgcatgtatctttcctaaattttgttgagaaacaactaggatatt

SEQ ID NO: 35540 - DNA, 10747 bp, Oryza sativa
  unsure (1)..(10747): unsure at all n locations
caaaatccacacgctttacctttggagtttggagaagagatgaacgaaaattccaaacatggacacttccaagaactgagcagatgatattacagctttttttcttgaagggaattttttttctgtttgaagggagatattacaagttttcatgtccaaaagcctttcctttgtaagcaaattgactgacctacttcaatagatgaatccatgtatttgctgacctaatatttcgagatacggagctatcctgcaacagataattagaccagcattattatgctgatcattatcgttggaagactgcaggtcgttgccaatggctgaaaaaaaatgatttattttttttctgatgatgcaaccgtggagacgctaagctgaggtcaggtcttcggtcgcatatggtagccctttgatcaaatcttaatgtttagatgtcatcatcaaagaagaccttgacttagtaataaaaagggaataatggtaattgcaaaataaacagatactaaattaaaatcaaagtaatggttcacacttcacaaggtgatccagtcttttattgcttctcttcctagttgggatgcagtgcagtcataaacaagaaaatgactacacgacctggtttcaggaaaataaaaagaaaaagaaaaagaaaagaaaaggactagatgtgatgcgctggaagtatagagataaacatgggtaaaaatattacagcttgtaagtaagaaaaggcactctgcacaagtaggtagcgtttgaaatagatttacttgttggattattgttgctgattatctacttcattattggaataaattaaatattttgataagtaaatttaacaaaatagtttagaacaagtagtctaagcaatgtttgacacttagcaatacaatagaagattttttttttaggaaaatgtatttctaaaagcatggagcaaagaatgcacatggtgaataagtttgtaacacctgtgatacagttagagaccaggatttacatttaacatatcatttttcagaaatcaagagacaagatgccctctccatgacaagaagttatccggagtgattcatgtagaagaaataaaatttaccatagcattacattaattgcatatgttttacaaaacaaacaatattacagtatatgtaacagttggacccctacctagcctagtccctttcagtcaagacaactactggacagtaaaacacttgcacacagagagagagagagagagagagaacgacttgccgatatataaatactcattgagccacccaccctcttaacaaagaattcgtccagccttgggaagccgagaagaggagagaaacaagagacagaccgccgagatagagtaactgagtaagcatctcgatcttggcatgttctttcttcttcccctttccatcaatgatttctcctcttgttttcctcatcacnaactcntgcagagacctgttcttcaacccaattctgctcttgttatattgcctggattcctttttttttttggttcttggaagcttctattgccgctgcttgttcttgagtgccctctgcaatttatagataattttcttcagtttttttatccaaaaagagttcttggattagttgtaaagaagaggttaaatcaaggaaggttgcatcttgttcttgactgattaattggtgtgccatgatctgcaggtaaacgggttcttgcctgacatttgtcttgtccgggtggccattcatggccaccgtggggcagcctgatgccatgagaaggatcaccgttcactacgtgaatccgccgccgatcgccggcgccggagaagcacacgtcgatggcctcgacgacgaggttcttgattatgtgattggtgatgttcttcaggatcaggtatgcatttgatccaacctttccatcattattagcatactgctcttacaggcttgcagaatgatgagctttagcatcaaacatatgtttctaagcctttgatatggcctctttactttagttcaacattgtttagtaaactttccactgtttctctgaaacttttttgagaataaacttatttgtttttctgaacttttttctaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaattgagacacctgcagatgaagatgatggtatgcattcattctcgcccagtttttgtaagcacttgatgtgcataatgattttcagtcgcggcaatcttaatcttttcacctctgaaattttgatcgccatgttggtttgattcagatataagctgcgtaccctcttcatctgactctgaaaccgatgaaccgcaggaaggcacaacgaagaggtgaatatatgagctgtttcagaattgcatttattcagcattgttcgttcagacttcttgatgcaaagataccacaattgcgtattcactaaaaagatgagctgtttcagaataaagcctttccaaatggataatgtataaacatgtactacgaaaagttgagattcctatcatttgtttgcaggctgccacacaggatgatacggatgatccagacaacatgacatacgaggttagtgttatattcacttgtatcacatttcttctgtaaaagaggtttacaccatctatgaaaaagttgctgattcttattctttctgtaatccagcaaaggcaggcacttgtggaatctgtaggaaatgagaacagaggtttatctgatctgcttatctcctacttggagacatggaagtacaaatcaggctttttcccaaggaaggcaaaccatgataagtatgtctaccatttcagttttcaatcaatcacatactgatttcttgcagaagataatccaagcatgtaactgatgacactctgattaaaatcttcatcatggcatgcaactgatgatttcctcctcttttttctcccaaaattgcagctgtcctatatgtctatccgctttcagacgccgagaaacactcattacattggcttgcaagcatagttaccatgaaggttgtattgctagatggctcaagattgacaaggtaaacaccttcttgggacactagatttgctatctgaattgtgtacctatcttagattataccatttgtcaaagtttacatgagcactgatatgcactgtccatttcatataacaagatggtctttgtctttcagtttccttgagcttcttccaaattaaaagaacttcatgggcttgtgcagtggaattcctgacatttttgtttatgaaacaggcctgcccagtttgcaaatatgaagtgtttggaccttcctagcgtgtgaggaggcgatcaacaaggctgaccaactatgactcgatgagacggcatatagtggttgcagcatctgctctgcagtattaattaaaaagggaaaccttaactcccaaaaaaaacagagaagggaagaaaaagaaagcaaaaaggaaaaaggaaaaagaaaaagaaaagacaaggagaaaagaaatttgaaaacagagatgcttcgtcaagattgtgcatttttttcatgtttttttttggctgtgtacaagcgtaattttgacctgatcgactcaaggcagtcgctcgaggcctttaatttcgtaaagcttcatatgcatgagtgtgcaattgtgtgcctatagtagtatagtacatgttttctgtttgaaacggagtcaaagatctctctcctgccgaccacccatctaaaagaaggccatgtgtacatcaatacatgtactgatatatactccctctgtccaaaataaatcaacttttgtacatgtcaaaatcttcttgttcaacttgtacaaaccagaacatattactccaaaatcacaaaaaagaacatattactctaggagtactcgtcctaaataatttgtgctttgcttggcttggtaccagcaaggcagcaacaagtatgctatgccacttcacttactacctgacaggcagtccagctatgatatctctcgtttatagtgggcccatctggtagtggcaggctggcagctgccttacgtgtgacgccagcgaggcagcgggcatgggtggcgtgcccgagaagagacacgtggagtcgaacgagacaaagcaaaaacatgggctcacatccccaacgtccagaagaagccgccgctgcctcctctcatttcggaactctaaagcctcctcttatttcccacttctctcttgccgtcgacccagcgaaccctagccaacgagatcggtagctagaggcagccgctatagccatggatgtggtaaatgcagcaaccttggatgtgttaaccaaggtttcccatccgatcagttactgcacggttatcgtggtctgtgcttaccgcaagggagcggtaataggaactgcccagtatatcgacttagttaaaaagaataaaaaaatatatatttttggttaaatttgtctggctttcttctgttttgcaccgtaaccgctgttacagcggtgaaggatacccctcccctgacggtaagggaaaccctggtgttcactaggcactaggtggtaagggaaactctggtgttcaataggcaccaggctaagcagaccaatgcgtaggcaccacagatcagctagacagacaaggtggtggaataaagcctaataccagaagacgtctttcagaacaatgttaagttattaggtttgcatagttacataaacagtaacaaacttttttctgaagaagaatcaatgctatcacaattttaatatactgcctaagtaatcacctcacccagatcaacatgctattaccaaaaattacctacttcatggttagtgtggcatatgcaattgcatgaacgctggcttgctctaacgcatcccattaatataagttaaaattggataataaagaaactatatttttcatgtactccaagttcgaaacaaaccaggccaacatcacaagcaaaggctttatggaaacactagttattgaaagtttcgtttggtggaacaaaaggaatagacgaaattgaacggatgaacattgcagttaggaataggatgtgatcagaaaaacaatttttgcgctcacagataatccaacatgaagtcaattatgctcagagaacaaacgaatcatgagattcagtcacaaactttgcatgcccttggcagttggccccctaaagagaaaatttggaaagacaggagatatcaaaatacctgagaaattataatacattccaatagcagcatgtgctcttcttccccctttctgtttggaaaggaaaattttcaatcagctggtgatttggatttcaaacatatcacatctcgttatcactgaatcaggaaagatcggagtgattaccaaagcaagcaaatcccataaattgataaatacgacaacccccttgctgtcccctccacatcggaatctctcacccaactcaagagcaaccgcagccatggccgacaacaacttcggagagctttcggtggacggtgagcccggccaaccgggagggcgcggtcgcggtggccgcggcggccgtggtggccgaggaggcgctagcggcggcggccggggcgggggcggtggtggtggcggtggcggtggcggcggagccggcgggaaaggagggaaaggcggagccggtgggcacggcggcgccggtggcggtggtggtggtggcggcgggaaaggcaggaaaggcggggccggtgggcacggcggcgccggtggcggtggtggtggtggcggcgggaaaggcaggaaaggcgggcgcggcggggacggtggcagcggcggggccggtgggcgcggaggcgacggtggcagcggcgggcaaggtgggcgcggcggggacggcggcggcgttaggagctgcacaaacagcagagggacccagatgctaatgcgaattagagagcgggttgttaatgcgaatattaatttatatagtgagaagttaaattttttgtataactaaatttaacaaacagtttgaaataagtcgtataagcaatacagtagaaaattttcttctagaaaatgttttttaaaatgtgtagcaaataatccgtttgaataatttgatggataatctgatgtattaagctaacagcctaacaatatattgtttggatcattaatccgtgccctactatcactatctcgaatcttaagtgagagaaagaaagagacgaaaaaaattggaggcaatccaatagctagtctattttagattgatcaacatattgcgtcgggcgtccacaaactgtgattgtgtatgcatcccgattttattagtggactaaaatcacgcattgaatcctacatgtggaaaaagcggtctcccagcgttatattttgatcaatccagcgttatattttgattaatttcaaatgtttgggttttacttacgccgattaataatctacaatggaggaagtacatgttagctctaatactattaaaattggtagtgcttcaatttctaaatttaaatttaataagctctgttttttctaagctaaaaccatttgattccaactctacaacatgtggaataaaacccttccaacctgacctgaattaaacatagtcgaaaatcaaaaactctgtatacagcagattacaggcgggttttttctttcaggaactatttcaaatcccagaaaactcgtgcaaaatccttccattccaggattttggagtaaatcctactataaaaatttcttcgctgaatcgacaatcatatggcattataaagatacaaaaattaaaataatagtactaccactaaagtaaataatagtaatcgccagacgttgtcattcagcagtatgatgggcctcgatgtgtgctagcagaagcagctctggttcgatctcagcattccaagccaactcacttaccagcgcacataacgcttaaattacatcagtgtatcatcatcatcagaaactgtttcagacaccccaaacaaaaactccacatacccaaaacaaaaaagaacaagacgagaagctagaatctacggcagtttccatcatcaccaagaagccaagcaggcaagcatttgtcacatgttccatgagtagccaccacctgcctggtcacccaggaacagcccactctcctccagttcagtactgatcagattcccaagattgtcaagatcatccaactcatgcagagcatcagccttgggggtagccgcatggccgccgctgccaatgccgccgcccgcagcagctgcaacttgggggttgctgctcactgacttgaagctgttacttctgctggggaggatgctggctgtattgttgatcacactgctaggacctgttgtaaccattggagtcccacccttcaccgcgccgttgttattcatatgatccccgctagcggcgctgccggtgatagccgttcctcctgatgcaagaccactgttagcaggagcatgttgaagttgttgttgctgctgctgctgcgccaagacacggttgttagtgttcttggcctcttgcagcaactgatggagcacatgctgctgatattgtgggctcacacccaagccctggaggctgctctgctgaggcataggctgctgaaatgaggccggatgttggaactgcgcgagatgcacctggtttggtccacggaaggatctagatgcttccagctgaatgccattgtgcattgctgtgggacctttaaacatgcttgatgcctcctgctgaagcaaactctggtttgcgactgaacttctaaggatattctggtaattgttaagtgcagcagcattctgcagaccatttccaatgggattctggtaattgttaagtgcagcagcattctgcggaccatttccaattggtccaataccgtgcgtctcattcgcatgggtgttcatttctgttttgacacccatggctttgaggttagtctggtcattaggaaggccagcagctgccattagttgctttggctcgtgcatgttttgtactggaagttttgctgcagtttgcttgggatagctcttcagaccctctgcagatgaacagggaaaacattaaacatttcaaagcataaaaaaattgctgaattttacagggaaaaagggggaaaaacagctgcttcgctgttatcactgtattatctaaattggtatgctgttataatctagtatccagcaacaataataataatttaccaggtaatccttccatacggcaaccacacaccaccatagctagttcaaaaaccatgtttaccaagtgatatcataacaacaagtatatgatgttggatttggtttgccatggatatgcttttactatctagccctgtaagcattttccccaaacaatagaatatctctcaacacttcagaccaaaagaacttctaggcttatgcttattaccattttcatgcaaaacattgnnnnnnnnnnnnnnnnnnnnnnnnnncattatataatattgagcgcctagtcaaacaatagagaactgagtggtgaatttgcataaaccatacctataggaccaagcttgttcttgtggctgaattcaatcaggtctttcatgtgattcaccacctctgatatctgaagaggacacaaattcaatgaagatgctgtgtgcagaagtatattacaggaaattctggataatattatagcaaatgttaaataacacaaggagaactcgtgaaaatatggatactgttagcagcgagatattaataactaaagaaaattcaggagcttctttatggataatatcacaaaaataattaaataacctacaaatgctatgcttacctgcaagcagcgaacatatcttttagatagaccatgctcatttaaggtgtggtggtctatatttttcgctagctgtcgtgacgccgtcacaaacctaaagagcgtaatggggtgctgagatcaattagatcataaataaaaaaaactctagatggaatttttaaaaaatcatgatttgtcatgccagaagaggaattaaaattgcatgtcaaggaactagtggcatagttggctcactaacatgttgcaaatgttctgtgcatcactgtttgagaccccagctggaccactttcagtggcaacagtttgatatttctgggcaacttgcagcagatgagcaacctggaaaaagcacatatgaacaatgagataccaagtcaccaaaattggagtacaccaaagaatggcagagaacaaaatgtgcagaaaaaacagggatgtttaccatcaggacagcactaccaaaataaaaactagacaaggacggtcaagatggcttaaaattcgaaattatcttgtgtttttgcatgtgcagccctcaggaagccagtacataaattggaaaattaaacaagaatctaaatagatgttggagcagtctagcaggaaaaagaaggggctttttacaacccagcctaccaagattcgcaatattcatccaactaaaccactttattaaaattgcttacatacgtgttgacaactatcacataagaggtgtattgggtatattacagcagctaatctactatctgctctctattgatcaaagtttaatcaaataaaacagaacagcataaatctacctggggtgaaagaaacctgcgagtgatatactcatcatgtcgccgtgaacagaactcccaggacattatctgcatattttcacatgaaaacagcagataagaatgatcctaaactgtccaatcatttgcaacatctagatattcacaaatgcaagctattacaaataagcctttaccttcagttctggtgtgaatatgattctcaactgcccctcgtgtatcacatgcatatgttcataaatgcttttctgaacaactttagtatgttccagcagcattagtccattgggcaaccggaattcattggccatgtcaaggaataagtattcatctataacaccatggtcaaatctaatttgacagagtctaggaagtatttcataggtagcctctgccagataagattgaaacaataataacaaagtgagatcaacatcatacaatggaactgaactaatgaaaaaagcaaaaaagatcatgacttcttatgagaagaacacactagtactttaaaaaaggagcaaaatacaaagtagtccagggaaaaatatgttgtgaggtacattttgaagaaatggcaggtgcaaactgcacaatatatggtaacatatactatgcagaaatgcagaaccagaactacataacaatactaggatatcaccatgtagtttcaagaaaaatattttctgccagtctgaccaatcattccaagtatattcaagacagacaaagcctcttgagatataaacttcataggatactttcttttttgctcgtgatggctaatttctcatatgaaagatacactcaagataatacaggtttatatatttgcattttctgtcttgagatgaggaggcaatctctatagcacaagacatgtaggaatattgagtttatctaccaaaagtactataggc

SEQ ID NO: 35541 - DNA, 6937 bp, Oryza sativa
atggaactgaactaatgaaaaaagcaaaaaagatcatgacttcttatgagaagaacacactagtactttaaaaaaggagcaaaatacaaagtagtccagggaaaaatatgttgtgaggtacattttgaagaaatggcaggtgcaaactgcacaatatatggtaacatatactatgcagaaatgcagaaccagaactacataacaatactaggatatcaccatgtagtttcaagaaaaatattttctgccagtctgaccaatcattccaagtatattcaagacagacaaagcctcttgagatataaacttcataggatactttcttttttgctcgtgatggctaatttctcatatgaaagatacactcaagataatacagttttatatatttgcattttctgtcttgagatgaggaggcaatctctatagcacaagacatgtaggaatattgagtttatctaccaaaagtactataggcacaaaacagtgcagtaattgatcttccataaaaaaagacaggagtgggaacagagcaaattgcaaggttcattgttatgataatgaagctggataaggttccaaaaaagtagtcaactaaccatatcctttgcccccatgtgtattacaaatgtcacagcgccatgaatcctgaaacatggagaaaatagtaatttaaaaggtgcaactacgaatttatgcttcacagtttactaaaatctcaacagcatcagctatctcagctctcagtagaacgatcattaaaaaatgaaaatgcaatgctaactatttcaaaatattcatctatagaacacgctcatatggattttgtttctcactacaatcacaagatacttgactgtcaaaatatagtgttcaatatccaagcaaagtttaaaagagatgctaatcaatattgttgtgaacatcacactgagaagtattctgttgaaacaggaaagtaaagggcgtcaatgtacaatgcagatataaagatttaagtgtgaaccgtgaactgaccggagctgtgtgtggaacagcacctgaaggatttcctcttttctcatacgaggatacacaccatctttctcttgctcgtggtgcaaaatattcatcaataagcttcctccagtatgttattggattattctacaagcaggtactccagtaaatagtaaatcttatagccaagaacatgtgtcttgcaataaatgtttacaacgcagaacctcacctctggtcggtgacgcttatggtataagtattgctttaaccttcgagaacaaagcccattctcgacaggagtcctaacaggtccagctagctgcattccaggctgcgctagtggaggcctcaactgtggctgccgaggtatgccaacttgagattgttggatctgtgaaaatggttgcaacatctgatgctgctgttgctgctgaatctgtgccagtttatgctgatggatcaaggcttgaatctgagggttctgttgaccctgcagatgaagagaactctggccttggagcagttgctggattaaattgtgttgcaggatatcatcttgcctaatatcaacccttgacttcttctgagcatgcaatgcaccagcagcatcaataacaggttgtgatgttacactagaagaccttcgcttctgcatctgctcttggggaggactttgttgcacaatgggaccatcaataactgaagatccagagatgttattggatgaaaacgacattggggaagcaggaaggcgcatgaatgaatcagcattcatgctcgtacttggctgcaactgggcacctccggagagcgatgagttagcatccgtcaccaaagagctaacaccaatgcttggcccagaggaatttgtagtgctaatagggatactaccatgcatatccctgggaacaagtccaaggttggagcatggcgccccagacatggaggttaccagggttcgatcccaatcatcactttgaagaacctgcaaaaggtgaacatgaattattaggaaataaatcatcaaatatcttactggataagaactgttaacagcctaatgcgtgagaactgagaaatggtcagcagtaactgaagccaaacagatgcaagtagtaatgagattttagcatcatgaaatttctcgattcaatggttgaaaaaacagaaaacagaagaaggccatttttcaattctctaaccatactacgctactgcaatagcataaccagaaaatgaaactagaatccaacaaatggtaaataaataaaaaaatcgtctttgaaaagaaaataagggacagaaaatatagcatgaaacacaaattgcaaaacagttgatgctggttatgcagggtgtgagctgaaatttactcttttggttgaaattagccgagctttagcattctttccaccacacaaaaaaaaatatttttcccaggttcctctcatacaagtacaagaatggagcatataccaaaatgtcttccaggtcagatcaaacaacgaaagaaatgaaatagaaatcaagttcacatcagacaaaatagaatactgaactaacttcacaacaaaaggctccagggcaacgaatcgagagaggaggggaggggaaactgccacgtccggggaggatggagagagaggacaacgaaggccggagatgtgcccgcagccggatcgccaaccctagcaaagtagaggagcaggagacgaaacaaggagaaaaattcccccctaatctttgctccgtagcagatggataaaaaccctagcccaaactcgccccccaaaaaccaatcgaaaaaccgagctacaaagattaagctaacactcgaccaagaacagaaattccacctctacacccccaaaattaccacgctacattgcaggaatcggcacccatcaacccaaaaaaaaaatcacccaaccccttctttcacaacccaaccacaaatcgcccccaaaaaggggagcaaaaacaagaaatacttaggtcactttccgcggtccgagccatcaaccccccccccccccactaccaaaccatctctctcaccttgagttcgtcggctcaatcgctggccctcccaaaccccaacttctcctcctctaccttgcagctgcgatttttttttcttttttgctgcgaattttttttttctctcctcttccgcttcttctcctcctcttcctgcgcctgtaggcggcgtcctcgccgacgagcaaaccggttaaatagattcgcggcgcccgggacggtggcgaccggctgcagccggtgggccgggcccacattgaccgccattgaccggtctccgtggggcccacgggaggcctccgggccgtcggatcggccgcggagccgcatcgcgaggcgggtgtgtacacgcggccgcgcgtgattggctcccggtgggggcgggggaaaccgggagacgggcaggtcggctcctcgctacgcgcaccccgctcgcgcgcgcgcgcgtacacacgcggtggtggggccatcttgtcagcgaccgtgtggcttggcgggtgtggaaacctcggtgctttgcggtggaaggctcgggtgatctttttggccgagcacgcgggtagctcttcgtggggcccacacctacggttcgtggggcccacatgtaagtgagggtttatgcagggcgggtggctgcgttggtcgcttgaagaaataggaggggtcttttccaggacaggaatgacttggtaacactgactttatcgtcactgaacggtgggtccattgatgtatggcccacctgtaagtcagatctaacatgtgtgtgggtatggctatgcgtgttcggattaacggtgaagtttctgccctttaattttcaaggaccgactgctcactgctttgcctaggaagtggaattgctccatgcacacaaaaggctacacacaagggtggggggagcttccttttgtggctgtacaaagggtgggggccagcagaggctgtgctgagtttgactggttttgcattgtctatgcaaggctggaagactatcataataggctttcctttagcttgattattgcagcttacatagcctaaatcattgtaatgggggcataagggattttttttatgtgggaaatacaaaaggatgaagattgaagatgatcaatggttgttgtggttatagaacatgtattttgtgataaatggaatacaattatggagtgtaggttgtcctaaaaacgtgattcagcatagacagaaaagtgatatcttgtctagagcacaacttcggatagtgagaaatatacggcggaataactggatagaaacctatccaaaatacatgaaacggttattatatgcttttatatctataagatattagtagacttgtctagcacgtcggatctagtaaaatatttagtatactatttttgaaagaaatcagataatcatgcttggagtggcattccaataattttatattattatttctaccaataataatataaaattattatattattatcttgtactccctccgtcccaaaataactcaacttaagatgggccatcttaggacaacgaatcttgacaaatgctttgtccagatattttgggacatagggagtacatgactatgctatgcagataattcttttcaaatcgaactgggatgaattttgaacctgtttagcctgtttttgaccagctttaaaagttaatgtacatattccaaaccagcatattaatcgcttcagctgatggtttctagcgttgtgatggagtgcattccaggttaaccgcgttgctaaaccagccaagccaagccaagccatccctggttacttgattagtctgtgtgacgtgtagcggttgcatccttcgcatggaagaatacatgacgaggatacaagtcagcggccactatataattttccatcatgtgcatatacgaggttcttatcgtgatctaccgcgatatcttgattatatttcttgtaatttgactggttttttcaaagaaagagaactcaatgtcaactcatctttttttttcccgacagcagccccgatgaactaaggcttccttcgaaatagagtatggagtgagcttaattatcaaccgtacgcaaaattaaaaaaaatcattagcatgattaaattaattaagtattaatactagctattacaaacttaaaaaatattaatctaattttaaaagaatttttatgtatatttttttagaaaggaaaacacgattaattgtttagtaagcgtgctgacgttaaacgagaaagttgcccgaaatatgtttgatcaagtttactcaaacatttaaaagaaaactcacatgatgatttgctttaatttagtaagtacgcagtacatgtgaaactaattaactatcttcatatacaagccctgaacgatgcattcacacggatcaattaacacgagccgcgtcgagtagcatgtatgatttctgatattgtacaatcaaccttgaccacccaaaaaaaagtcaaaaagaatccaatttgaagcgacacgtctcctagctaacaaaacgcagcagagagaagagtaacagtaacacaccatgaacacgtaggtacatttgcgttctgtatatatttacggaattttcaatttggtttctcgccatcgccaatccaagacactgcgaccggccatcttaaatcgggcaggaaatcgacaagtaattcgattttgatagctttcagtttacgttccaccgcgacgatcgatggattgatgatgaaataatctcgatcgatcactgcatcatgcatgctgctgagtccaatcaataatcggagatcacctccccttcatgtcggcgagctgcgcgaacatctcgccggcggcggtggtggacacgtcgggcacggtggagacgccggagccggaggaggtcgccggggccgcgccggcgccgtcgtggtcggctggcttgtcggccccctcgggcgggttggcgtcctgcagctggagcgcgtactcgaggttccagagcacgtcgcccatggagatcctgtcgctgccgaactcggcgaggcacttctcggcggcctcggcgaacttgttgagcgactcctggttcaccgtcccggcgagcttggggtccatgatcttctcgatgaggcccttccgcttccactgcatcccccactcggcgaggctgacctgctcgcgcggcagctgcgggtcgatgggcggccgcgcgcacagcgtctcgaggagcacgacgccgaaggagtagacgtcggacttgtccgtcagctgctggcaccggaagtactccgggtcgaggtagccgaagctgcccttgacggcggtgctgacgtgcagctggttcatcccggggccgtccttggacagcccaaagtcggatacctttgcgacgaagttgtcgtcgaggaggatgttggtggtcttgacgtcgcggtggatgatcccctgcgccgtgccggtgtgcaggtagtggaggccgcgggcggcgccgatgcagatctccagccgctgcttccacgtcaacgccggcaggtccttgccgtagatgtggtcgcggaaggggccattgtgcatgtactcgtagacgaggatcatctcggcgttctcgtcgcagtagccgatgagggagacgaggtggcggtggcggagcttggacagcatctggatctcggtgttgaactcgttgatcccttgctccgactgcgggttcccgcgcttcacggcgaccttggtgccgtcgtcgatctcgccgatgtagacgttgccgaagccgccgacgccgatgatggcgctctcctcgaagttcttggtcgcggcctggatctcggcgaaggagaagaagcggccgatgccgaaggtggaggagaaggtgtagccgctcttgctggacccggccttgctggtg

SEQ ID NO: 35542 - DNA, 1875 bp, Oryza sativa
  unsure (1)..(1875): unsure at all n locations
ccgccgacagctcgccggtcaccgtcgacaggtccagcccggagatggccttgcgcccgttgacgaacacgttgaagtagaggtcgttcatgctcttgctcacgatgtccgcgaagaagagccggaccaggtagccgaacgccgggtccacctccatcttccacgacatgttgaagctcgggctccccacgccggcgtccgccatcttcgcgcagctcgcgtacacctgcgccggcgccaccagcttcgacgtcccgtcggggaacttgatgttccccaccggcaccgacacgtccttcaccgcctccttcgactgcacgtacggcgcgtccacgtcccactgccgccccagcgtatccttgtcgggcgcgatggccgggccgccgacgttgatccggtacaccacctggtacgccgcctcggcgagcccggtcatctctccgacgggagcgatccccatggccatgtctgtgatgagctcgtcgggggcgttcacgacctcgatggcgttgatgaacgcggcggagcccttgagcgggtagaacttgacggcgaggtggttctcggtggcgttcacgaggaactccttcatgaccggcttgttctcggcggtgaagctgtggaggaggacgttggtgtcggtggagacggtgaaggtggcggtggtgaggtctaagtcggagttcttgagcgggaagaggtagaggcggacgaagtgccagcccgggacggtgagcgggaagctgtatacggcctcgtcgcggaagatccgggcggtgaggtaaagcggccagggcacgtcagcgtcggtggtggcgaccttgatggcgtccttggcggagagaaggctgttcgactgcgcgtccgtcttgtacaccttgccgccggtggtgacggggctcgtgctgccgcagtcgatgaggaagttgtccttgggcgtgaacgtcgacggcgtcggcgccgtctgcgcgccgctctcggtgaccggccgcccctgccccgacacggccgtcgcgagcgccgccgccaccgcggcggccagcagcagcgccggcgggatcatcctcccgcggcggcgcatggtggtggggtggcctacgtggcacgcaagacgtggcagtgtattattggaggaggcgcgcggcgccctctcgccctctctctctggttggtggggccaatcggaggagagggaggagggggcgtggggccagggagtctagaagagggtggcggagaggtgggcgggttatgtgggccaatgagcgcgccaagtttagtttaagcaggccgcccctacggttgggcccgcctcgcgcgctccaccgctcgcaaattctcgcatacgcgcgccgcgtcggccgcctattcttagcacgcgacggcttcgttcgattgcaggtggaggagcaagatttgtaccgcacacgaaatctaatttgcaggtggaggcaactccggctcggacgtccgacgtttggggaaaaatcgggcgctgatgtcagcgcccgatttacgtgcaaaaactactttaaattaatttttctcttaaattacttatctaaatcatgattcgatttcaccattaaattcgttgcaattaaatcttcaaaataagaccacacatggatatattccgacgattttttttagcttactgttgaattatttttaaatgttgcacgatgttccaccaggtatatcagaattgtttcactaaatagatcgaaaatgtttcactcgtttaaatcgggtgttgtttcaccttatataaaaataagggccatttgcttatttgaccctgttttgaaggctaactannnnnnnnnnnnnnnnnnnnnnnnnnnnnnnnnnnnnnnnnnnnnnnnnnnnnnn

SEQ ID NO: 35543 - DNA, 4359 bp, Oryza sativa
tcaccttatataaaaataagggccatttgcttatttgaccctgttttgaaggctaactaccaatttgaccctctttttttgagtttgcttatttgaccctgcttttcgaaaacgaacgatcggtctgaccctgttctgttaaggtgagttgacggtgttaagttaggggtaaatagtctattttgcccttgcaacgaagctgacgaccggcgatggcaacgaagctgacggaggcggagacggcgacgacgatgctcttcccggccacggcgggcgcgagtgcgggcgtgagctcgctgcacggggccatcccggcgcttgtgtcggcggggctcggcgccgcggccgacgagtcagcgggcgacgaggccagggacatcggcggggccggcggcgaggccatcgtcatcggcggcggtgggggccttggcgagcaggcactggcgcatgtcccctccgcgcgcataccgccgccgccgccgccccctacatccacaagctgacgccggcgcggatccgcctcccctccgcgcgaatcccgccgccgccgccgccgcccctacctccacaagctgacgccggcgcggatccgcctcccctccgcgcgcatcccgccgctaggcccggctcctctcctcccttcgccggcgcaggcctccgcctccctccccgcgcgccgatgcagatgccgccagcgccgcctctgccgcaggcccggctcccctcccttcgccggcgccggcctccgcctccctccccgcgcgccgatgcagacaccgccgccgccgccaggcccggctcctctccctccccgcgccgcatgccagcctccgcctccatccccactgcgcgcgttgacgccgccgccgctaggcccggctcccctccctcccttcgccgcgtgctgtcaccgccgccgcaaatcgctagcagaagagagagacatggagactcagagacatgtggatagggctagagatggatatggtttcctcaagggtattttgggcattatgaattttaattatatttttttctttttttaaaatcaaatcttaacggtgtagtggaaatagggtcagacggaagattcatttttgaaaagcagggtcaaataagcaaactaaaaaaagtagggtcaaattggtagttagacttcaaaacggggtcaaataagcaattgtccctaaaaataatgtttcagcaaatagcgaaagaatgtttcagttcactgcaatatttgatccatacataatgaaacattataagtacactaggtgaaatattttttggtggaataagaaatgaaatgaattcccttaatagggggtttccaaaatatatgggttttttgttgcaatgaaatatttcagttcactgcaacattggatctatacatagtgaaatattgtgagtacactagatgaaatattttttgtgaaataaaaataaaccaaattcccttaatagggggtttccaaaatatgtgggtgatttgttgtaacggcgcgttccataatgtcaaaatacactacaatatttgatccgtacatagtgaaacatcgcaagtactagctgaaacatcgtaaaactactagctgaaacatcaaaagagatcatatgcaatattcaaaaaaatatcaatagaaaagctaaaatattttttatcgaaatataatcatgtgtggtcttgttataaagatttaattgcaacgaatacaacggtgtgatcggatcgtagattggataactagttttagagaaaaatcgttttaaaaggagcgataggaggcgcgggcgcccgaggcgtccaatttttcctctgccgtcgggcgccggcgtgcagcactctaagcccatcgcagtggcggtcgaggagacacgccggtttagcccgttgtttttcgttgggccgtggactagtggtgagcggtgaggtcataacatattgacatagccaatccaaggtttatttttcttctttaaattttgtttttttaagaaaagacaagctgccaatttttattaaatagagaaggagtaaacggagagagctacaaatcgaacgtccgacgttgtaaaaaaaatcggacagtcaaatgtttcggttgactgttggtgcaacattaagttatacatagtgaaacaaaaaagtcagcctatgaaacatatagaacttttgtgaaacataacaataagaatacatggtgtaacatatttctatcacatatgaaacattgagtttttattgtctgaaacatatgttttttttcatcagaatataatcatgcgatatcttgttgtaaagatttaattataacgatttcaacggtgtgatcgaatcgttcaacggataagtagtttagaagaaaatttttttttaagatcactaaatacttgcatcatgcatggtgtgggggagaaagctaatagaatagcataagagagactaggggcaatagcgtctcatattttttcagtgattggtgaaacattgagttgcacatagtgaaacaaaaaaaaattcagttattgaaacatttaattttttttatgaaacataacaaaaacacacattgaaacatattgctactgcgtctgaaacattaaatttaatggattgaaacatatatttttctttcatcggaatgcaattatatgatatcttgttataaagatttaattgtaacaaatataatgatgtgatcatatcataaattggataaatagttcaaaagataaaacattttgaagaccatcgtatgaatgtgtggagacatagggtactattagtagtttgttcatccgatcttttcttttcgtcggacttatgatctcaagtattttcgaggttatgtgggccagcgagagcgccaagtttagtttaagcaggccgcccctacggttgggcccgcctcgtgcgctccaccgctcgcaaattctcgcatacgcgcgccgcgtcggccgcctattcttagcacgcgacggcttcgttcgattgcaggtggaggagcaagatttgtaccgcgcacgaaatctaattagcatataattaataaaatattaataattataaaaattaaaaaatagatttatttgtattttaaaaaattctatttagaaaattttaaaaaacacatcatttaatagtttgaatagtgtgaatagtgtgctaacggaaaatgaagaagttgaaaattttggagttgaagaatggaattgggcaaatgggaggtagaaatggcgctgcaaatttggatcggttgtattcagagatttcatcagttatttcttcttcttctaataatgcatgaacttggacagcagacaacactggttgatggagcaagcaccgaacacatcacatggatgcataataagttcgattaattaggaacccgtgtttatgttttgtgtttgcagtggtccaaaatcctatgtttgcagtaacgttactattgttcagtaggggtgactgactattatcttgtttgcctccaataattacacagctgaattgcaatgacggagtcgatcgatcacctgctgcaaattctgcggttgtttggcccaaacaggctcgaatcaatggtcattagtgatcagggaaactggagatattaatttcttgtgcattaacgatcaaaacaccgaagtagctaaaaattcccgtttatattttatacgtcttgcacgttacaaccaataacacaacagacactaacatcgaacagaagaattaaaacaatacgtatagaacaaaaacgcttacttcctccgtttcacaatataagtcattctagcattttctatattcatattaatattaatgaatctagataaatatatatgtctagattcattaatatcactatgaatgtggggaatattagaatgatttacattgtgaaacggagagagtacataatagtactgtgtatacgtacggtatatagtagctagctcctaataggagtaataagcacttagagaataaggatagataagttaatccacgcatgatatcttgtttgattattagcatccgacattgaaccacctcctccttgctggcttccaccgctcctccgccttcctcttctccttctcgcacgcacatttcgcttccttcagattcttcatcttcagataaaaaaaatatccatcaaattaattcagatttatatatttttcgaacaagagattcagatttatatcagatcgataaaatgtgtattgataatgcacagtttccagacttttctttctttgtacatttctgcaattattattagtactaatctagcgagcttaatgtgtgtgttgctaatgaatgcgattaattaatctgtaataatc

SEQ ID NO: 35544 - DNA, 21529 bp, Oryza sativa
cagcgccgccgccggcagcgacttgctgtgctggtggtgcgccgccggcccgccgtcgccgtcgccggcattcgcccgccgctgctcctccagctgccgcaactgaaacaaagatcaaacaacgacatggtgatcactgatcaatcgacgaatggatcgatcgacacgcgacggcgacgctctctcgcgctcacccggaggtcgagctggtcgaggcggccgaggagggtctccggcggagggagggcggaggcgctgatgaggacgcggcgctccgagccgaggagcacgtcggccatggcggttgcacgccggagcacgcagcggcaggtacggtttatatagaaggccgcgcgcggcggcgagggcggagccaagatcgggtcgtggactcggctccgcaatctggcccgcgctcctcgcgcgcgcacctttgacttggacactgtcatactgggcctggatttgttggggttgggctttgtatggccctcgtggcaggcctacatgccaggcccaatttgaggcccaccgagtagtcgtaattaacaggagaccaacaaaacatgatactccgtatctctttgaagaaagagagcagagttgatgaatgtcatgtcctgagatttggtctattttttttcacgaacgcgtaaaataattgcacgttaatatattagaggaaaaatagtttttgatacacaacgcaatcagccagatcggcttatgctaggggaatgaagaaaagcaaaacaaaaattgtagctaggaaggaaaaaaaactactacggcggctatgaaactccgattggtgggaaggggtagagccacgttacattttcaataaatctccaaaagtagcaatgcacgctaaagaccacagatgatcttccaagcagatatactctagaaccactgagaccgaagagagcgtagaatcgaaaactctggagttccgttccttccatagtgccaagagaccagaagtatcagagagtcgaaaccggcacggagatgctcagataaagcaggccctagaggttggccaccaatcctgaagccgactgccacaagaggaagagagagcggtctagccaggaggcgacaacacacggaacctgacctgccgagcgaacacacagtcgaggatttggtttagagaatgtctctattgggtattgtaattggaagataaattgcgtagcacgtaaattagctagacatgtttttaatttaatcaattttttttaactaggttcaacccctggcttcttattaaacgttccaaatgtcatccctcaaaaagaaaaagagagagagagagcagagcagagaagagttgatgatggttggatggtgtggtctggaacataagaaaaagtcagaatcagatgattggtccggaggcatctctctctctgttgccaaaagcaatttctgtggtagcaaaccatgatcatcatgcttcttgttctgggagatccactgcaaatttccacaaccccacttcacaatgtacacccattgcttgcccttctctctttaccgtttttctgcatccatacatgttttctaagtggtagcaactcatattcagctgtgtctggaattgcctaaacattttgaaaatgcttcaagcactgaactgctctctaccaaactcctgcactactgcatcgcctcttgctttgaccatcagaatgttacgaagaaattgcaccccttaagctccacatttcacgccagttgcttgtacaccttttttttcaaagcgaaaattgcagaagcaactgtcgtgaaatgtagagcttgacaattgttaaaattacatgagtacaacaatgtccactgtattaagctctacatcccaccggaatatataatcaaaactcgggagagaaattagcctgcaggactgcagtacaggactccactccacatgatcagttgttgtaaccagactaattaagcaaggcgagctaatgagcagcagatcgagcacatggtaatgcctcgctaaaccgatcctgatcgatccatctgcttttatattaaagagatggcacaagccaccagacgatcgaactacctggcaattgctccttctctctctattattatttttttggccattaattgctaactgaatactcaaggcaaactgtgccaaatgatttaattatttgatcacttatgtttaacactccaacgatcgcataccaactgctagtactggtattataaaccagtattaaactagtactatcatgcatgatgatggaagtatgggccattcaggtttcaggtttacgtgcagtgtggctatactgtaggacgaacactcgcaatgatttaaaccgacacttgtggtcaattcaaacctgcccaggatcacgcaagatctctctaattttaattagttcgtgctaagaaagtattatatatgaaatgatttttggttgctctgaaccttttgtgtcgtattcaggcacccaggctgtcttggaagccatttggattccatgggccacaaatataggcatggacagcatgtgaaacttctgccttttaacaaatccctgcaatccaaaggcgattaaaacactttctgaaaagtattttctaacataaatacaataactgtctttttcacacaaacattttctctaggcccatgattcaaactctcataaactatggactccatctcgaacaaaataatttctttttcaaaaaaacgaaaagaaaagaaaccggtatgaccgcataacaatagtcagttacatttcaataaacaaaagtaaaaacctagacgggttacaagaaaagggaaaagaaaaccctcgccgaacaaaagaactccatatagatttcatgagattttttctatttttctatattattctcgtgggaatcatacatttaaaaaggaaaattatacgaagtgagtgagcgagttggtccgtgtttggacggaagtagaggctatgggcagcatgaccaatgacagggaagcggcaccttccgatcactcaggtcatccattcatccattcatccatccatccatccattcatccatccatccatctcaatatatagctaatctgtattttctgtgtgcttggaagcagctttggagggctctattattgtctttagcctctctgattgatatgactccctaaccatatgctattatgatttatgtcatactggcaatgtacatacgcctctatatatattcccatatgtttagcttaatttaaatctacatgatttagcatcggtgtcggtatagctacaagatatcgtaagcttagcttttgatcatgagccttgttgcgactaataggaaggttcatcagtgatgaaatgaatagtgaggcttcgttctggcatccctagggggcgatctcgtctgtgtctctttgttggtctagcggcggtcggtcacgcttaacggcggtcgatccggtgctagccttctcctgggattatgtgttggcgatgtcggtgtgtgggtggttgtatattttttcctttttcctggttacgaccctccagggttgtaatcttgtaatttttttcctgctctatcaatagaacttcgcaccgtctcgtgcgagtcgttcaaaaagaatagtgaggtttcgtgaagaacagttgttgggaagaggaagaataagagagcaatgctttacatatttcaaaaagtgtttcgaaaaacatgcttcaaaattggatattttttccttgtgtagttctgaggccttttttatctgggaaaaatttttaggattgattgtcacatcggatatacggacgcacgtttaaagtattaaacatagtctaataacaaaacaaattatagattccgccagaaaactacgagacaaatttactaagcataattaatccgtcattagtaaatatttactgtagcaccacattgtcaaatcatggcgtaataggcttaaaaagttcgtctcgcaatttacacgcaatatgtgtaattttttttgcctacatttaatattctatgcatgtgtccaaatattcgatatgacagcgtgaatttttttgttttggaaactaaaccgggcctggatttctggtaatcaaaattggctcagtcttgatcctatccatattgcctggttaaatatagcattgcctagatggaaatagaagtgccataaaaatgcacggtgctgacaattcaaaacaacaactactgcatatttgaaaaaccaactaactaaaacgtgtcaaatgatctgaatggaaaattcagagcagaacaattaagcgatctcaaaccaagattaagtacagaataatcaggcgtgcgtttttgtttctgtaaaatacggcaatgcaagcgtccgaacacaacacacataaaaccacatttagtagttaagaactcatagaccgacattaactaatctctgcaacgaataaaaacaacaaaacgaaaaggaaaggaatcggacaaagaaaggaataagaggagaaccacagaaagcaatcgccaaagaaaaggaaataaaaaacattgtgcaaatcaaaacgtggttggctgcatttcgaatcagatacctgtctttttttcatcagaaagcaaagctgattaaggagaagaagaacttgagaaggaggagaagagaggaggaagaaaggaagcagagacgaggaggtgggttacagcgtctctttcctcggtcaacgcaggcgagaggagagcgttgacagtgccagcgtggcatccccaggtgggccccacacgcgcgacactcctgactgtcggtggagctcagactgtctgtcaccttgtgccgccggcctgcgtgtttcagactgttgatgaagagttgttagacaaaaagaaaaaaaaggaaaagttgatctcttgttattagcaacttgttgatcttttttgtagtagtattttgaggagaattcagtggctttggtttactaatccaatctctcaagctgacttgattgctgtgcacatgagcatatagtagttactacttcagtttcagttaaactaagctcaccctccaacgactaatgcacagcaccacgcacatgtagcagtgtcatttaaaaattcagtaacagtttctgaaaactaaaaaacaattcagtatcagttgtgattacaagaacacaatgcaactgatcctgtatgttttattcattggattatatttttgacagtgcacaaaaacacactaataaggcacaacaaagtagcactgttagggtggcggccattcattaaagattgactcgtatcgctgaatgccttgtgttcctgattggattcaactgtttactttccgtgctccactgtttgggaatcaatggttaattatggggatcattagcatgatgctttgctttcttttgtcatcagacttgtatgattcaatgatgatatttttttcttaataaatggaatacaaactagtaattgtcaggctgatcagctcacatccagacagagactgcatactggctgatactgtcagctgtgtttgtgtatgaatctcatacagacagcagcagtttactcagctggttggtaacaaatgtacaccaggttacaataactcttctgtagtttttgaactataaaccaaaaacgacatttagagggagtgacgtccctccaaatatttttttaagaaaaaattatgagtgtatcgggaattgaacacgagaccttggggttaaaactacataccccttgtcattgtactatgaagtgcatctcaatttggaactatagttttatagtttcttttgtttttgaactattaaccaaaagagatagtactctctacatttgaaattactgaacattttagctttcttttaagtcaaacacgtctatctttaaccattaatttttaataggttcgtatagtctaataacatatgaattatatatatgttatgaaagtctcatgctgaatctaaaaatatacttgaaatttattatgttaaaccatacaaatttattaagaaaaaaaattgacttactagaatgacgagtagtttaaaactgagggagtagcttgtttctaaaaccataattcaagagccacttcaattcatgcatcgaaaagctgattgccagcactactgtagctgtcctgcaaacctgcaacagcaaatctagctgtgataaattctgatatctgaaccattgcacttcacttttgaatcatagaagatgaattccacaagcatgattcatgtcccttaacttgtgccttttcttttttctaggatcatgtgatctctttatttattattcctctccctcctggcacacaaagccttcctatgaccactactattgtattactagattttaaacacctctaaataaattaaaaaaacaaactcttacatttttcaacattattatttggcattgtcatgctgcctgctgacctagaatttcacaagattttcataggaaacaattcatttccttcaagatttccacaaaattcctctgttccaaataagaccatgccaatgccaacctcaatggccttgccaaaaggttttgatcatataggcaagtttatttttagttgttttttaaataaaaacttggaaaaaaatatcctgttatgttggacagttcaaattaatcaagagcaatttttttccggtagttggatctagctaactaatcacaaacaaattattttcgcaccttggcgcgaataatgctcccgcgattatttcatctgcatgtgctgcgtattctccactgatgatcagctgctgaactgtaccagcactgctaatctactacgctagctactttgtaactgtttttaaagcgggtagttacatcgttaatttttttttgttttgattacaagtactcggtgctaaaatatatagtatttaaaaaatctattaggcgatggttgggacgttatatcgacaagcaaatcaaacaggaaggaaaaggtttgcagcagcatcagccgacacaatacgaatcaccatctaaccaaacgaaaacgaatcaaaacttggactagcttgctgcaaatttcctggttttaaaagccaagaaaataataatttctcaggcatgtggaatactagtagagacgacaaggaggaaacaccaaaaaattcagcaaataaacaaataaatgaagtgtattcatttctgatggcgccatgatcaagcatctagcacaatgtggagcatccacccttcctttctctcacattccacagtagaatcaaatcaattttgtcatgaaccaacgcaactctgaccctgatcttttcagtttatttaccagattattgaaacatattatttatcgtacactttaaaaactatattttctttataaataatttacactcctctattgcatttcttatcgctagtgttattttctcattaatataaagattttacttcgattttcgtaagcacgcttttaaaactactaaactgtatgcgaaaactctaaatatgaaagttgatttaaaatatcaaatatattcatttgttaagtttataaatattaaaatttaactaataatgtgctaatagctttatcgtttaaccgtgcgtcaacttaatcttaatcttatgagtttcaaacactattattaagtttattcatcaaaacatgtactcctactttatatttatatctgagtgcatagtccgccaataatctaaatcgaacaggaatatatatattatcatgttaattaaatatagttttccagaaacatttatttatataaatctctttggaatttgataatggaaaatgtcatgtggccagtggcaagtaatctaattggcgtatatattccccttgtccatggcgttgcggtttgttccctcatcaacctcaccaccattattttcttctctcctcttctcttcttcctcctctcctctcctctcctcgctctccatccatctcgtcttcttcttcctcctcctcagcttcgagatttcagcttctccaaacccccattcttcccgccacaagctctgctctgtgctttgctcgctcgcctttcccgccattggtgtgcttcgctttcttggcttcaaagatccgacgagctctgtgatagctggggagaagaagaggaggagaggaggatgctgggagcgagccctaaggccaagaaaggcgcgacggtgaagttcgggtcgatgaagaatcctcctcctcccccggtggttggcgccgccgccggagcagcggcggcggcggcgggtgggaaggtgccggcggaggaggtgtgggaggtgcggccaggcgggatgctggtgcagaagaggggcggcggcgccgacgaggagcccgtcaacgtgaagccggtgcccaccatccgcgtcaaggtcaagcacgccggcatcacccacgagatctacatcaactcgcaggcgtccttcggtcagtgcccgccgccgccgtcgtcgtcgtcgtcgacggcgaactcgatggatgggggccatgtctgatttcgttgtgggtggtgcaggggagctgaagaagatggtggcggcgcgaacggggctgcatccggacgaccagaaggtgatgtacaaggacaaggagagggactccaaggcgttcctggacatggccggcgtcaaggacaggtccaagctggtggtcgtcgaggaccccgaggcacgcgcccgccgcctcatcgaggagcgccgcaatggccacctcgagaaggccgccaaggccgtcgccgccgtcaccgccgaggtcgacaagctcgcccccaaggtaggcacccacccacattgcccgccatccatggcgacgccgacgccgaggtagtaggctcacctccgattggttggttggttggttggttggttcggcaggtggcggcgctggacgcgtcggtgaggaagggggagaaggtggcggagaacgacgtggtgcaggtgaccgagctgctcatgaacgagctgctcaagctcgacgcggtggtcgccgacggcgacgtcaaggcgcagaggcggctacaggtgagctgacgagctacctcgccgcctcctccaatctccaccgactagcttgaccgccatggttaatgagctcaacctgttcgtcccatgactctgcaggtgaagcgcgtgcagaagtacgtggagacgctcgacgccgtcatggccaagaacgccgccatcgtgcgcaagtccggcgagaagctcacctccaaacaacaccatcacccgccggcgaggcagcagcagcagcaagctcaccaacaccatcagcagccggcggcggggcagacgcggtgggagatgttcgacctgctgtcctcgctgccgtcgacgtcgtcggcctcctcaacgaccaccgtcagctcaacggcctcctccggcgcgccgccgccgctgccgccgccggcgaaccggctcgactggatgctattctgagcacacacatcacagaatcggcagatgcaatggtggtgcttggttggcaagaattgcacccatgtccggaaaatccgaggtgtcctgtccctgatgagatgatgatgaagatgatgattgaattgccctggattatttgctgctgctctagcaatttggttggccacattacatggtactactaccacttctagatgagttcagttcatcatgtgagagtaatttttttttaattttgttttttctttctttctttctttcttcttcttcttcaccatcaaatgtttgatattcttttgtgtgcatatattctgagaaagagagagagagagagagagagagaggaaattaggggggaagagagaaattgaagtgtattcagattgggaataagtcaaaaagggttattattgttctccaattggcgtttgaagaaaaggcaaagaaaatgttgtacccatatggatacagataccaatacataccgttcttgataaggggagaggccatggacttggactgtggatgatgaattcttaaatctttttattattatttcctgttagttgttatgattaaaaaaattgtttctttcttctccttgttgttgttggtgttggtgttgtctgtgttcttgagttagttggcgcctatctgtcaggcttgattcctttcagaaatgaatagtgcaggggttggtgtgcatctaaatactttattgctgtgccacatttaggtgttgcatcaagccatcagagtccgagctgttttgttttaggtaaaaagaagaagaaaacttgcgagttgctttggcctatttggcgattattacaacaaactaatcagctctaatgaatgaattttctttcttttcctccttgttgattcagcttggatgtctgatgaaatgagagatcaagcgttgattgattgattgattgattcaattaattactagctggttgccgttgcagtgtcagtattgagagagtgaagcatcatgtgtgtattagtgatgtattagtagtggactagtcattgcctggtggttgagctgagcttctcctcttgtgcctgtcacatttgcaattgcattgctggctagagagagatgttgccttccttcctctcctctcctccaagctaatgacaccaaattacatgatagtatccttccttccttcttttgttgtttcttttaaagttgggctatttatttctgaaggtaatgacatggtaccatctgccaattagcaacattgcatggttggtgctgaatagagagagagttttgagtcacatgtttctcgagtgatgatggccaatctttccttttctttaatttggtgagagatcatactccacgagatggcgtggaaccagcttgttaaacactgatttattcatgtttaaataactaagaaaaacaacaagagaagaaacaaaaagggccaggtaacgagtctaacggcagaaggattctttatcatgtatgtctcgtcagagttgttcatcagccaatcgtcatcatcgatttacagtcctcaactaactaatcataagctcgtcaggcagaataaaaatcctgaaaattccatagataaactagtcatacttggccaaatacatagcttaaaaataaagtgtttttgaaggtgataatagtaaagtttgaactgaaattaaggtggcaactggtgctgtaggtgagtctagaaatggggggatgttggttacgtggtcgccgtcgaggggtgagaacaaaggagatggtcggcgttcttgaaagcgaccactcccggcgaacttcgacgacggacacatggatgaacacgcttcctcttcgcctacaccgacgccgccggcaatgcagggcaacgcgcgtttcttttcggctgatcggtttggctgattagctacctgcacgctaaaacatgagaaacataagggtgtagttatatttatggcgtcatattttttattaaaaaatagtcggcatgtatttacattgtaagtccttaaattacatatgtaattttagtgtatttacaatgtaagtctcaaaattacatatgtaagtaataaaattacatatgtaaattcgaaaattacatactaattacatatgtaagtggggtgtaaatgaggtgtaactactgtgtaagtggctgaaaaaaaatcgactgtagcatatgacgccatatttctagcaactccgaaacataattattaactagctgggtggtggcccacgcaattgcgcggctagcacccaaacaaaatcttatatttttttatgattttacttaaaatttattaaatagctatctcattgtcttaagactttgaaagaccaaaccttatcatcctcgtgtttctaatatatagtttgtaaaagtcacaccagttgctaccccttatgtcatctcttcatttttataatttctagatgtcccgtcaaacgttgccactatactcctctgcggcccgtccactgtctcctctctttattatcattgagattttaaaaatcgaacataattatcgtttgggttcatttttactttctagaagtcccgccaaccgtcagcggttttgccattgtactcctctacggctcgtccgctgcctatctttttttattgtcattgagattttaaaatcaaacatgattatcattggttttttttttactttttagaagtttcaaacctttaaaaactggacttgtagttttattttttataatttttagaagtcccatcaaacgatgccactatgcccctctacagcctgtccgccgccaaactctttattgtcattgtgattctaataatcgaacataactatcatcggaattcattttttattttctagaagtcccgtcaaccgtcggcgactatgcaattatactcttatacaccccgcccgctgcttcttctttttattgtcattaagattttaaaaattcaatatgattatcaatgggatttgttttttttactttctagaagccccggcaaccgccttactcgtttgcttcacggcctgcctgacgtccctccttttaatcgtcattaggattcaatttggtgttttattaacaattttatatctcgtatcaaccgccaccactctacttctttataggcttgttacttaatttatctcgtcatgtgtttagatggtcttttcttttaataatctatatttttatcacaaattttagttatttttaaattgtattcctaattgaaatcttatttttctttttctaatttcagattttcttaaaaaaaagttaatatcgtattgtgttatttttaatgtttttattttttattttcaatttcagttgttttaaaattttattcctacttgaactctcttttaatttttctaattttagatattattttatttttattctaaattttaattaatctcgtattgggttcttatatggattcttctttcaatgttgcttatttttaattccaaattttagctaattttaaattgtattcctacatgaactcttattttattttattttcctaatttcaaatttatttatttttatttcgaatttcaattaatcttgtattagattcttatatggactcttcttttattattcctaatttttaattccgaattttagctattttctaattgtattcctacttggactctcgttttcttttctaattttgaattttatttcattttatttttattttgaattttgattaatctcgtattgggttcttatatggaaacttatttcaatattccttatttttaattccgaattcagctatttttaaattgtatttctacttggactctcctttcctttttctaattttggattttattttatttttattttgaattttgattaatctcgtattgggttcttatgtggaaacttctttcaatattgcttatttttaattccgaatttcagctatttttaaattgtacttctacttggactctccttttctttttttcctttttctccgattaatgtgggaatttctagctcccacagcgaatgtggtgcctcctttcaaagctgttttaataatataatagattagcatataattaattaaaaaaaatactttatatgccctaaaatatatgagattttgattggatgaaatacattgtccataattcatagtattagaatgtattctatgcaaccaaaataccctatattttggaacgaagggaataattattagaaacatgaaaaataaatttagtttggctttttagtattaactaaaaaaatttcatacaaaacataccatttagcggtttgaaaaacatgttaacggaaacgagaagtagctatgctcaattagatcttggggtcttaattctcgtcttctcggctaattaatatgtctccacgtttaatttaactctcggatttcaaaccttaattcagcccatgatggaaaaattaaccaaccaagcaaacattaaaacgatgaaaataaagtttgatttcttcacacagatccattaccccatcgattcatctatctgtccatgctgaaccaaagtaccaaatttatgccttacattatcaccgactaataatgatacagcaacagtgacaagtcccggtactgattgcacaagctaatcatgtctatctaataatccggagtatgaagcaaagattcccggccgctcggattgatgaacaaaggcgaagcatcacaaatccaatgacagatcgatcaagcatatgtactgtacattacataccacgatatgatagctagcgcgatcaagaaggccatgcccaattgccaaatgatccagtgacaagcaagctgcagcctgcagggatcggagcagggggacagagcacaagctgaacagtgctcacatagctacagacacaggagcagctgctctctttgcatcgaccaaagatgctgaattgctgagaccacgagtttcagatgctggtgcttgatatttgctgtattctttcttcttctgaattttgccggtgtgcgagttcggctgtgcgtatcttagttatgtagagatcgaaagtgttctcggggaccagaagatgctgatcgatcgatctgcagacaatgcgatgcataagtgcgtgtctcgttctgatcatcaggtgaagatcgagaatggctgaaactgtatatgtgcttgtttgatgctgaatccacagatctgacagtgccatagaattattggcgtacgacgggtacctcctcaggtttcagacagcacttgccctgaccatgatactgttatatatgctgcctgccttttagtatggctagattagattcttcaatctcattccagttgtaccgtgtggtgaaaaagttaaaactgtcatcactggtgaggatgacacaagagtaagtactgataatgccttgaaactgtaggaagaacataccaggatcttctcttgctttgtttgtttctcaaatctcttcttattgatcatcagaattcagatggtgagaggcgagcaagagggagagatcatgcctaaagtgaaaatagccgtactcactactacagaacttgagctgttgggcatattgatgagtcacttagaacatcttcaacacagagcgaccatttttgactctcaaaataactatttggccagcctaacaaaaatttagagagtcaaacttatcttctattccaacagcctctacacatttcactctctattaaccaatgtaccccacctgtcattcttctcctcctctttcttcttcctccactctccaatcccctgctcgtgctagcggggtcagcggcggcgacgctgcggaggcggtggcaaaggcatcgagccgccccgctgccgctccctccctcccttgccgcacatggagggcgacgacgacggcgtgggcaggcagatcaaggaggagaaggagccattgcgggaaaagggaggtgggggggggggggggcaaagcagccgccattggtgggtggaccatcctcgccgaccgactcctcatctcctctaggtgcgctgacctcggcaccccgcaccagtcgcgtggaggcggcggaagtcgctcggtgacggcgcagatggtggcgatggtcgcggctagcgacgacggcggcgctggggcaatgcaagagagaatagtcggcaaggagatgggaggataatgtgtgtggggccacagttggccagtgatttttggttggccaagtttggccagtggaaggagggttttggccagccgggttggagaggctattgaaggacgttttttgactggaacggctaaaatttagcttagagaatacttggagaggctgttggggatgctctacgggtcagtgtgtcctgtacctcgttgaacttgttgcatgactaaatagtaaataccattaaggggccttttgtattgtaggattggcaaataatttttctagaggattcaattcctttgggattttctcctatagaactctttattcatataaaggtatatattttttaaacaaaattgcatttctatggtcaaatttgtaagaaaataagtaagaggttacacctcttggaaactttccatttttttactgtggtgtaatcaaaggtcatacctttctgtttttctgtattttcaatttctgtaggattgaagcaacacgttatttcaattccaacagtttctctatttctccttttttttttttccctatcccacgtttaaaaggggcctaagtagctgtagcacatatagcaaaattgctttgacaaaaatagaaaagagaagtaacgggtaggagatttgggtcgggttagggcccatctgctgcgaaacagggtgaggcccataatagcagtaatgccttggcccatgaaacaaggcttgaaccgtaacatgcttccaacgacgccgtctgccgtctcaactactctctacttctctagtctcaactcaggcacgagttcgttctcgtcttggtcagctgggacccacaaagagcttccttccgggactgtaacgattatttattaaacatatcccaatttgccccgttttgatccgggcacatccacaacttacacggattttcggcacttatcctccacgtttggctatttacaacttacaagacactgataactactataaatttctctcaatattgtaacactaaaacttgagatatgagtcaaactgtctcacgatattttgaacccatctcatacaccacattaataacattctaatccgtgaaagcacctgcaactctcggtgacgaagagccaacatcgggtgccaaaccttgatccaatgtgaaccacctgtagctcatgaagatacacgttcttattttttttttgacaattttttgccaaatccaagcaactgactattataatcaaacaaatggataatcttatttttaatttttcttataggcgcacgtaaaaatgttgatatatgtgcatggagatggttgatagatgcatgtggtgctttgtgttcttaattagtatcatggttttacttctaaaagaaattctaactatgtacacttttgagtagtgttttattccattaagaaacaaaatttgatgatacttaatgtttcataacacgaggatttgcgcttgtggatttgtgcatgtccttagaaaaaaacatctaaatttgatcataatatgatttgaagttaaaattttagttacttttttttagaaaatttaccgggagggagagctttcccacctgaattcattgatataaggagttgaaagttcagtttatccaattatacatcaaaagagcgaatagtggaagaaaatagagacttccacgccgagattacatgacgatcatataattttaaccgctcagcccatagagaggcttccgaaacacacataatgcatacccgacacagggaagcttcctcatgccggaagaccacaccatgacgatgattccaaagacaccagaaacaaagtaggtagaacaccctggaatgtttgttgggaatttgatgtggcagaagaagagaagccagctcacacattgacgcaatgttgacctgaatattaaggttgtcctaaaaagcagcagcaaaggggcagtgtaggcacagatacgaagccgtttctttagccgagttgcaaagatcacaggcgggggtggacacaatgttcttcttacaaaggtttttcttcattgggagccgatctttagcaaggagccaggcgaagaactggaccttgagcggtgctttgttgttccagataaacttccaattgaggcaaggaggcagttcactgcgttggacaagatagaggtggctcgtcttcagaatgtcactagaatatttcgagtttctcacatcaggtctgtcatttgccgtggtatgctcagtcaagagaacacgaaggtagttaaattgttcagccataatcgacgacaggcggagagcaaagtgatctctcaaatccatagaaaggacctcggtaaccgagtcttgcttgccaagcgagtgcgtgtagagtggttttattgattaaacataatggtctcacaatattttagttaccttttaaagaaagggttaggctttattgattaaacataatggttacaatcccgcaaaataagataatgtacctttactattgtgagacgtgacattactaacaaaaataattatttggatagggagactcggggttttcaaaatcgtgcagttgtcatataagataaaccttctcagtttttgaaaccacaatatacctcatggtaaccgtacggttttcacggtaatcgtacgattatcacagtaaccgctaaagcgtggggtgacggtaacccacctaggttcggtgaacttgcatggagtacacaaatcatacggacttgcaaaacaggtgcgggtacgttcccaagtgcgcgtagcaaattattagacgtgcagagggtggagtcgctgtcccgatctcctctcctaataaatcacaacttcgcttctcggttggcagcagcgatttcatccaagcaccacgccgccgccgccgtcgaagccgatctcctgcgcgcggagcggatcgcctctgtcaggtacgacccgccctcttcctcctcccctgctaatttctcttcgcttcgtcggccacgccacgccacgcgcgttcttgccaaccttggtctcgcgagcagcgaggatggggaggaggagaggaattcctctcgaattgatcgccggttgatgcgcccggcttgttcctcttctgcggcctaattttgtacgagttcgggggttgtttaggtggagaaatttggtacagattcgattttacccttttggtcttcttcttgtgcgtccatgccgccgttcatcagctacggtgaccttttccagtctagcttttggaaggggccgagctcccagccatggattagctatcatcaacttagtcaagtgacttgtcgagttgtcggggtgtagttcactgtctaggtgttctcaaaatcaccaccttttatagtggcacgcctcttaaactgtatccatgcaatcaaatttaaatcacatgtcattgagttaacctttatgctactttacaggccactgtaaattttaccgagtttatgaaattgtgaatatgtgctaaaggttatatgagctcctttttttttagcagagcctgctgtttaaattatagtcttataggtagcctgatgagtgatgacaaaccttattctgctactgccaatttttccgagattctttaaacctttagctgttagccctgttacattgctttcggttttggcaatttcttcgttatcactatgcaacagagatcacgactgagcctatattatttttggaattaatttgtttcttttcctgcttcaattgtgtccctgattctgtcacggtaatgctcatctattcactgctataattgtgacccaacatcttatcaccgatgcagtcaccagctatacagtatgagttcactggagagtgcaagagcagatcttgctctgcttattttatacctaaacaaggctgaagcaagagataagatctgtagagctatacaatatggctcgaaatttgtgagtaatggacaaccagggcctgcacagaatgttgacaagtcgactagtctagctcgtaaagttttccgactttttaaggtaaagttttaatccttgtccgcagtagatattgcaaatgagaagctattttttcataccttgacatgatctgtggcaccacattattttgcagtttgttaatgatctgcatgctttgattagtcctcctgccaaaggaactccactacccctgatcttacttggaaaggtatgttgaagcttgtattgccttgtaggaactctgagaacctaaagatacgttttttcacttctcattgtatctttttgctttgtgccatccacagtcgaagaatgcactgctatcaactttcctctttctggaccaaattgtatgggctggaaggacaggaatatacaaggtttgattttctcttcacatcattactgatatacataagcaccatacagcatatggttttatcatacctagatgttgacagtagaaattaatggtaggtaatctaattgtttgtacagaacaaggagcgagcagaattcctcagcaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatcttgcttttgatgacataatggcgtgtgatggtattggcagaacgagcaataccagatgaaactgcagaagtgcaacgagaggcgtctcgctctcatcaaatcgagcctcgacatagttgttgctatagggctgcttcaactggctcccaagaaagtgactccgcgtgtgacaggggcgtttggatttgctagctcactcattgcttgctatcaggtaccttaactctcacatattgtcatgtggactatcgtctgtttagagttagcaactgcaaaacctgaaactttcattttgatctgcttatttcctctgcagttgctcccagccccagccaaatccaagtgatccacctgaaggggtgtcagtgggcagttccaatgttgcaaccagtaagaaataaaagtggagctgcttgattgactcatgtggacttgaaaatcctttgtgggttatggttaatatgatgatctagtggattgctgcagctgtaattttaaggtgcagtacttgtgacaaaaaataagaaacttagcatgggaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagcgatttattgagtgaaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaa

SEQ ID NO: 35545 - DNA, 1739 bp, Oryza sativa
  unsure (1)..(1739): unsure at all n locations
nnnnnnnnnnnnnnnnnnnnnnnnnnnnnnnnnnnnnnnnnnnnnnnnnnnnnnnagaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagctatttattgagtgaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaaactcacacgtaaacttaacatgattttctagacatatatatccaagcgaattctcacagtgaactataataagattaaaatagcattcacccgttgcaacacacgggcatttttttaagtaaaattaaagtatttgacatggatagcaaatataatatattttgaccatacaaaataatatttctgtgcctcccttcgcccctccctgtcttcgcccttaagtgtatcgactcacgaatccatccatagatcaaatagatcgataacctttatgtgggggaggagtgcgcgtcagctggtcgggctagcgagagttaagccatggccgatcgaagcaagcaaacagccactttgatatgtaatgtaagcactgtacagtattttaccatgaatcaaatgattagaaaaaaattaataattacttaaattttttaaataagatgaacaattaaacatgttaaaaagaatcaacgcgcgttaaattttagagacggagagagtattatattatcattattgtatgtccacatgttcttttttaggggatatgtccacatgttatgaagcgatactgtcacaccctaaaaattcaaaatatataaattgttgtttaattggaatttttagaaataattttaaaagcctagaagagaagatctaattttttaattaataaattccaatataaaatggggccagataaaatttcattaaatactttgcttaatcctttaattcctagatttttctgggatttatttgagctaaggaagtatttttaataaatggaattgcatttaaggaataatttaaattgaaaaaggttttaaaagtcttcttttggctttgggccgaaagtcggcccaaaacccttctctctctcctcggcccagttcggcccagtccgcagccgccgcgcccacgcgtccgcccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatcttctctaccttttctcttttggaatcatcggctaattctttttggaaatcgttggattcgagttcgaatcggattcgtctctttcct

SEQ ID NO: 35546 - DNA, 651 bp, Oryza sativa
  unsure (1)..(651): unsure at all n locations
tcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaatnnnnnnnnnnnnnnnnnnnnnnnnnnnnnnnnnnnnnnnnnnnnnnnnnnnnnnnnn

SEQ ID NO: 35547 - DNA, 459 bp, Oryza sativa
taaaccaaagccactgaattctcctcaaaatactactacaaaaaagatcaacaagttgctaataacaagagatcaacttttccttttttttctttttgtctaacaactcttcatcaacagtctgaaacacgcaggccggcggcacaaggtgacagacagtctgagctccaccgacagtcaagagtgtcgcgcgtgtggggcccacctggggatgccacgctggcactgtcaacgctctcctcttgcctgcgttgaccgaggaaagagacgctggaacccacctcctcgtctctggttcctttcttcctcctctcttcttcttcttcttaagttcttcttctccttaatcagctttgctttctgatgaaaaaaagacaggtatttgattccaaatgcagccaaccacgttttgatttgcacaatggtttttatttccttttctttggcgattgctttctg

SEQ ID NO: 35548 - DNA, 681 bp, Oryza sativa
  unsure (1)..(681): unsure at all n locations
nnnnnnnnnnnnnnnnnnnnnnnnnnnnnnnnnnnnnnnnnnagtagcttcatcttaatatcagcagattgaacctgtcgaagagcttctactggataatgaatctgcatttggaacgtttgttagctctagtttttatttcaaacaagtagctactttcttaaggaagtacgccaaacggaggaaatatcaagtataagccatcttatcactatgaacatgtggagcacttcaaacaatcagcaactttgataatgaaaaagggtgggtacatacgatttcataatttgaactaaaagaaaggagatattctcagtgaataatggttttcttatcttttaaaatgttaactaaaagtttggtcctttatgtatcccagaacaccgatagagttacacttacaatatttagctggagaacaattaagtaatggctacctacaatgtttcaagacagacaagtgctttgccactataatgtttgacagaaagagaatatctggcagggaatatgctaaacaaagaaaactgagttgacaaacacctgttgctaaaagtaatctcttactgagtgttaccatgagataatcgtcaggattgttgtcaattacaaatccatagaggtataagtagttctgcaagtaacaaaactatgtcatttcatcagcaactatatttcagt

SEQ ID NO: 35549 - DNA, 923 bp, Oryza sativa
tgaactgttatagttggctatatggtctgctaattctacgctaaaacaagtttgcttttcacctgccaagtgccaagtgaagtcatggcaaccaaatttcatgtaaatgctctgaattagtgtgactactaagaacacaagactattcaagcaagaaatcctcacccgcaacttatagaacaaggcaagggcctccctccacaggccatgcacagcaaatgccatgatcatagagttccaagaacagagatcctgctgacgaccgataccctgaaacacctgccaagcttgtcgaatgctgccacacttggaatacatctccagtagtgcattagccacgtacacattcctcaggaggccttttcccctcgcatactcctccaccttcctcccaagctccatcgccccaactgctgcgcatgcaggcagcacactgctcactgtcaattcattcggttgtacccctgccctctcccacatctccaagaacgtctccaccgcttcctcatgccgaccgttctgcgcgtacccagacaccatcgcagtccaggaaaccacattcctatctggcatttcctcgaacagcttctctgccgaatcgacgaggccgcctttcgcgtaggccgaaagaagcgcattgtacacggccgtgtccctgcacgtcaattcgtcgaacaccttcctggcttcaaccaggagcttgctcttggcgtagaatgagacaagcgcggaggagaggaagggatcgcttgatgcgaagtggcctaatttgataagcagggagtgggagcagaggaagaagggggtggaggaggaggcggacgaggaggaggaggagaagaggagagtgaatgacagcggagtgaggaggcgaaggcgatggaggcgggagaagaaggggaggaggagggggtgggggcggt

SEQ ID NO: 35550 - DNA, 4904 bp, Oryza sativa
  unsure (1)..(4904): unsure at all n locations
nnnnnnnnnnnnnnnnnnnnnnnnnnnnnnnnnnnnnnnnnnnnnnnnnnnnnnnnnnnnnnnggtgggggcggtggaaggaggctagagcattgatgaggcggttgtggagcggcgcctaaggaggcgccgggtaggattcgaggaggcgcgcggcgtaacactggacgccggcggtgaggactctgaagagcagcggctgcagcaggcgcaccccgcggcggagcgcgcgcgcgtgcagctgcttcgcctcctccatggaacatgggaaacacaaggcaccgtgctagtcgtttcagacacgacgacgccggcggctcgagaggatgctgagctcactgacggtagtggaccggagaagagcgcggccgcgccgtcggcggcgggcggcgaacggcggcgggtggcgggtggctggtggcggcgagagatcgtcgctggagaaggtccaaagagtaggagccgaaaaaagaggcccatctagcagattagtactagaattcttttttttttctctctcgaagtttcaaaaaagcatgaaaatttttacgtggtccccttacataacatggaagtttatatctaagtttcaagtttttttatatttattttctagaaaaaaatatatttgtatggtatatttgagagaatttacttacacaaaagataataacacaaaaatatcttatgtggcatatgaaaggtgatttatattaaaaacaccaaaaattattttgtatagcataacacaaataagttatatattaaaaaaaattgaaatgcaaaaaatttgaaacttatatacaccatattgtataaggaagccatatgaaaattttcatagtttttttaaaacttctagataaatcgattgttaatcttatatatccatagggtattttcaaacaaaggttcggtccaatagcatattatataacaatagataaaattattggtatattgtaaaaagagataatatcagtgataaattatagaatagattctctcaattaaatatgcgacggaagcgtccctttcaccaccttcttctaaagtggcaaggcaaaatccaatgaaatatctgaaccaaagcgaccacgtgagacggctcgcagcacacacaaccatgatgtcccaccacgaagcaagtgtgccaagttggcaggaaacctgctagtctattgagccacttggcacctccaaattgctagaacattagaatcatctaaaaaaaaagaataaaaatctttaggagcataaacttccggaaacttccatgttgcatattttccaaatactcttttccccttttgcactatttcctttgcaacagtttaacaataacgacaaatttccatcaagtccccaactgaagtcaacaaaagaatatcaaaatggaaaaaaaatagcccttctatttccttttgaattgcttgagtaatatgtctagaaaactactgataacttggaatgatcatatctagtaaatcacatgcatatagcgagtacttttacctacttctctatgcttgagagaatgtaagaaacaaaatgagtctaatactaaatatatttaaaaaagaaattatattctctaccttctgtacaccactaataaatcaatatgaaaaatttagaatatgtttcatatgaaaatattaggaattctgattcttagggataataggaaaatctcgatatgtcataggttaaatagaaaactaaatggcattcactaattattttatattatgcaaaattgttgtattctaaaggagaatatgaattgtggaagaatgccaataagtccaataggaatacgaaaggtgccccaatcgatccaaccccgaggttagactcatgagagctagctaagggaattttgaggtttttcagttaaagaaatatattacatgttaagttagaaattaataacccatcaagtggtccttctaggtgttgatagaaattcaatgggatatgaactaactccataaaaaaaagttcttaacttttgtgtgttctaaacatgacataaacaatatagaagtacattgacttattaaaaaagtacttaccaaccgccttatttgatatttatagtttgaaagaaaaaatgaatataactttttaacaaaaaaatgacacataaatatttatgagctatttgctgaaataaattaaaacatatattattttagattttttataaggatggcagtaatttagataataaaactcataatataacaactctaaataatacagcaaatagtgaatatctagaatataataaatgcagtggctaaatccagtgggtgcaccaacaggggcatcgattatctagtatagaataaatgctctcaattaaatatgcgacgcaagcatctctttcgccacttttttctaaagtggcaaggcaaaatccaattaaatattgacgaaccggaggaaccaaaacgaccacgcgtgagaactgagaaggctcgcagcacacacaaccatgatgctccaccacgaagcaagtgtgcaacaagcgcgagaggaagaagaagagcttgatcaccatggcgatccgatgatcacctcccctctctgtgagcacccagaacccagaagcaagatcatatattgttatttcattttcctttttttaacgaataagatcaacgagattatatatatatatatatggccttcatcgtatatatgttgctgactgatgatgctcgtgcacagtgcgaccatcgacgtcgggcagctcgccggagaatggagaggaggagaactcaccggtggagctggtggcgctgacggtgccagtgagcgacgagccggagacgccggtgctgacgttcaggatgtgggtgctggggacggcgtcgtgcgcggtgctctccttccttaaccagttcttctggtaccgcaaggagccgctcaccatcaccgccatctccgcgcagatcgccgtcgtgccgctcggccgcctcatggcggcgacgctgccggagcacgccttcttccgtggccggccgtgggagttcacgcttaatccggggccgttcaatgtcaaggagcacgtgctcatcaccatcttcgccaactccggcgccggcaccgtctatgccatccacgtcatcaccggcgtccgtgtcttctacgggaaaaccctctccttcttcatctccctccttgtcgtcctcacaacacaggtgcatgcaaactagcttctgcctaaacatttaataaattaagttgtcaacgccctgatgctagattagcttaattacctggcaatcaaaaatagaaaaaaatatttcttccttctcatgcgtgtacgatacagtaccatcagatgctggggttcggctgggcgggaatattccggcgttatcttgttgagccggcgtctatgtggtggccatccaacctagtgcaggtctctctgttcaggtacactgcttgaaaaccagagtagatagtatgacaaaaaatcttctcaccagagttgaattcttgcaaaattttgatccactcaaacctccacaccggcaatgcaagagtctgaaccaccacatatgttccacttggaagttggaaccgctgcagtgctgcaccgaactacaacaaaaatggaagaagaaaagtgacatagttaggagctgagggacctcttatatattttctctattattttttcaagaagcttccctagctaagaatgacaggacaaacacaaaccaaattctgtttgagtatagtaagaaatccaagatttaaacatatgtaaaactaaaactaaaatggagttgtgcatatacacattcttagctctgaaacgacaaagaagtttgcatttgcattccgtaagaaaataacttacatatttcttatactagcgcacttcatgagaaggaagcacggagaaaaggtggcttgacgcggaaccagttcttcctggtggcattcgtctgcagctttgcatactacatcttcccaggctacctattccagatgctcacctccctctcctggatctgctgggtcttccccagctctgtccttgcccaacagcttggttcaggtctccgaggcctcggcgttggtgcaatcggtctcgactggtcatctatctcctcctaccttgggagccctcttgctagcccatggtttgccactgtaaatgttggtgttggcttcttcatcgtcatgtacataatcacaccaattgcatactggtttaatttctacaaggcacaaaatttccccatattttctgatggcctcttcacctcgactgggcaaaaatacaatgtatcaagcattgttgactcccatttccattttgacaccaaggcctatgagaagaatgggccactatacctcagtacttcccttcttgtcacatacggtgttggttttgcaacccttgctgcaacaattgttcatgctctcctcttccatggaaggtatttttttttcttagattcgccactccactgtctacaatattaaaataatgtggttaagaaccatgatacttgtctccagtgaaatttggctattaagtaaatcagcttttcaagaaaaaaggatggacatacacacgaaacttatgaggagatataaacaggtccctgagtggtggttcatatgcatccttattgctaacatcggaacgaccatatttgcttgtgaatactacaatgaggaactccaattgccctggtggggtgttttgtttgcatgctccattgcctttttcttcaccctcccaatagggattatcaaagcaacaacaaatcaggtatgtggatttaacacattggacatattatgtcatacagatctaacaagttcaccttttttcattatatacagactccaggcctgaatgtcatcac

SEQ ID NO: 35551 - DNA, 1208 bp, Oryza sativa
aaaaattctccgggccatatttgaatttttcttgtacgtattttagtgtttgccaatttcttttcgaattttaattaattctattattccttttagaagatgatttttatttcgggatgaatttatcaggacgtgacaaatccaccccccttacaagaatctcgtccccgagattcgaggaggctagcaagaagataggttgggcggtcttctcttcttgtctgacttcttccgctccgctttctataacaaacttgcctaacaaagcttctccactctggactgcttggctcgatctcctattgcagatggaatcttctctgcacctgacttatccctggttgaacctttagctgacttcgactgggttgcggcacttgaagatggggattcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagggaaccaacttatcccacttgatatactttgacgtcttcccaaatagttttactgctggacttcttattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaacctgggcttgcacttttcactccgtgtagcatctgataccgagttgaagatttcactccttgccttcatagaaacccttttacctaggtcatcttgcttacttaatgacagggtgactgttgtgggggaggcaattactatcaggggtcttccttgagcgatgcagagcatgtttcttgttatcaatcaccttttccggctacttctttcatgctagagaacatctttggcaatctcttttat

SEQ ID NO: 35552 - DNA, 637 bp, Oryza sativa
tgctgggcgttctcggccgtggcagcgatggagggcttcgccaagctgagcacccggaagctcatctcgctgtcggagcaggagctggtcgactgcgacgtcgacggcaacgaccagggctgcgagggcggcgagattgacggcgcgttccagttcatcctcagcaacggcggcctcacagccgaggcaaactacccgtacacggcggaggacggccggtgcaagaccacggcggcggcggacgtcgccgcgtccatcaggggctacgaggacgtgccggccaacgacgagcccagcctcatgaaggccgtcgccggccagccggtgtcggtggccgtcgacgcgtccaagttccagttctacggcggcggcgtgatggccggcgaatgcggcaccagcctagaccacggcgtcaccgtgatcggctatggcgcggcgagcgatggcaccaagtattggctggtgaagaactcgtggggcacgacgtggggcgaggccgggtacctgaggatggagaaggacattgatgacaagaggggtatgtgtggccttgccatgcagccttcctaccctactgagtagcttagcaaggtgttgaataattgtatacacatccatatatattgtcttgtaatgc

SEQ ID NO: 35553 - DNA, 457 bp, Oryza sativa
aggtttgccaatttcttttcgaattttaattaattctattattccttttagaagatgatttttattttgggatgaatttatcaggacgtgacaaacgtcgacgggaatggcggccggcggcaatggttggtggccggacttggcgcgtccgttcccgaggattgaaggcaccattcaaggggaaattaagggggaaagagagaggagggaaaggggattaattcccctcaatcaatttgggaatcccatgcttgaatcgcgtggatttgagggaggaagggattagggttcacgggagagagagaagccgggcggcggctggaggaagaaggcgacggcggcctgacgcgtgggccccacgcggggcgcgcggtcagcgcgcgcacgtgcgcgctcgggcgggagggcgccgctcgggttgggccgggcggccggcccaggaggggggggaggggga

SEQ ID NO: 35554 - DNA, 765 bp, Oryza sativa
ctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagttttttggagtaatgcccttctccactgcagttgtgacaaacaataactttcttacactcgggttcttcatcttgtacttgatttctcagctgctgtattggagcttccaaaggtacaacgcagatactggcatctgtcttgtcaactggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcacagatatcttcccggactcggcattttcttttctcatt

SEQ ID NO: 35555 - DNA, 724 bp, Oryza sativa
ctcgaccgcgggtgctgcggcgtggggcggaacaacgggcagatcacgtgcctgccgatgcagcagccgtgcggcgaccggagcaagtacgtgttctgggacgccttccacccgacggaggcggccaaccggatctacgccgccagggcgttcaactcctccgccgccgccggcgacgcttaccccatcaacgtcagccagctcgccgccatatgaatccaatgattaatctcgctgacatatgatcgatcattgatcaatgcatgcacttacttacggcaagagcagtgtatctcggttggaaagaattaatgttgtacccctcattctctaaatgtttgacgttgtcgacttttttaaatatgtttgacaatacgtcttattcaaaaacttctgtgaaatgtgtaaaactatacctcattccctaaatgtttgacgctattgacttttttaaacatgtttgaccattcgtcttattcaaaaacttttatgaaatatgtaaaactatatgtatacataaaaatatatttaacaatatatcattttcaaatgatatgaaaataattaataattacttaattttttttaataagacgaacggtcaaacatttttaaaaagtcaactgcgtcaaacattttgggatgaagggagtattgtagtagtatataggtattattatcagctattcccatcgttccataatataagggattttggtcggat

SEQ ID NO: 35556 - DNA, 493 bp, Oryza sativa
tatcgaaaagcaaatctgtacgacgaccaaatggctaagtggtgtaattgtgtgtcagtccagtccaagtccaacagaaaggttggcagatgataccccaacggtgttgcgctttctttttgtccataatttctatttctagtttttttttaaaaaaaaacaagcggtcagttaataaaatacggttggaccaactgctttctaattttatcccaaaagattgctctccaatggcaaaaacgtaaaagcaattctaaggcccttcacaatgcggggacgtggaccggtgctccaccgcgctagctaggattcgcgcttgcgtggcgtaaggttgcgcgtcccaccagaggcgctcgctcccgcggagggaagcgcgcttcctcgctcgcgctggagcagagtaacggctggagcctacactgtggagagcgtgcctccgactcgccgtcacctcgcgcccttcccgttcgcgtcgccgacctcatcgtcgtcc

SEQ ID NO: 35557 - DNA, 3991 bp, Oryza sativa
caacacgtgaggaagatgtgtcttgtgggtaaagatgtacacctttgatcagagtaaatctattcgaatagccgagccctcggatatgggcaagcctagcaatgtacccaagtcagtgtttaattcttaaaatttgctcaacaactaaaatgtggaatggttggcctgggttggcttgggacgagctgggacccaggtcgggttgccagttcggtctgaatcatcgtaggccttgggttaaggcaggttcgtgagggttcatggccttgattaataacagtgtatagctctaggatcgtgtttacaaaatagcttgagcaactaaacgtcttcaaatgctgtttactgcaactctaaccccttatattataattcccttgtactcccttgcatttattctgcatttgtgggtgtgtcttgttgagtacggtggttgtactcagtcttgcttaattttcccaagcccagatgaggagctccttgaagatgaaggcttcggtgtctagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgatctttcaaatgttgcttttctttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgttctcctcgccatcggcacccttcaccagcgctacccggacgagttgcagcactcgccctaccgctaccaccctcgtcgcggaggagcccgcgactacgccacctttcgagacgccagctcggagcatgacgctaccgtcgtgcatctggcacgcatggtggaggcatacgacgcagctcgtattgacttccatcagatggtgcgccgtggcatggtggagaacaacatgaagatcctggagctgcgccaagagaatttgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttcctcaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagtcgtgtggggcatggttacgccggtgtgtggtgtaactatgtcggggcctgtctttatttgtttgcctaagcaacttgaacattaatgaaccaatttaatagcagtgataaattcaagatttatagtagtcgtgggtggttagttttaatcgtcagctctccttctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctcacccaaatcctcgcccagcaagccaacatgatgaatgctttcctccaccacctccaaaatccgccacaacagaatgctccaccaccccctccccaacactccaaactcgccgaattcctccgcatccgcccacccaccttctctagctccaacaatcccgtagatgcgttggattggttgcatgccgtggggaaaaagctagacacggtgcagtgcagcgatgaggagaaagtcgtcttcgccgcccatcagctgcaggggcccgcatctctctggtgggaccacttccaggctacgcagccagaagggcaacctattacttggactcgcttcaccgccgctttccggaaaacccatgtgcccgccggagtcgtggctcttaagaaaagggaattccgagagttgaagcaaggcagccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcagcagcagcagcagcaacctcgctccgcgcctcgacctcaattcgtggtgcgcattccacagccgcagcagcagcagaatcagcaagggactcgtgcaccccgtcctcctacgccaactgtgcagcctgttcaaggtcgcagggacgctcaaggtccgcagcggctgtgcttcaactgcttcgagcccgggcactttgcggataaatgcccgaagccaaggcgtcagcaaggccaagtgcctccccgctccaacaacggcgggaaggatgtcattcggggccgtgtgaatcatgtgacggccgaggacgtgctgacaactccagacgtcatcgttggtacgttcctcgttcattccatccctgctaccattttgttcgactctggagcttcccactcgtttatatctgtgccattcgtggggaaaaatcagttgggggtagaaaggcttagaaaccctctgctcatcaccacccctggaggggttatgacagcaaagtattatagccctgccgtccctatagaaattcaggggattccttttccctcggatctgattctgttagacacaaagaacttggatgtgattcttgggatgaattggttggctcaattccaaggagtagtggattgcgcgaggcgcactgtcactctgtaccgaggaccggaacagccggttgttttctttgcacctccaacctctgtcagaagttcagaacttcatcagataggtctgtcagaaatccccatagtcagagagttcggagacgtgtttccggaagaactacctggtatgccgcccaagcgagagattgagttccggatatatcttgctccaggaaccactcctctgtacaagcgaccctaccgtatggcagcaaatgaactggccgaagttaagaaacagttggaagagttgaaagaaaaggggtatatacgtccgagtacttccccttggggtgctcctgtgatttttgtggagaagaaagacaaaacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgggaagaagatattccgaagaccgcattcaccacgc

SEQ ID NO: 35558 - DNA, 2763 bp, Oryza sativa
cgagaaggcgttccaaactctcaaagaaaagctggcctcctcgccagtgttaattttgctggatactcgcaaggacttcatggtgtattgcgatgcttcgcgccaaggattggggagcgtgctcatgcagacggtcatgtggtagccaatgcatcacgtcagctacgacctcatgaaggcaactaccctacacatgacttggagttagcagcggtggttcatgctctaaaaatctggcggcactatctcattgggaaccgctgtgaaatatatactgatcataagagtttgaaatacatcttcacccagtcggatctgaatcttcggcaaaggagatggttagaactcatcaaggattatgatgtgggaatacactatcatcctggtaaggccaacgtggttgccgacgctctaagccgaaagagccactgcaacactctcaacgtccgaggcattccacccgaacttaaccaacagatggaagccctgaacctaagcctagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaaccctatggaacggaaagcgggtatgcgttccagataaccgagaacttaaacagctgatacttcaggaagctcacgagagtccttattccattcacccaggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggccttccaaaaacccaaggtggatatgattctatatgggtaatagtggatcgattaaccaaggtagctcgattcattcctgtgaagaccacctatggagggaataaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagaccgatggacagaccgagcgtctaaatcagatcctagaagatatgctccgcgcatgtgtcctagatttcgggaagacttgggataagagtctcccctatgccgagttctcctacaataacagctatcaagccagcatacaaatggcaccctatgaagcgttgtacgggcgcaaatgccggacaccgctattgtgggaccaagttggagaaagccaagtgttcgggactgatatcctgagagaagctgaagctaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcaaacgaaagggaagcttgcacctcggtatgtgggtcccttccgtatcgttgctcgacgcggagaagtcgcctaccagctggagttgcccgcctccttgggcaacgtgcatgatgtgttccatgtgtcgcaactcaagaaatgtcttcgagtgccatccgagcaggccgactcagagcaaatcgaagttcgcgaagacttgacgtatgtggagaagccagtgaaaatcctggacaccatggagcgcaggaccaggaaccgggtaatccgtttttgcaaggtccagtggagcaaccacgccgaagaagaagctacttgggagcgcgaagacgaactgaaggcagcccatcccgatctcttcgccagttcttccgaatctcggggtcgagattccgtttaaggggggtaggtttgtcgcgtcccaaatcgactctaaaattcatcctcgaaattgtgcaaaagaataagtaaaattcaatgtgaaagcctccaacaattaaaatgtgcaaagataaaagtcaaatgaggcttggaggatttttgtatatttcctaagagcctaaaatgcttaaataaattttagtggaattttcagagcacaaataataagtgaaaagaaataaacaaagtaaaaaggttttataaaaagaaaatcctaaaagaagttcttttcccccccctttttccctcttgggccggctcggcccattccctccctctctctctctctttccccccggcccatcggcctccccgcgcgcgcgcgtcgcttacaggcgggcccgcccgccgctctcgctgacgggtgggacccacctgtcatcgccctcctcccgccgcgcccgccgccgcgcccgtgccctagcgccgccgccgccgcggattgcgccgcatcccgccgtccccgcgcgcattaaagagaggggaatcactccccgtgattccctctcccgtttcccccgattccccctctctctctccctcggattcgttcgaatcgtgcccgcattcgtcgccggcgcaatcaatggcggccgagatctccgcggccggtttccttcctccccggccgccttctctcccttccgacgctataaaatcgttgcccgagctccgctcttccgtttccgccgttcaccgctcgctctcgccgtcggaat

SEQ ID NO: 35559 - DNA, 1558 bp, Oryza sativa
atgactgtacttctactctataataaagagacctctggtgcttgtgatactctgtctccttgtgataccagccctgtttcctgggactggtatcgattaacaggttaatttggagcgtcacgggctagatccggtcgggactagttcggggcgtgacatgtatcgatcgctaaggtgcaacacaacaacatctagtacggttgtagttgggtcgtcaacgtttctcccaaatcgtagttatcatcaactcaccgaaagattgggccaataacagctttgagtatctccagaggagcttagggttcatcatgatctcaaccataggaaataacagatggcatagatttggccaactcttggagccgctcgatttggtaagatccaaaaaaacacggggagagagatgaataatggtgagagtgggcggttcatttctagaatagctggttctatagataataatgttggagttctaattacaggatcttaggctttactctacaaaacaatcacctcttgcttatgcggaaattaattgatctactgacctgtgtttgaagtcattgccgttcttctttcttattcttctagagatgcctcacgaaccccttccagtgcctagatcggtcgggcgatttatttagggtttgagatcaaagagagagagttcggcgtctgcctccttccttctctttcttcatctcaattagtttaggattctatttttttgtaccaatcacacaaaaaacgaatttatctcttagtttgtttcttgttagataaagaaaccggtggtttagatcctctccttacccttatcgacacaagtcgacaaaatcaaccaccattctcccctagattttgagacttacttacgagtctattaaataatatagctccccaaggcaatgtgtcttcaacaacattatgcgtcactgaaacaacaagacctatagctcactatagtactcaaataaactcaagcttaatttagtggatgttgattgaaaatttagtccccctcatccaggatctgagtaaggctctaatttacatatgtactggccagaacataatcttaattaatcttaattttatgagcctttagattatggatccattagcaaattcttagcttaataattcgatcctgggacatgtctttcacaaccatatcaatgtgttaggcagaaaacacacaacacattgctactagaatagaaaactgtgtttaattagtgcacaacttataacacagtatattttgggtggtttacaccttttgagtggtttatgagcactatttaccactcttagttctaggaaatattcttatgattaatcataacatgctttaaaatctaactacatcatcgactatgcagtaagagattattttggagcttttccatggttattgctcccctatgtgtggacatagcttaatcttagttaacttaataatctttataaatatccacacatctcacaaaataaagtgtacaaatgtctctgaacttctaaggtcattggactttagaaatatgagcatgttact

SEQ ID NO: 35560 - DNA, 1700 bp, Oryza sativa
tttctagacgatattttcgttggttccattcaactataaataattaatatactaaggaaatgaccatcataatgatgttgacatgaaatcataaatactttctagttaaatttccattcaactaaaaataaattaagtggcttaaggaaataatattcttaataaatattgacatgaaattatattaacgttggtcaaatattatatcataccattaatttctttctagctaaacatcccgttggttccatttaactagaaataattttctaagtgatcaaataattgaccataattttccagcaatttaaatggctaagaaaactcataaataaatttctggaaataaataagacataaatggcgggcttaaaataataatgcggcccatcacttcctaagccggcccataaaaacaggctaaatacattttgagaaaattaaattcacgggcttaataataaattaaaataaaaggcccactcttattgaaaaggccagcccaaaatggaccggcctatttatgtgcacgatcggcccactctcaggcggatgcggccgagatcggcgtggcccattacggcgacggcccgacgcggaagcgaggacggccgtccgatcaaacggacggcttagattttgcccgcgccgaacaaatcgcatgccagggggaaatgggtgtgagccctaaccctagctcattcttctccccttctcttccctctcttcgacggctctctcaccctggcgagcgagcgagcagcggtccggcgaaggcggcgcacgcgtgcggcggcgagcgctgcagcggcttcatctcggccggctggggggcgcacccgtagggtggcgccaagccgtgtgccacggcatcgacggtccggcgaggcggcgcgcaagcgacggcgagcgtcgatgcggccggagctcgtcggggggggggggcggagctcgaaagcatccgccaagctgacgcttcccgtccctggcgagggatggtgtggagagacaagctccaagacggctgcgcacggggaacccgacacgaccgcgagaagctaaggtgcggcggtgccgcttcccgggaggctccggtggggttcaattccggtaagtcattcgaaatcaaaccctaaattgactctatattggatttaattcgggctttggtcttagggttcttagaaccgaaattagagttcttcgaattagggtttctaaggtgtggattttgggaatttcaatcttgtttatcccaaactcctcttttctgagctaaatagttggggaaaagtttgggaatttcaatctagtttatcccgtcttccccaattttcttcttaatccactgctagccgaagctcattcatgatgaaaaacttaatcatgtaagaacagtagattaatagaccttgcaataggccgagtagattaaaaaaaagttaattggtgattttcgatctgacttgaccaatcctcccctctaatatctggccgaagccatagcttcggtctgggaattcttagtgtgagagtttgggaatttcaatctcgtttatcccaatcctcattcttctcttaaattctactgctaagcaacgaaattaaattcttcaataactttgcttcttctactgttggccgagaccaacagtataacatggcttaatatgcaaccaagacttaaagaaattaatcta

SEQ ID NO: 35561 - DNA, 4190 bp, Oryza sativa
cgtgggatgaatcggattggaactagtgggtgcgattgcacgtggaatactagtaaaccgctacacttgtaatagtaagtctaacaagagttttagccttttgaatttatcccataacataacaatttttccaccaacactctcttatcaaccaatcataagtctctaccatttaatttctccatctatcttcccttctcaaccaatcacaaccttccaccatttaattttacctactttcttaataaccatttaactctaaaaaattcttatattatgagaggagagtagtattttattttctttgctaagtacttagcaactcctcagtttgaaaatataagcagtattaattttttatatggcctttgatcattaatttcttttataatgtatcaacaactacaatattaatattgcatgaaaatagtattaaatacaaatctaggtatactacttgcatgacactaagcattttgtttttagtttaattattagacatttttttaatattgactatgcgaaaaacaatgatgtcttatatttttcaaatggagggaatatatccaacgttcggacatcaaagcattaacaaatttaagaagttagtcttttcgtatcaaaacaagttaatttctaaagttcaaatttcaaaataagttgatttctatacccttatgtaacctcagtccataaatcaagaagttctatcatttcattacctttaggtacatcaccacccatactacttttctataacgaggagcactttagttaatttttctccttattgaagttgtctccggatgtgagggtagcatttactacatccgttctaaaaatttttctccttattagagactaaggttgagaagaaaagactttagcacctctcaataaataaggataagtggagttggaaagatgggtgggataagataggaagaaattcaaatggggggtgattggtgtaacaagtagtagtatgaattgtgctagaaacaaaattctagaagtttggagtattttggaacagtagttttaaattttctattgggaactttttatatcttagcattattctattgggccatttgcttaaatgaagaagttgttttaagttcggttcatgccaaactttaacaagatcccttccttctttaccatgtatgtgaagtttgctcatacgtaaaagtaaacttttcacaaattagctaaggccctattcggatttcgtgaggttggagcaattagccggttagcttacaagataagaaagtcaattaacgcatgattaattagtattaactattataaacttaaaaagtactgtttttagctttatgtaaaaaaaagacttgaaaagcatatatgcaataatctaagtaccaatagactgaagagagcgaggcataagattaattgagtattaataattaccagctcaaaaatatatttatttgactttttgaaaaactttttcaatataaaacatttacacaaacttctactctctcgtatttcacgggcacatttatcgaactttgttttttaaaaaaattctatagttactttaaaaaatcatattaatctattttcaagtttttttactaatacttaactcatcatgtgctaatgagccacggttggtatttcttaacatcacatatagaatacgcaagcgcacggaaaataccgatgtagcagttcacctgagagtattccaaggtatcgatttctacagggaatgtgtgtgtcagctcttcaccagattcgtccaatgatacaaagcaaagataggcaaagatagctcaatttgatcgtaacgcggtacttcagccactggccagccagctgctcccagatgtcgctctagtgcatacctggacagggagggattcagtgtaattgagggctgtcaccacctctacacccatctcagacctattgtgggatacgagaccaccatcagaaattaactctctaacaccatgtctacacaattaataactacttcagcgttagctaaacactaaagtaaccactatactttactggatcatagtggtcaatgatcccgcacgctaattaggaactaaccaagagataaatctcactgaataaatcataattactcagaatagtatttctattaaagcagagtaattaacagagtaaaagaaataagaagagaatttccgacttcctcttataattcctccgacttcctctactctactctctctctaattctagtatacaataaaatacaataaagtctcttataattcagctcaagcttgaagtgtgtgtgaaattgagtgaagtgatgtccttatatagacaggtaatgatggttacagaacgcgaaatgtttgaaatgcccgtaaccgtcatcaggagtgcatctggagcgaccacgccgaaccttagcctgaacggctgagattgtggttcagctgaaccaggcctggttcagccgaaccctggtctagcccaacaggcccataaattggtttgtatctcctttgcaacttgccttatccatttcttcgagagttgggcccattttccaatgttgaaatagacttttggagcccaacacttgcatgaaatagtctgaatttccttccaattttggtggtttattacctgcatccaaatatacacactcgtggaatatgttagaattaagcactaccactatgttagatgttttatttcctatgttttatgcaggtattggcggcataaaattggcatataactgccgccaatagccactccgttttgcgtatgcaggagagaagttctcaaacgtaccctttatcttcatccgagtcgtagaagcgaacgcaaccgtagccgctccggattgcagtgtagtactgtagtgtagtatttaaagagggtaccaaagttgagtgtagtaatgtactttggacagtgttaaaataaattcaatgcagaagttgatttaaaatatcaaatacatctatttttcaagtttgtaataattaaagctcaattaatcatacgttaatggttttctcattttacgtgtgttgacttcatctttatcttaatttatattaatccatcttaattactagctccatcaaaaaatgtacgtattttaaaggttgacacaggtactaagaaagtacgtggaaataattggagaaagtgtatgattggatgagaagagaaagttagtgaaggagaatgattgtgattggttgagacaaggagacaggtgataaaatagtttcattttagaaaaggtagcttgaataacatggatggaggtagtaattaagatagattaatacaaattaagattagaaagagttagtgcacgtaaaacaagaaaatcattagcgaataattaattgagttacaacttgaaaaataaatttatttgatatattaaatttcctttaacaattacaatgtttaatcgtttaaaaacgtactaattaaaaccaaagataaaatctactactccatccgttttagattataaaacgttttgattttggtgaaagtcaaaatactttaaatttgactaagtttatgcacaaatatagtaatatttataaataccaaattagtttcattaaatcaataattgaatatattttcataataaatttgtgttgagttgaaattattattatttttttctacaaacttggtaaaacttgaagcaatttaacttggaccaaagtcaaaacgtcttataacctaaaaacagagggagtatagccctgtttagttcctctaaaatgacaaaagttttgatgttttgaagcactttttgctacatggataagcactagtagcgcaatttgtcatttgtcatttgggagtttagggtagcaaattttgaaaaaaaaaacgttgggagtcgttctctctttctttactagtaaagtggcaaaactttaccctacatctaaggctctgtttagatgggactaaaattttccctatcacatcggatgtttggatactaattataaatattaaacgtagactattaataaaacccatacataatcttggactaattcgcgagacgaatctattgagcctaattaatacatgattagcctatgtgatgctacaggaaacattctctaattatggattaattaggcttaaaaaatttgtctcgcgaattagct

SEQ ID NO: 35562 - DNA, 1366 bp, Oryza sativa
tcctccactttgtcatgtaagatttttttggcaacataagttcatgttagtttggtattcatctaaatgatgtgtaaattaatttgtatatgataggtaaagggcacctctaccgtccctaacatagaaagaaccagagatagatcaacatcactatatagataatcatcgttatgccttcataatgatggtagcagttactggagattatggtatacccacgctgcacatttcttcctgtgtattcctgcatcacacttctgatgaacattttggagatgtcaagatcaatttgatccatccatgagagaacaccataagtggtgtgccaatttcatatgtttcttttaataactattggtgaagtcaatagggaacaagttcagaactttgcatcattgagcaaaggagccttgctgaacgactcatctatcattgcaaatcataattgttcaaaaaagaataatatgtgcatattattcagaaggggcaaactaagcagcagaaatagagaatgtaattgaaagttacccaatctcacttcatgtttgacctgtaacttcggacatggaattactgattttgaaatccaattatttagtctttcatccgcatttatgctaagaaggaattagagctcatgtttacattgtaacagcatttggtctatattgtaatggaaatggatgataaataacaaagaaaaacttctctgttttggagtttcccatttcttgcaaacactatccttttgtatgactaattcatgactgcacctcaccttgatgttttatttgtgtatttatcagttgtgaattgtctatagaaatcagatgtaaaaggagaatcaccaatctgtatatgcattttctccgcttgcaattggctctatacatttgtgtcaaagttctgagatctcaacctctgacaacaaaaatttaaatgcagagttcacaagatgtcaacaacagtcatgcacacccaacaaacaaagaagcatccaaagacaaacaaatatgttgctttccactcagaaggctgggttagattatatggtctcttttatttttctccggcgattttagggcttagtaaataatagcttattcgtttgattcttatcttcgctgtgttgcctttgtagtacttccaatctgtattaatgttgttagttatgtttgcccttccaatctgtattagaggatgcctttctctacgcatctaattctcgagttaggcttgctgattgtaattgggactatcattttctagcttggaaaataaagcagaggtgttgttgagcagtgatttttttttatctcaatagtacgagcacatgtaacatgttcaaacaaccctttttggg

SEQ ID NO: 35563 - DNA, 357 bp, Oryza sativa
catgccagccgcaccagtgccccatccctcccccaccttcctttctctctccctccttgcaggcattttaacaagcacttggcgtgcaaactgcgcgatgagcacaacgaaccattgacgacgcgtcgcggccaaaagccttgtcccccgctgcgcgccaatcctgcaaagccactgacccgcgcctggtaagccgacgccgccgtgcccgatgccctgtcgagatcgccgctgacctcgccgttcgccgtggcgaaccaacactgcccctctacccgaaacgacgagacgcgactagcccgaccgcctctgtctccgctctgcaaagctgacgctgaaactgcaaggctaacgtcg

SEQ ID NO: 35564 - DNA, 479 bp, Oryza sativa
tgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgggatcggtgtatacttcacatctgttcccgattaaatagtgcctccagatcttaagagcatgaaccacggctgccaactcgagatcatgggtgggataattggcttcatgaggcctgagctggctggatgcataggccacaaccttttgttcttgcattaggacacatcctaagccttgtcttgatgcgtcacagaagatctcgaaatctttttggatatctagcaaggtgagaactggggcagtggtcaaccttttcttcaattcttggaagctgtcttcacaggctgcagaccattgaaatttcttttccttctt

SEQ ID NO: 35565 - DNA, 2063 bp, Oryza sativa
  unsure (1)..(2063): unsure at all n locations
gctaactcattagctgccattcggtagggtctttttgcaattggagctgtgcctggtgccagttctatggcgaactcgatctctcggtctggtggattctgttaattctccggaaatcgtcgggggggaaaaattaaatttttttcccaaccccaaaagggaaaacnccctttaatggggcacccgactcccaaggaggtgacttgtaaacaggttaggatagaccgacttgcggtaggggtgttaggggtaaagcggacttgctttcctctaggtccttgcaaggtgatggacttttcggcacattctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctacggtgacttgaaagaggtaacgctgttaggcgcagtattgccactaggggcacgctgctgtggctgaggtgcccgaccggtttatctgaggacgaggggcgtagcctggcttgcggttagcctgagtgaccgactggtggtattgcatgggttgaccgtagcgaggcgagaggtgcgcctcgggaagaatttccctgatggttagacttgcgtttcttgtattcttcggtagcctctttcctggcatcctcaagtagaagtgcgttgttgatcatatgttgaaaagtggggaagtcatgagcaagcactggagtctcattccaactgcgattcctttcaagaatttcctgatcttcttcttgtctgtgtccacttcctcaggggcgtaccgagccaacttgttgaactgactttaggtactcatttgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaacaccaaagcgggctggtgcacgagctgcacggcggggacggctagccatctaaactcccagaagagggcggggtaagagtcagataagcactta

SEQ ID NO: 35566 - DNA, 2758 bp, Oryza sativa
ggctaactgggtgtgggtagggcgagtacactggtgagtacggcgcacgcgagctgggggagcgcgggccactgggagtgcgggcagagccgcgggagctgtgggaggacaggtggctggcgtggcaaaagcggcctgagtcccaagagatagtgtcaactgaggtgacaccctcctcggccagacgggcctccaaagcggcgtaactgcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccagaaaaggtcttggtacgcgatctgaagagtgggcctggccacagtgaagtggtgggggcgaaggccagctccgtgtatacctccacgggggtaaaggtacaccgagagctcacagtgaggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtacccgttttagaaccaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgtagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggccatggtataacaattaacaaaggaaggatcaaatgcaacaaattaggtaggtctgccaacctgccttacagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcgggccaagagaaatggagcggtctggccgagctaaatg

SEQ ID NO: 35567 - DNA, 1970 bp, Oryza sativa
atgacggcggggcggtttggaccggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggatgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgcgagagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcgggtattgagatcttgagatggcacggacactagacaacaagcaaagaaacaaatttcgcaattagggtttttaagagatgattttcccgctaggcgccatgacggaacgggcgctacagaccaacccccctaacaagaatctcgaccccgagattcagcacctaagggagcaggtccgggaactcggcgcggagaagatcttctcgctcccaggttgcctcgtcttcggaatgattgctccattggactttgtagaacttgatggtcttccttcgagtctgacgttctgcctcttcaagaaccttgatcggtctttccttgtaggtcagattcttttctagctcgatattacccaggggaacttgctcttctggaactcgaagacatttctttaactgggatacgtggaacacgttgtgcacgtctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctgacggttctgtgctgtcttcaaacgttctcgtatcagcttaacttgttcttctgctgacttgagtatgtcaggaccgaataccagtgctttgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcatacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcagacagggctacgtattctgcgacgtctcgcttcattccagcccaccagaagtatgccttgatatcttggtacatcttcgtacttcctgggtgaatggagtaggcggactcatgagcttcctttagcatgagatctcttaactccttcttggccggtacacagatgcgtggtccgctccaaactgtgccttgatcgtctatggagaaa

SEQ ID NO: 35568 - DNA, 664 bp, Oryza sativa
ccctagcagaagggcaccaaccttctgccatatgacatctcgactaccggcccgcagctcgtgtagccttcatttgccctgaagaatgtccatcgacacccgacttcatccatctccaatcggtgtacttttgtttatgactagactgagccacaaactaagccttacccattagacatgtggaagtacagtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttataaaaaccacctaatgttgtcctattaatcagcgaagcatctacctaaattcatactagtggaaccaggaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatg

SEQ ID NO: 35569 - DNA, 5200 bp, Oryza sativa
  unsure (1)..(5200): unsure at all n locations
acaatcggcggtctgaccgcccaacacatggcggtcagaccggcccactcggaggaaaccggtagatttccaaattttggtaatctttcctattttaatcctaggtgccaaatttgggtgtaaacacatgcccccctacctttttggtgaacaacgtgaatctaaaagcatagagcatgtttttggccttaggacgataatccaattaccggccatagtacctcctaagcatcttgccaaacactcgggaagtatttcttcaagtatttcccgttgattgctcgctgaaaacgctccccttaaagtgtctccaaaaagtatgcgttcccccgaacaatgccgcatattcgataaggaccttcccaactaggagatcacttaccgaactccttggatcgagtacccaaaggcaaaattgtcttccaaaccaagtctccaacttgaaacaattttgctttcaccctcttgttgtatgccttggccaccctcttcttctctttctctatctcttccaatgccttcaagcgcttgtcgacgacttcatcaaggttgtctcccatcaacgtcttgtaatcttcacttgacaaatcatcttgcttgatataacgaagagaaccaagatttacctctaccggtaaaatggcttcttgaccataaaccaactcaaaaggagtgactttagtggcaccatgtttagatatcctatgcgcccacaatgcttcggaaagcacctcatgccacctctttgggtgctcctcaatcttctttttcactagttttagcaatgtcttattactcgactcggcttgaccattagcctgagcgtagtaaggagaagaactcaacaatttaataccataagattcggtaaaactattcacttctttagacataaaagaagcaccttggtccgtagtcaatgtttgccgaacaccgaatctatgaataatatgcttcaaaataaaatcaattacctccgtatgagtcatattcctcgaaggcacggcttcggcccacttggtgaagtagtccgtagcaactagcacgaacctatgcccctttgatgacgaaggataaatttgaccaatgaaatccaaagcccatccccggaacggccatggtttgattatagggttcaacacggcggcgggtgccaattgaacattgccgaaccattgacaagcctcacatcccctataatatttgaagcaatcatcaatcatcctcggctaatagaatcccgctcttctaagcaaccaattcatcttatgggccgattgatgagttccacaaattccttcatgcacttctccaatagccactttagattgatcttcatccaagcacttcaacaagacaccgtctacgtttcggcgatataatcttcatcaagcaatgtatatttgaatgcttgccgccgaatttttcgatcaaccttaagtgtgggatcttttagatattgaatcaaaggaattctccaatcctcttctgtatcctgggcacaaatgtccgaattttcaattaatccggcctccaaattgattgaagtgtgcccccagcatcctgcccaaaaccggtcagaccggccacacagggccggtcagaccgctcggggtcgctgatcagaccggcggcatgtggccggtcagaccgcccctggtcaccggtcagaccggccgtgcaacgccggtcagaccgcctggtctccaattttgctaatttcgcacaaagatttaaaatcaagcaccggttcttctaatatcagaaataatcccttcttcacattataaccagatgcttgttgtgctaagtcatttgctctagaattatcatgcctagcaatatgtctaatagcaaaattatcaaaattggcaataatatctaaacatgaatcgaggtacctatttagtgatccatccaagcatgtgtagactccgcgacttgttgcaccaccaattccgaatcaccaaaggcctccacatatttagctccaaccatctccataacttgtaagccgaacaataaagcattgtattcggcttgattatttgtgcaataatattcttagcgaaccgatgcctcataacacatgccattaggtgaaaacaaaactacccctatgccttgaccttctttgcaagaagaaccatcaaaataaattttccaaggtataacttcaactaagcaaatctctccctcataagcaacatctatatgatggtctactataaaatcacatacaatttggccttttatagttttcaatggttcataagccaaatcatattctatcaaagcatatgcccacttgccaattctcccacttagaattggcctttgcaacatgtgtttaataacatcggcttgacaagtaactatgcatgtactagataacaaataatgcctcaatttggtacaagcatagtataagcatagacaaagtctctctatagaacatacctcgattcggcatctaaaagacggcggctcaaatatgtaatgatatattccttggcatctttctcttgcgtcaaaacggcaccaatgactttgtcctcggaggcaatatataaccgaaaaggcttttcggctttaagcgctcggacaacgggtggagtagataaatacctcttcaactcttcaaacgcctcttggtgttttgccccccaagtaaaatcggcttcttttttcaagcgaagaataggaacaaaagcatcgattttacccgctaggttagaaataaacctcctcaaataattcaccttacctagcaacttttggacctctttcttgcatgtcggcgctttgaaatcacgaattttttctatcttcttaggatcaatctcaactcctctctcatgcaccatgaatcctaagaacttccccgccgacacaccaaaagcacatttaagtaggttcatcttcaaaccataccggcgcatcctctcaaaagctaatatcaaatcggctatatgtccttccataccatccgatttgacaacaatatcatcaatgtagatctctaagataatacctagcaaatcatggaaaatcaaattcattgccctttgatacgttgcgccggcactctttaaaccaaaggtcatgacaacccacttcaaataaaccaacaaaccccggacacctaaaagccgtcttgtacatatcctcttctgtcataaaaatttgattgtagccggcattaccatctaagaagctaatcaccttatgacccaaggcatcattaatcatcatgtcggctataggcataggatactcatctttaggagtagctttatttaaatctctaaaatctaagcaaactctaatcttaccactccccttcttctccaccgggactatgctagaaacccactccgcataacgacatggcctaataaacnccgccttcaacaaccgatcaatctcctctttgactcggtcatataataaaggattaaaacgacgaggtggttgcttataaggcctaaaacccggtttaattggaagccgatgctcaacaagctcacggctaagacccggcatctcatggtactcccatgcaaagcaatcaacatattctttaagtagctcgattatcttaactttataatcggctctcatgtttttgtttacaaaagtcggccttggtttaattccatcacctatgtctacttcttctaatggatcggccgatgtaaacccttgcccaagcttctctacttcatcaaaatcttcaacggtctctccaatatcgttctttgtagaccgatattcttgcacccttttttgtaaccactctaaactagcctctttattcattatacaagtttatatggcttagccgtgctacactagcaagctttacagagataggtacaaatttgccatcggagatactaataaaatcatagctagaaagatccctccccgataagcatgggatatccccataacgccactcaaaagtagcatgggccattgcaacctcggccgatgtatccgcttgaacattttcaacatcatcgccgtcccattggattaaacattgatgcaaggtagaaggcacacaacaatttgcatgaatccaacaacgacccaaaataacattatagttcccccccccccttttttttttgtgggggccccccacacacccccaaatattttcccgcggggaaagcccccggaaaatttgggaaaaaaaggaaaaaaaagggcccgggggtttttgggggtaaaggcccgttccatttgtttttacccacggtttgagtctccgccgaaaagatacccctcgcctccattggttcaccattgaagccattgaggatcatgttggtcttcttcaactcatcatcctcatgccccaacttcttgaatagcgaatacggcatcaaattcacggcggcacctccatccactagcatcttagagaccggtttcccatcaacatggcctttgagatagagaggcttcatgtgacggtttgactcatcgggcttctcaaaaaccgcatctttaggacctaatgagaattgggcaacctcggcttcatccatagcacaaaactccataggcaacatacacaccatgttgatatccatgtcttcctttggagacgatttatctttgtcaaccgattgttcttccttctcctctacatcaatcggttttgccttctctatggatttaggcctccataccggtggtggtcgtaactcattgaaccttttatctctttgttcttcggcctttttctcccttaattcttgggcccgaagacattgcaaccttctcttttgtgtagccgtcaaatccttaggcatccacctaggattcggctctgttctaggaggcaaataatgtcctctattaactttgcttgaagacgatgaagcccccacatcgccctttgcagccctctcatcaaaccgacaccggagcccggtcagaccggctgtaggccaccggtcagaccggccagaccggcctgaggcgtcggtcagaccgtcgtcaggtcggcggtcagaccggcctgatggcccggtcagaccggcaacatggctgcggtcagaccggccagagggcctggtcagactggccgactgcgaggagctggtaccggcttcggattttttgcttggggactttccaactccatctccagaaggtataggcacatcatgagatcctattt

SEQ ID NO: 35570 - DNA, 1021 bp, Oryza sativa
tgacttttaaatgccgtttactgcaaaacttaacctctatgttattatccccttgtactcccttgcattaattgtgcatctccggtgtggcttgctgagtactgtggttgtactcattcttgctcaatcttttccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgtcaagctggtatcagagccatctcgactgtaggataagccaagtggataaaacctaaggacatattttataaataaaactatttgcgaaagttcctctttttctccttcccctaatgctatttgcaaagggtttactcttttctttcttcttcaaatttcaactagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctggctctcccctttgttttccctctctccctctccaaacctttgcaacagatggctgacaatgagaaaaggcaataaggtcagaagtcaggatattgggacctcaagct

SEQ ID NO: 35571 - DNA, 2192 bp, Oryza sativa
ttttaggattttctttttataaaacctttttactttgtttatttcttttcaattattatttgttttctgaaaattccactaaaatttatttacgcattttaggcttttaggaaatatacaaaaatcctccaagcctcatttgacttttatcttgcaccttttaattgttggaggctttcacattgaattttacttattcttttgcacaatttcgaggatgaattttagagtcgatttgggacgcgacagccgccgccgctccggacttcctcccgactcggcgacccctccatccgcttcgccgtgttgccgccgaccccgtccgccgctccgcttcgcccgcagaccgtcggagcgccgtcgccatcgtcatcccgagccgcgccgccgtcttcttccgctccgtccgccattctcgtcgtcgtcgttgtcccggggtgagctgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgtgggtgcggctgacgcgcgggacccacggggccgaccgccgccagccgcgtgcgcccggtccaccgtggaccgagcggctgacgcgtgggccccacccccgtggacccggtccgcgcgtcccctccctcggctgacgcaataaataggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagagtaaaagcctttttcttttccgttggtcgtgtagacgctgcagcttcagaagatccgctcttcgtggaagtcgaagccgtcgattggggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattactaccttgttcaccctagaataaacaaaaccccaactagtggacactctatttatggttccactagtatgaatttaggtagatgcttcgctgattaataggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtgtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccataactccacctaagacctctcctccaaagcttctcttactgaagagggaaaagattgagcaagaatgagtacaaccacagtactcagcaagcc

SEQ ID NO: 35572 - DNA, 2813 bp, Oryza sativa
gtttccaaaatagcttgagcaactaaacgtcttcaaatgctgttaactgcaactctacccccttatattataattccccttgtactcccttgcatttattctgcatttgtgggtgtgtcttgttaagtacggtggttgtactcagtcttctttattttccccaagcccagatgaggagctccttaaagatgaaggcttcggtgtatagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaaaacacgaggcctgggagatctgcttaactctagtgcaggtccaaagcttgccttcggatgtatgagcgtgccagttgatttgatcctgtaatcaacaagagatagaacaaagaaaccgcaattaatcctataaatgatagccgatcggctagatgccgatgacatatcttttatttcaagccgatgtcatgcgtacatcgatcgacaaatatcaggcgcttgacggcaggcacgagctagaaaccaaagccttcatcttccaggagctcctcttctgggtttgggaaaaattgagcaagactgagtacaaccaccgtacccaacaagtcacacccacaagtgcagaataaatgaaagggagtacaagggggttataatataaagggttagggtttgcagtaaacagcattaaaagacacttagttgctcaaagctattttgtaaacacggtcctggagctatacaatattattaatcaaggccgtgaacccacacgagcctgccttaacccaaggcctctgatgattcagaccgaactggcaacccgaccctgggtcccagctcgtcccaatccaacccaggccatccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacgtacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattctgaatagaggggggcggtgtgaatccaattccacaatatttaaaccattccatagtgtccaggtgatgagaaaattcccaaagtctagagttgtaaaaccacctaatgttacctaattaaacagcgtaccatctacctaaactcatgctagtgataccatgagtagagtgtccactagttggggttttgtttattctagggtgaacaaggaaataataacaataacaataataaggtcataacaaaggtaaataggcatggctagataaaacagtgatagcgcgggaatttaaataaagcgataatgcaataatttaaatcaaaataattttataaaccgggattcaatatgttcaaggatgatgtgacttgccttgctcgctttcccaaatgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaatggatttattgcgtcagccgaggggaggggcgcgcggaccgggtccacgggagtggggcccacgcggcagccccacggtccacggtggaccgggcgcacacgggctcgcaccggccggcgccgtgggccccacgcgtcagccgcgcccgagggcgcgggcggctgacggccgggccccacgcggcagccgcggggcgcgcccgaaggcggccacgccggcacagccgacgggaggcggcgcgcccgcgcccctatggtcgccggcagcggccataggcacggcggagcggcggccgacagaggggaaggaaggggggaaacgaagcggcggtccacggctcaccccgggtcgacggcgacgacggaaacggcgaccggagcggaggaaggcggcggcgcggctcgggtggacggggtcggcggtgctccggcggtcggcgagcgaaacggaggggtggacgaggtcggcgaggatgcggcgaagccgaaggaggcggcgccgagggggaaggtggtccggggcgacgacggcagcggaccggagctcggcggcga

SEQ ID NO: 35573 - DNA, 37346 bp, Oryza sativa
  unsure (1)..(37346): unsure at all n locations
aggggatgacgggtgggccccacccgtcagcgagggtggcgggcgggcccgcccgtcagcggcacgcgcgcggggaggagtccgaatgggccgcgggggagaggagagagagggagagagatgggccgagccggcccaagagggggggaaagaactttttagagcttttctttttataaaaccattttaactttgtttatgtcttaataattattatttgtgctctgaaaattccactaaaatttatttacgcattttaggcttttaggaaatatacaaaaatcctccaagccttatttgacttttaactttgcatattttaattgttggaggcttgcacccagattttaattattctatgcataatttaaaggatatattttagggtcgttttgggacgcgacaataaagggcagatttaacgtgtcaatcaagcatatagaataaaagtagttaaattagataagatcaactgaaactccgatactaccctaatcggcaaccagaaagcaggctagagattgcaatttgaagcacgacttaatagatcaaactcaactgatgcagcattaagtatgaaaagaagaacaatatctagaaaatcaagccgctggaagtttcatagagtggtagatatatcacataatctaagttaacgtcattatctaacctaatcggctgccttccattagcagatgttagccgattataggttagataaagatattatcgaagactatgtgagatatatgataactcgacgaattatatagacaagattagagtgtcataaagatggaagcactaatcctgagaacataagtcgtcatgacaagttttacctcttgttgaagatcgaaaccgatgcagctcaacccgagagcacgaactcgtcgaaataaaagtaaagcaaaagggtggcgatgcgccgagattgtattggatgtgttttcttgtttttacatagggctcgggtctatttatacccgaggattacaagatacgtccataacggacacgactattatctctaacaaactctaagataccataagtctttacggcagacttttgcccaaacatatctctaaggaaattacatagaatatcctaattaatagatacaatcgccttcccaggactctatccaagcatggcaatcaccttgaagcagatcaacttgaacccaatgactttcaccgggtcatattatcggaatcggctgtatcggctagccccgtccaattcggactctgccgatcctgaccttagccgatttagactgcagccgatttttactctatctccgcaaagatcttcatcttggatttcacttcgatctgatcttcatctccgatgccaatagtgatagaatttaccaaatttggtcgttaacaagttaccaaaatttgtcagcaaactaaatgtaaccacttttttgacaactttaccaaaatttggtaagattgaaaatggcatcaaagtgaacaggcccccaataaaaaaaccaacctagctcttacataagtattgtcattcattatactccctccatctacttttgatagtcatatttcatcttatcacacagaccaagggtaagtaactctacttatcattcatttaaacatgctactagtcattcctcgtaaacaaacaattcattaatatttacatttctcgatgcccatgtagccaatgttgtgtggaagaatgaagagtcatgcattaaatccgagaaagtcattaagatggttgttgaattgaaatattactatcaaaaataaatttttcagatttgaaaatatgactatcaaaaatagatgtagagagtcctatataatattataattattttttatggaacggaaagagtaaatgacgtaagaagatataatgtaatacagtttttgtgtcactgcatcacgactcaagccgcattcgagataagagcatatgaaaacgaagtacatgcgcttaaaacgattatttattagcaaatgattaattaagttttagttatttaaaatttaatttttttgattatttaatatttcaaagtaatttttatatacaaaatttttacataaaacatattgtttaacagttaaaaggtcgtggtaacaagaaccgaattatgtatgttaataagaaaaaaaaaggccctcagagacgtccatgcaccacgtacggtaccagtaattaacgaaaactaagtagcaggtttaacatttctaacagccaacaaattacatcaccagtctagctaatatgataggtttaaattaagaagcacacgacaaactacatcactgagtctagctaattaagcggcagacgtagccacgtggcagcatctcaagccaagacgagcagcgcggcggcggcaaccccggcgacgcggtggtagccgncgncaccaccaccaccacgcgacggggagacgacggcggcggcgctggtattcccgtgcggcggcgtcggcggcgaccccgacgagtaaccgtaccccggcgtgcggtacgacccgccgctgtcgtnctcgtcgtcgccgtcgccgtcgggcgacggcgcaccggccggggagtcgccgccgccggcgcccttggcggcgtggtccgccatgacgcggaccgtcatcctctggcggccttgcagtggcccggcgcgccgctgatgaagtagaagttgccgttcctgtcgaggcggaacctgacgtcggcgccgtcgtcgaaccgctgcaccggcttgtcggcgctgcagagcttgtagtcggcgcgcgacaccaccaccaccgagtcgttcttggcgtacttgaaatctgcacactcacacacacacacaatgccgcgatcatgtcaccaccatggacgacgaatgcaatgcagcaagcaatatgtaatggaaatggcgatcgatcgatcgatctcaccgaggaaatcgccgatgtggaagcggttccgggaggcccagtggttgtacgtctcgtcggtgcccgtcggctggctccaacccctcggcccgtcgccgccgacgacgaacacgcgccccggcggcgccgccgacgccccgccggagaggacgacgcaggcggcggcgatgacggtagccgggaacagcagcgctgctccggccatggcagcaacactacttctgttgctaactgtcacagatggacgaacactaatacagttggctcagctcagcgattggatgattggatgatccgtcgatgtcgtgatctctccggccgggggggaggagggatgattatataggagtggacgtacgagtgcggtttcgcggttgcggacgtggcggtggtggatgccgtcgatggcgggcgtcgtggaggcgtggacggcgggagatgcgcgggcgtgggagggtgacttggtcagaggcggcgatcgagatgcatggtggcacaagtggcggcggtggtggtttggtcctgcaggggagtggcgttgaacgaggcaaaaccaggtgaaataggcctccatattatttgggctttaaaattttttcagatgggccctggcaactgagcaagagcaaaactaacgatttcagatgggctttaagtttttcgtggaattaggaaaaaaaagtctatttagctacctcagatatgggtcgaatctgattcgtaataatgactccctctctaactattaaaaccaacataaaaagtgtgaggtatgtggcacccgggtaccccatattgaggactaagatcgcgtcctcaggggtgggccgaagacccaattccgagtatggtaggtgttgtatagttggtaagctatagcagatatggcaatgaaccacgtatcatgtaatagtaggcaagtatctagattataaggatactgtaccctgattagcgccggcgggcctaagccagtataaaaggcgccggtggcagtctgagggaggtcttcggatcatttttccaccggatacagagttaaacacactggacgtagggtattatctcactctgagggcctaaaccaggataaacttatgtgtcaccatctcttcttatctagcgcaccccataaaatatattgccgatccaagaaatcgatagttggcgtgccaggtagggggcgcttgattattttcaaggcggagatggcatccaccggcgttgagatcaccaacaccaccacttccctgccaccacccaaatctcctttggcgcattcgacttcatcgccgacagcttcggcaaggtctgtcaggtgagcctcggcgtcatcgggccggttacagcctaccgctaccctccaggaatcaagctctctccttcggcagtctcgacttcttcgccaccaactccggcgtcctcaagctggcttcgtgggaactcacgccatcgacaactacaccgccagcacctctcggtatcagcaacttcgttgcttcctctgccaaggcatttcaagtcggcaacctcgacaccagccgcccgatcacgtccaaacccccgcggtgcccgggacaccacggccgctccgcgtcaccgtcctcgactgccgcgggagctcagatccctgctgggttggtttccttgatgagtctgtacgtctctccgactcggaactcgggaagctccaacaacacccggacttcaagccatcactcccgcgaggtcttcatcgtctttcaagagacggacgaggagaaaagggagtacgaagaggagaagcgccgtatccagtagcagcaggaggacctcactcggcgtctaatcgagctgcgacagcgcgnccgtctcgcccaaaatgccatcttccaagtcaagttggaagaacatgatgtcttcaccacgctacagaacaacatgatagccgcaaaggccctcctcgacaacatgccgattccaggcgacgcggcagtcaagaccaccatcgctcaggtgaaggccatggtgtatgccgccgctgtccagcactcggaagtaccactgaccgcttccactgccagcgactcctctggcaagagaccatcccggccacaaaataccgggtcaaggcgtgtcgaggcatctcaagcgggaaggtcacacccaagtctgcgcaccagcgacctgcgcgacaagatcgaggtgggacgtcggctaaacgccgacctccgcaacgtcatgaacaagcgtcgccagctccgcgacgcctaacgtctacggatacatgaggacaacatctacgctggccgctgccacgccgacgtccagccggacggctgcattgtgttaacaacgaaatttggttagcccaaagtcatcatcgacttagagtcagtatcgccttcagagttatggaatcagccgatgagagtcgtcaaatcgccagcaaccgtgttctcgatggagtcggatcaactaaagggaatttatccagaagagtccgagttcaagaaggatgcggcatgtcagtttatctattaattaggaatagtttgttagtttccttttatctttaggaaagtttctttcttgtccgagaaggacttgtatcaacctatgggtataaatatgtacacccgaggtctatgtaatttatcttcacgatcaatacaattcggcgcatcgcctccttttaccttttctactttattttatcgtccggcgggacttggcacctgacgcggggctgcaccgatgtttcgccggcccaggcaattatatcgtttacatcggcgtcgttcaaggctgcatcagtacattcgaccttttggattgctctggtttggatgatatatttgcctacctatttatcatatgtctctgttaatctagtattagcatatcaatttagctctatcggctgcttctcgttttagggtttctgccggtatcgggattagcttagacatctaccaccctgaaaacttagtcaacggcttgattgtctagatattatgtttcttttcatacttagtactgcatcagttaagtttgatctactaagtcgggttttgaaacataatctctagcctgcttcttgattgccaataagggtttcatcggggtttcagccggtgagttatctggacgttgcatcggctcataaggattgcatatacatataagttggatttagccgatgacaacaaaggtttcactgtttaatctaaccttgtggatttcatgacatcggatctccagccgatgtatgctttaaccttcagatcagtgcttattctatcatatcaatgctagacgattggtttatactggacaatattattgttatattttattatcagtagttgattgcctatatatcattatttactaaagtgttagaatctacattagacgtatagctgattgctcaaaaccctatcgctatcggctggtatcggcatcggctattatcggctatcggctggaactactccatcggcttgtcagccgatcggctgttttgtctattatttgcatatcttgtcagttgcaggatcaaactgactggcacacccgcatcttaccaatctttggacctgcacaggagctaagcagatctcccaggccggtgtgttcaatttttttcgtcaacacattgtcgtccatcgaccataccatgactaccgcaaccacttgcccgaccccctcccacaccgcgacgacggcaccgagggcataccagctttcaccgtcaacctacgtcgagtcagatggccggccaacttcaagcccatgggcatcaacaagtatacgacggcaagaccgaccccagcgcatggctttccgtctactctaccaccatccaagctgccgggggcgaccaactagtcatggcaaactgcctgctagtcatgctgaccacagccgcccaggcatgggtgacggggctaccgaggtacaccatcaacagttggttcgaactgaaggggcagttcatcgtcaacttccagggcacctttccccacccgggcactcagtgggatctataccagatcgttcaaggcaacgacgaacgcttctccaattacattcgccgcttcacggaacgtcgcaacaccattctgcatgtcactaacacggaggtgatggcagctttccaacaaggctgcaagaacgatccaattactcataccaaattctagaattgggtcactcatgttaagcagcatgttttaggtacgattcataagcgagttgtcaaaccacattagcttatgtcccctaaacatagccatcgggagataatcaatacctccaacaatattcactataaaaccattatgttcagacatatccacaaaaatagtggggtgtgtcgatgcaatcatcgttggcacaacgagctcaacttatgcaacacgacgaatctttgcatggcttgcacacgtccacacgtgaaaaacgccagcgtgcgacaagcatggtcatcaaccgatggctgatcaaccaacacaaccagggagtagtcaccgactacaagaacacgataaaacacaatagtgcatagccaacatttgtctgaaatacagttacaccgaattgtgttagtagttgtaactccttggatcatacactaattgttcttctaaactaaagcattttgtcaattccagcatgaagataagctttagaatagaataggaaagaccaagaactttatctatctagaaaatatcgatctaatgcaaagttccaaactaagcaaaagataaactgcttggcaacagacaacagtatagccgaccaatgttctcctaggacatgctcgaaactagccatacaactcccattgtcaaaacaactttattagacaaacactaccaaccattggtcatcaaccaaaggtggccatttagcgctagatccacgcgaggatcgagattgggtcaacacccaagtttagctgttggtgctatagtgaagtgggaatcatgcatattcacagtatctaccctcgggcttattctgctagatttggctccaattttccggtgtccttgcaagacatcaggttcaaaataatattgagaagatatgtgcacaataggggcaaccatatgaacaatgtcattccaccacatggaaaacactttacatctttcaccggaccgagtgaaaaatatctcaaattattgaacctcgcaactccaagttgctagaaaattgaggtataatcatttatctccaaatcagaaaagtgtgctctcaaccattgggaaagcaaaatgtcgaccgtagtccgactgtactctaattgagatgttaagccactaggggaaaggcacagagaatcccaagcccataatctaatttcacacatttcaacgactcagaatcctattcttgagtgtgatcatagggatagagtgatctacattaatgcccaaagctatagtcattgaaggcctttacgtgaaatcacccacactatctgtccaaatcatttcatgcagttctcagagaacccaagacgcaaacggacaatatgcgtgatgaattcggcaaaagcatggatctcgtacaacaagaatacgtgtctccatcttgtagacacattaatatcaccatttatgtatgaaggagtttatcagtaaagagcggtcttatccatagccatggatattcaatttcccagaattttcatgcattaggtgattttctgttatttacttggtcttatttagcattgtattcccaatatttatgtcacacagaaaaccatcacatattgatgcaggaaaataaacccatcataatgcttccaaggggagattcaacactatgtgaacacaatttatggaagcatcataacctagaaatccgtatctaaattattttattggaattgcatcaactttaaaagcattagaatgtttaaaagcaccattacatgattatttacgagtccgaggacccacacgcaaaaccaaactatacaaggcctaagcaacaagaaaattagatgcatatactgatgcatgcatgcttgcaacatgctttttgccgatcgatctcaagcatccaaggacgcaagatgcatccatacatgcgcgttacaaggccaaccctaggtcgtgccggcgtgaagtcgtgcatgaagagatgcagacgacactgcgctatattagatagcaaatccaccggtacatgcaagccaagaacaaccgagcaaatcaatctgtcgttaaaaaaaatcaatctaatagcaatagattggaacgacaaaccggtgaacgaagagctgctgataacgtgttgtaaaccaacacgcctattagcggatcaccggatcctttccctgtccctcctacaacaatagagacgtgatatcatgtcgaacacccgcgcccattcctttgccctcaagaacattgcagaagtagacaatgaacacaaatatagggtggagttctctcttcattatagatctcatctggagtacaagccaaccttaaatattacaccctgcccctgtatatctaggagtcttaggaggagatagaacttatctctactctgatttagattggcccacaagaaacttatctcctagagatttgtttcacaacaccaataactcgtctagatttatgtgcggccgataagcccatctgatttgaacggtgccaagtctcatttttgtcatgtatggtgtttactgattacttttgtttattccctcagttaaacataatatagattgtgtgtctaattttaacatttggttactattttaagatggagatcagtgtaaccttcatacttcattcatgctggtttaacagaatgatcttaataacgtgacgtgactcttacagtatgtaacgttacgcgaggtcgtgagtcttacacagaatgcagcctaacgagtactaacaaggttttcaaaaaaacgagtactaacaactacttcctccgttttatattgtaagattttctaacattgccaatatttatatatatgttaatgaatctaaacatatagttttatattgtaagattttctaacattgccaatatttatatatatgttaatgaatctaaacatatatatatatatgtgccgagctctcttgcagtgacagcctgtcctggacagttggttctacgcttcgcactcacgtgccacatggaccgtgtgcgccaatcgtcggcaagcttagcttcaatatgcatggacagcttggagtacttatatacttacttacacagagatccatctcctagctgaaatcctgaaacacttcagcatcagtaaaaatcaaccaggtgctcgatcgatcggatcatccgagttgcagaaagatagcaagaatcccgtcaccaacaatgtccgtggagatactgatggatcttaaccttatcaatggccaacctccgagcgccagtgccgacgacgccgccggcgatcaggcgatgccggccacggggaaccccgtgcaagtcctgatatctcccatcgttcccgtcccggcgttgacggggacgcagcggctttgccgccggcgtacacgggcgtgctgtacctgcaccaccacaagaaggaggaggaggcggcggccgcggcggcgctggggcagttgaacgaggcgaagaagaagcgggagaagtggctcaaggagatgagcggctggctgatggtgctcgccgtgctcgccgcctccgtcacctaccatgccggactcaacccttccggcggcttctggcagcacaacgacggtgagagtcacgtcgccggcacgccggtgctccagtccaacttcccacaaaggtaacaacgacgaactaatttttgcctccgaccacggcgagacccctccattaatctttcttttcaatgtttgatgtgcatgtgataaggtacaccgtgttcttctacttcaacgcgacagcgttcgtgacgtcggtggtgatcatcatcctgctgatgaacgagtcgttctaccactcggaggcgaaggtggtggcgctggagatcatcgcggtgctcgacatggtgtgcctcatgggtgcctacatcgccggcagcacgcacgcggcgccctgctccatctacgtcaccgtcctcaccgtcgtcgtcttcctctacgtcgtgtacgcggcggagctcctgcgcaagatctggtggctcatcatccacgcgcccgtgcacgacaccgccgccaccggcggcggcaagctgcccgccgtgccacaacacatcgtcgagcaggcctcgccgcaccaccgctgccacgccgacgacgttgatagctccatgtcggcgccgccacggtagtccgtcaacgtcgcctatatacttcctccgtctcgccgttgacttttttaaacatatttagccgttcattttattcaaaaaatttaagtaattattaattcttttcctatcatttgattcatagttaaatatacttttatgtatatatataattttacatattttataaaattttttgaataagacgaacggttaaacatgcttaaaaaaaataaatgccgtcaaatatttagggacggatggagtatttaggagcagagacgagagtacatgtgttgtgtaccatgtgtctgtgagtgtaatttcaatttccttgtgtatttcgcaacttttcagcttatgaatcctgtgatgtttggagctaaaaatcagtgatcctttcagaagttgcatgcagaagttctgcactcctttttctttcatgcatgtcggagtgaggaatctttatttcgtctacttggatcactgaagatacacagaattgaccagccaaggaaatgtaaaaatcgatccattaataaatgaaaaacaaatgagtaaaaacatgagaggggtaagagagagagagagagagagagaccaatgatcctttcagttacatgcagaagttctgcactcctttctttcatgcatgtggagtgaagaatcttgattgtctacttcgatcacagaagatacacggaattgaccagccaatgaacagattgtcccactctagtgggtgttatcgtttattataatcttgtcatatttcaaagtcttattgatagccttaggtgctaccaaataactagcaaaatacctgtgctttgcaacggataaaaaaaactttaattttacgtatgtagtcatgatgggtaaaaccctgccaacttatagacaggaagctgaataatacatataaacaaaacgaacaaattaagtgccagtaaaataaaagacgcaagtcatatagtaggaaaagataaaacacccgcgctaacggataagcaaacaaagacaacaacacctcaacaattggtggagagagccaaaggagcaaatagtgagtgcgtaaggagttgacggccactatggtattcaagcaataattaatttaggagagcatattgagataccatattcaagaggtgaaattttgatactagacactttttgatatagctccagagatgcaagattttttagagctgagtattttcagctccacaaatctatggatatggatctacggttacgctgatagcatttagataaatcattttgttcacattttaaataaaattttaaattttaaaccactatagtttaacatacaaactttatatctatcataggtattagatttggagttatgccaaacatgacctactaattaagtcacaagttctaggcgagctcttacatttcgttgacctcacagcatgcatgcggatgcggataaatttcagtgatctcataaaataacatgaattaacagggcttgtactacgcgagcagcttaaacgggaataggagttccatgttcataaataatgatactaactaagaaataaccacaagcccacacgtatagatgtttgatcagcatttgaattggacctagattacatttctgcggatttgtagttatatcgttcaatttctcaatatgtgaaatcctggtatcaattaattgttctgttttagttattgaaccatcgactaaactcaaacagtacaagccggaccgaaccgttcctttttccttttctagaaaacctctcgaatatgtacatgagcgtcctgcatccaggcccacattgtgtagcccattcatcacgcagtggcggagctagccccgggcaggtcgggcgtcgtccaggctcctccgctaacgtcttcactgtaaattaatagccattcatgtctaaaaaaattagtcgaatattactggaaaatgttagtactcattcgggcttcacgatatcaatggctccaccaccgcattcatgtgtgtccgcgtctgtcccttccaagttccacaccacacgcatatattcagcttccatgttgtagaaaaaacattagatttttcttttcccagttaaaaacctgggacactactggagaaatgattttgctggatcgcttaaaaatcacattagtcccggtttgaaaacacacaataattttttttttatatttagtcccggttggtgttaccaatcaggactaagtattatttttactcccggttcaaagacatgtcagagtcctattattttttagtcccggttggtaacataaaaaaacgatgaaaatcctgcctcgagccgcgcgccgtgccttgatctccccgctcgtccttatcccctgcttctgtgctcctcctgccctgtctcatgctcttcttctcctactcccctccttttctccacctcctccccctctcccggcctctcctccccttcgtcccccttcccctctcctccccctctcctctccctggcggaggcagccaggcgaaggcggccgggcgatagcggctgaacagcggcggccgggcggcggaggccgggaggcggcacacggctgggtggccaacggcggcttgttttgtgattttcttttatttttggaatgatttgtaaatttcggtgtaaattattttagatttggggatgatttggtggatgattttgtgaatgacttgtggattgtggatgattttgtggatgggctgagaattgtggatgatttgttgtgcatgatttggggatgatttgtgtggatttgaaggtgacaataaatgcaagaagcaaaaaaataaaggaaaaaaaagcgcctaaccaaccagactaaaatggcgctgggaactttattcccggttggtgttaccaacggtgactaaagattcatttttactcccgtttatatctttagtcccggattggtcgtcctgatttgcaacccaggactaaaaggggttgtaaaccgggaataaagagcccttccccagtagtggtaacgtcaaccagtcaacgggtttggataagatcgatccccttaggacctgtttagttcacgaaaagaaaatttttgggtatcacatccgatgtttgaccggatgtcggaagggttttcggatacgaatgaagaaactaatttcataactcgcctgaaaactacgagacgaatcttttgagcctaattaattcgtcattagcacatatgggttactttagtatttatggctaattatggactaataggctcaaaaggttcgtctcgtgatttcccccctaaatgtgcatttagttttttaatctatatttaatgctccatgcatgtgtccaaagattcgatgtgatgtttttgggaaaaaagtttggggaaccaaaccaggctttgagcttaggtggtgtttggatgcagggagccagggactaaactttagtctctatcatatatgatgtttggacattaatttgaaggactaaacatagactacttacaaaactagttatataaatgagagctaattcgcgtgacatttttttaagcctaattaatccataaatgagagcacatgttttctgtagcatcactgttggcggctgttaaatgtcaattctataccgccaacatctacataaagttcagataatagagcatatattccacagtgttggtgtatatttgtatgcagatgataaaacctgatgttgggaggaaatctggactaaagtgaggagaattacgtatccatacaaggaggggttgtgaacttcatcaaaacattagtaaatcaacccaaaactccgaagaatggatagaggaggactaggagaggagccaggccaaaggccaggccaggagggaacttcatcaaaacatcagtaaatcaacccaaaactctgaagaatggatagatgaggaccaggagaggagccaggccaaaggccaggctaggggggcccagcccaggttcggccgaaccctggtgatcaccgttgatcccaggttttggcatggacgctccagatgcattcctgatggcggttagggggcacttcggataattccccttcctataaccgtcatacctgtcctataaatagacctcacttcattcactctcacacacacttccaagcttgagctgaattataagaggctctattgtactatattgtgtactagaataggaagagagtagaatagaagaagtcggaagaattccggagttgtcggtaatcttctcctatttcttttattctgtttattactctgagttcaatataatattcttcttgagtaatttagatttatctcatgagaattatctcttggttagttcctaaatagcatacaggattattgttcactataaccaactaaaatatagtgattgctttagtgagttataaaaactaaagtagatattaattgcttagacgtggtgtttaggtagttgttatccagtaattactgcgtatcccacagtacgtttgaggtgggtgtagaggtggtgacagccctcgagatcacttaagtcctccctatccgggtacgtagtagagcgatatctgggaacaacgggtttccagtgcctgaagtattgcgttacgattaaaattaagctttccctagatgtttctcactactaaatcctctctatcctagcctatcatctgcttggtgtccttggatgaactgaaggaagatctgatcacacacgttcccttggattcaatacccttggaatactccatagggaaagtactgcatcggtatatccgtgcgcttgcggattttatctgtgatcgtaagaactaccaacaagcatttctggcgccgtcaccggggaacggttgctgatcatttccgaacctagttcatcctcgtatcatttttaagttttttattatacctttacccctgctatcctagagaagtattcctgtcaaactcttctcgaccatggagcaacctcttttttagctgtctgctcctcggggcgaattctatgagccaccttcttcatcggagcccatttatacaactggctatgaaattcgtcccgaactaattagtatggttagggaaaaatcttttttctggctttgatctagaaaatccctaccatcatctgcgagactttgaacaagtctgctcgtgccttaagatgcgtggcatgagacaagaaactgtgcggtggaaattgttcatgttctctcttcaagagagagcaaagaaatggtacacctctaccgttggatgtgtaaacggtagctaggaaaagttgcgagacagattctgtcttgccttctttccagttactcgtattactgcccttcgagtagaaattctcagttttaaacagatcaagaacggatcaattggtgcagcatggtccagatttactaatttagtgcaatccggaccaaccctgtccttacccgagtatgtgcttcttcaacatttccatacgggtttggataaggagtctgcattctatctggacataaccgctggaggatcggtcatgcacaaaacaccgtcagaaggaaggacaattttggatcgcattctagaaaatacttccttcatgacgcaatccaatgaaccccagccggaggcatccgtgtccaagatagaggaacctctaacgatcgagccactcactgaaccatccacttctgctagctcgattgatgagaagtttcctgagcagctgtgaatcccgctccctcgctccgaattcctgccgggagacacggcgccgcgtcgctttgcgtcatctgttgttccgtcattgtcccatcccgagttctcgcggatgcgcgtccccttgccatcgtctcgtcgtcttgttgcccatccactccgggaagctgccaagaccgcgtctctccctctctcttgcgtcgtgtcgccaccaccgcgtgacgtcgctcccgtcgcctcgttctgagctctaccgtcccaactcttggctgtagctttcgtcgactgcgcgtcatcgttgtcccgtcgccattccctctctccgcgcgtcacctcgtgtcatgtcaccgtcgtttcgccgtcgcatcgccaccggtgcgtgacgccacgctgtcgcgtcgccatcccctcccggattcccgctgtagtggctagccagctacccacagttctcccgcgcctagacgccagctcaccgccacgtcccgccatgccacgccgcctataaaagggcccgagcccccatgctcaccacgccattcccatctctcctctctcttctctcctgatttgtctgtgccgctgctcaagccgccgcacctcgcctcccagcgccgccgtcgctggcatagctccaccggagttcgctgccgcctccccgaccgccggtcgccgagccgagcctcgctgccacgtcacgcctccgccccagagctgaaccgagcgagaggaggaagaagaaaaccccaccgctgatagccgggccccgtgcctccttctctctttcagtcactgacaggtgggcccctcttgctgtccgcattagcggaatattccctttccgttaataaatagatttccaaatattccaaaaaatccttttaatctttgaaaattcatagaaattcaaccgtaactccgtttgaccccttcaagttcctatatttttctaaaattgagatctacacagtggcatcattgtttctctgatttgagcttgttttattgccttttgttaattagttttgtttttcacgtttagagcctgagtacgaggaagctttggaggccgcttttgagggagaagaccccagccctgtgcaaggcaagcctctttgatcacattgcccctatatttgcaagatatgtttgtttgataagtgcattgcttagtatacacgataaacatgtttaggcctcggattgtttatacaaccgacggactgacatattagttgcagttagtttacatatgttgttgtttctttacctttgatagctccacaaatatttgcgccggtatcgttatgcgactaccgaggtagtttgcttagccatgctaacgttgatttaccgtgtaggaaactaggttattccaattacatgctaaaaaattcagtatgttgtaccgaggtgctgtgaaataaaatgtgctgtgtaaatagtgatgatgcaaagtcatgcctttgtggtttggccacgtattatcgttaaggaccgtttcctttggaaaatccatccaaacacattacagcgcgaccacacgggtgttgatgggatgcctctggctaagtaaattgttatcacataggagtgcggtgtgccaatggttgtgggatgccgagggtgaggagacgaagtttggatctttatagcccttttgggtgtttttattgcctctattgtggcacgcgatattagtaggagacatcctcgatatttcctgagtggatgaaggctgaccttgcctgatactcggctaagagacttagcccaactaggtggcatgctattttcatgggttagctttggaaaagccttatcacgaacttctgttaccgacgagtaaacagtgtcagtttcgtgccgtgtgggtaaatcgtacaacctctgcagagattaatgaactgttcgaacagccgtgcccacggtcaagggcgagtgtaaggtgtttctcatagtgtagattcatttgacaaatgattaaggaatagtggttattgggaaggaaaacatttccagagtccgcctatgtggcagacggctaacctttgtagttaggaatggatctgtgtgacccggggtgtcgtctaacaccgagatgtcgttaggggcgagaaggtgttgatgtgctgagatagctgggtgaactatgttgttgtgaaagtgaacagaaaataacagaggaagcaaattaattattgttagttaatcttgtgacaagttgttgcaaagcaacttgtggaatgggtcgaggcgtgagcctcctcccgacaactaacattttgactcactaggagttttgtgaaataaatcactttgccaaaaaggccgcttccgcaaataaaaccctagtctccttgtttaaaccgaacatgtcattctttcccctagctcgctgagtacgttaagtactcacccttacccttacattaatctatagagtacgaggatgaagatgtcgactcgaccgctgaggagtgtctctaggagcaagccgagtatgaagacttctagatgtttcgtgcctagcccaaagtctcgcctgtggaataagttagttttctaggtgctttgcctagtgcttagttgcttagtcgcttagtgtctccgcgctgttcgcttatatgccgtcgcttttatggttttctgtaatgttgtgttgcttatctatgggcctgtccatgatggcaacgtttgtaaggactactacctagtgatataataaaacagtttactgtgattcaacatttattctgtgtgtactagctagtgtatcctgggactggtactatctcacaggtaatgcataacaccctggtgtaagttgtcttgtgtttatagctaacgaatatcggggcgttacactccacttcctcaccaggcctcctctggttcctcatgaacctgtctcatcggtggggagatgccatcgagcttccgtccctcaccaaagccgtgcactgccgctcggagctcgacactgcaagtcaaagccaccttcatgaaattatgtcagatctcactaattgctatgtgtcttgcttgatttcttattgtagcaattgatatcccgtgcaatccttgttgtatttatggggttgattttatcactttttgagtccaaatcaaatccgtatccgactaccttttgtgttgaacttggtatccgctcagcctgtctttgtttaattttatttgaacacgggtggacgacgtgagcaaatggacgaagcgggcatgagctgcaaaggcgcaagacaacggacgaaaatgcatcggtgccgattagaaagttgccgattttttaagtaggtataagataacattagctgtaccttcgtctgttcaagccaaggccggaatttccactattaaaaaaaaaggaaggaaatgtacagattaaattccctttgttccatcataaacaagcatcgatcacacatgagttcttttcccagctttcaggtaaacctatcatgtatacaatatattcgttagtcagtcttggtcgtatataattctcatggcaccttttaccctcctgggcctcctgggtgctggcagcttcatgatgtacttcaactaattaacaagtccaattaactgatagtacaattcttcagccacctgaatagcctgaaaatccctttcttgtccatgtttcaagtatatatacaggactgcgcatatatgcacccttccgtcatcttcaccaaagataaagcagagcttttaaggttcttgggaggtacccaatgcaaggcacctctcaaactactccatccgtctcataatataagggattttgagtttttgcttgtaacgtttgacaactcgtcttattcaaaattttttgaaattattatttattttatttgtgacttactttattatctacagtattttaaacataactttttgttttttatatttgcaaaaaaaaaatgaataagacgagtggtcaaacgttgcaagaaaaattcaaaatcccttatattgtgggacggagggagtactcagcatcatcggcccttgatttgctaaagggcaacttagagataaaaaagcactacaatggtaatttagtaattgtttcagtcgtaacagcctctaactccttcctggttgtttgctgctacgccctaattaatttttagccggacacgaactggccactggacacaagccccaattcactaattctcatttccacttgttgcttgatcacatcgctatatatgttttcatccactatatcactgccacttacgtaggcttcatccactaaaccaaatctattttcttcttgcctctaatggttgatgtctaaaatttgacttttagtcattcttgtaaacccatttgtgcgaatgcaagatatatatttttctggggaaagcaagatatattctaattttaaccatgctttcttgcacagttacatatggcgttaactactaatcaattaccaatttattgtcatttacacaggttacgattaatggatgactgatcaattacatagctctatcagtatatgcaatcggccttctcttctacctctaaacgcatgtttgtttccctgtaatcgatgattggaacttcataatatgtccggggccatgcatccaccatacataactgctgtcacgtcctgataaattcatcccgaaataaaaatcattttccaaaaggaataatagaattaattaaaattcgaaaagaaattggcaaacactaaaatacgtacaagaaaaagtcgaatgtggcccggagaatttttggtaaattctccttggtctaaaaggagccctcaaattttagtggaattttcagagcacaaataataattattaagaaataaacaaagttaaaatggttttataaaaagaaaaagccctaaaaagtcctttttccccccttcccttcttgggccggctcggcccaactctccctccctctctctcctctccccccccgcggcccatcgggctcctcccccgcgcgcgcgccgctgacaggcgggcccgcccgccaccctcgctgacgggtggggcccacctgtcatcgcctaccttccgccgctcccgccgccgcccgtgccctagcgccgccgccgccgccgaatccgccgcatcccgccatccccgcgcgccataaagagggggaaatcactccccgcgattccctctccgttttcccccgcttttccctctctctctccctcggatccgtttggaatcgcttccgcaaacctcgccggcgccatcaatggcggccggatcctccgcgccggtttccttcccctccggccgctttctccccctcccggcgctatataattgttccccgtgcctctctcctccgtttccgccactcgccgctcactctccccgtcggaatcgtgcccgcaccgtcttcctctctctccgccgtcgccgccgagctccggttcatcgccgttgtcgctccggacttcctcccgactcggcgtcacctccttcggcttcgccgcgtcctcgccaacctcgtccaccccttcgtttcgcccgccgaccgtcggagcgccgccgtcctcgtcgatccgaaccgcgccgccgccttcctccgctccggttgtcgtttccgccgccctcgtcgtcccggggtgagccgtggaccgctccgttcgcttcccccttccctcctctctctcgggtgccgctccgccgcgccgttggtcgccggcggcgaccatcggggcgcgggtgcgccgccttccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtggaccgaggggctgacgcgtgggccccactcccgtggacccggtccgcgcgccctctctctcggctgacgcaataaacccgatttttaattaaaatttaaatgaagaaattcgcaaatatccatttaaagagcatataaatttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagattcgctcttcgtggaagtagaagccgacgtttgggaaagcaagcaaggcaagtcacatcatccttgaacatattgaatcccagtttatcaaattattttgatttaaattattgcattattgctttatttaaattcccgcgttatcactgttttattaagccatgcttatttacctttgttaagacattattattgccattgttattattaccttgttcaccctagaataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggatatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagttagtggtttaattcttaaaatttgcttaacaactaaaatgtggaaaggttggcctgggttggcttgggacgagctgggacccaggtcgggttgccagttcggtccgaatcatcgtaggccttgggttaaggcaggttcgtgtgggtccacggccttgattaataatattgtgtagctctaagatcgtctttataaaatagctttgggcaactaagtgacttttaaatgctgtttactgcaaaacctaacccctattattatccccttgtaccccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtggagatggagctgtaggcccgctagtccgctgctgtttatttttgattgtcaggcctgaagcgcctttgtaataatgtaaatattatcgatataataaagatgtgccttttgtatcatgtttgtttggtgcaccccggcttttcctgggacggggattaatgcactagcgttcgggaaaaggcaattttctcggtcgcgacaagctggtatcagagccatctcgactgtaggttaagccaagtggataaaacctaaggacatattttataaatgaaactatttgcgaaagttcctttttcctccttcccccaatgctatttggaaaaggtttattcccttcttcattcttcggatttcaactagtactagatggtcaggtcggcaaagaagaagacatcgtcagttgtctgccgaagctgcagaaggctgttggattcgttagcgaagcgaaggaagcagtgaagccagatgtgaagcaggagtgaagatctcggagaacccgtcgcagaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcagcaccagacgccaatgctgaacttgagtcaaatacaacctcaagtgcagttggaggcagtccaagcactcacaccacaagtcagcatgccgccaacatcccgaaggacccatgatgacatgccacatgttgacccaaaagaagcaagtatcatctgttttatgtgtgatgagcaagtgcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtatctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaatggagagaagcatcaaggaagcaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgcaaccccccgcaatcagaagcttgctcctcaacgaattgtcatccatgcatcccgaagcagtcctatagcccgcgttgcaacagctccaactccaatgagtgcactaccacaaggtgtcaatgctcaatttcagccccagccaccagctgacaagacagaggtcagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcggcctccacattttcgccaatttacaggaagcaaccatgccaatcaccaagtagtcagtggagcaaatgcagtacctgttaagcctagtgctagtcagaagcaaccataatactcttgtatcggtgttcaagtacttttgttttatagctgttccccgtcaatcatgtaataacagagaaacatgagataatgaatgagattggcaagtttatgtagggtccatattaagattgcaagtgttgtgtgatgggtacatttggttgatgattaaggagacctagggtctcatttccgtaagctcataatctattatgaatcaaataacctagcgattgatggcgaagaaaatcaagtgatcaaccaaagagacatttgtttggactaagagtttccgatgtgtcttcttcggatcaaaggcatgcacccgttgtggaaaaattggacatgttgctagcatgtgtctcatcagctagtcagctccaacagcaacattgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctatgatgaatgattgcaaggtgagtatatgacatactcagcaagccacgcagcaaatatgcaagtgcacaggataacaaaggatggcataatagggtttcatttgcaaaagcagcatttagtaaacatttgagaatttaacaaaacagttaagtaataattaaacaatattaatccaacgctatacaacataccctgttgtataggcccaaccattctgaacaaccaccccggctgcacagttctatctccaaaccaggaatgtcccattccaaaccaggagctaatcaaattattaccagtttaagcatcttttactatgatgagaggtgtgagactaatcacgaaagacattgttagacccgcccataaccgcgggcatggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacaaaaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcaactagggtttgggtggaccggcgcacgggcggcggttcacacgaacggacggccgagattgatccgatccaaatcggacggccaagatcgatcggtctacgaccggctcacgggataggatcccgatgacgtcagcgatgacgtcaccgacgacggcggcgactcggcgaagaagacggctcgggcggcggacactcgccggcgaacggcggcaccacggcaccaacggagggcaccagcacgtagaggacaacgcggcgaacacaccggtgaccaaaacggcggcggaaaaggaacggacggcgacggcgacgagaaggaagcggcggctaccttcgggttgacgacggcgacgatgctccggcgggttccgacggctgcgaaggggcggacgaggacggcggcgacttggcgagcacgacgacggtcttcccgagcggcggcgacagctggagcgacggcggagcacggctgaagcggcggcggcgacggcgaagctagggcacacggcgctagagctcttccgacgacgagaggcgaaggcgagggtggcggcggaaaaagaagggcatggggatccttttaaaggggctcggaggcgacggcgaaggcccacggcgacggcaacggcgaaggaaactcgcggcttggaaagagggaaaaccgatccgaatcgaactcgattccaacgctttccaaagcgatttagccgaagattccaaaggagaaaaggtagaggagatcccggagatcatttcccctctattgattcggccggagaaggaaagaggcggccggatttggaaggaaacagcggcggcggctcggcggcggcgcgctagggtttcggcccgaggaagacgacgggcctgacaggtgggacccacctgtcagcggctgcgagggcgcgcgcgcgcgcgggcggctgcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattagaattagattttcttttcaagacttttaaaataaattctagaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccacgttgattcttcttccgagtgattactccattgaactttgcagaaacggataactcgattcctggttcttctctcatttgtttccagtatacggattggtttctcaccataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcgattgtcggcataactcttataacgagattgagccactcgcaatctttcttgaatgatctttaccttttcttctgcttcccttaggatatccgtcccgaaaacctgacgttctcccgtttgatcccacaaaagcggagtgcggcacttccgaccatacaatgcttcgtaaggagccatctgtagactagcttgataactgttgttgtacgaaaattctgcatagggtagattcttatcccaacttccaccgaaatctagagcacaagctctcaacatgtcttccaaaatttgattcaccctttcggtttgcccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccagaataggttgtctttaccggaatgaaatgagccactttggtaagtctgtcgactatcacccaaatagagtcatggcctgatgacgttctgggtaaaccagtgataaaatccatacctatttcttcccatttccattcaggaatcttcaaaggttgcaacaaaccggcgggtttctgatgttctgccttgactctctgacaaacatcacatactgctacgtattctgcgatttcacgcttcatacttgccctccaaaacctttccttgagatcctggtacatcttggtactaccagggtgaatggagtataaagtatcatgagcttctttcagaattgcatcctttagatctttgttgtcggggacactgtcgcgactgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggaaagattgagcaagaatgagtacaaccacagtactcagcaagccacaccggagatgcatgattaatgcaagggggtacaaggggataataatataggggttaagttttgcagtaaacagcatttaaaagtcacttagttgcccaaagctattttataaagacgatcctagagctacacaatattattaatcaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttgtaaaacctcctaatgttgcctattaatcagcgaagcatctacctaaattcatactagtggaaccatgaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacaacacataaaaagaaagcacagggttctttaggttataacaaacattaggagacttgaacgggtcgattcagagttcgtatgaccaagatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgataaacggactccactagacaccacccgggttgcacacgtggaaaccacgcggctaccgagcgggcacactaacgcggacactacacggtcaccacccgcacgcgtgaacgactaccgacaccggtacacgggtaccggggtcgacgaccgcacaacgggtacggggcgacaccgaaaggacgagggcggggaagcgagaggaggaaaccttaccaccacgcgacgaggcgtgggaacgacaacgacgaacgggcgcggcggagacagacgggcacaacggagacgaacggcgaggggacggcttcggcggcgatccttgggcgaaggcgagacgcggccggcacgaggcttgacgacgcggagccgaggacgaacacgaggacggggctgcagcgatcttgacgaagcgaggacgacgaacgagaacggcttgacggagggacaaacgccacgacgaccgggaacgacgagaggacgaggacgacgacgaccggggccggcgagaaggcgacgagggcagccggcgaggagacgacgagggcagccggcaacggctgcacggaggcgaggacggcgtggaacacgccgcagcgatgacgatgacggaggcggcgccgcaagacgacgagccgggcgagagggaacggtgaaggcgacgacgggcacccgcggtgttcggtcggaggggaggcgaggccgaggactacgtctcagctgcgatgccgaagatgatgggggtgtggccgaccggtgcacggcgtggagggacgggcggccgaacaactccggcgaggcggatggaggggctcgcggcgatggcgttccggcgaaaccgaggagtggacgaggtggagggctacgtcaccatgccgagggaggggacggcagcgtcggctgatgcacgggcatggcgaaaggggcagccggagcagatgtcgacgagtagaagtgagccgggcggccacggtgttccggcgatgttcgggcgaggaggaggtgatgccggggatgagaccggcatcgtgaacccgagggaggtggtggcgacgtcgaccggcgtgcaggcagggagatgaaggcgactggaggcggccggcgcggaggaaatggatgggcgacggcggaaacgcagctccgggggtcacctcgcgaaacggagggcaggccggcgtggaggaggtggcggcgacgctggaggaggcgacggcgcggccggccggcgcacggtcgaggcggcacaggcggctggaggcggccggcaacgtgggagagagagggcgacggtggggaggtggctagagaccacgggagaccgcgggagggggctaaagcgatagaacggagtgcgggggttgcattttataggatgggggagggagccgggcacgggagagggcggaatgtcacgtcctgataaattcatcccgaaataaaaatcatcttctaacaggaataatagaattaattaaaattcgaaaagaaattggcaaacactaaaatacgtacaagaaaaattcaaatatggcccggagaatttttgttaaattctccttggtctaaaaagagccctcaaattttagtggaattttcagagcacaaataataattgaaaagaaataaacaaagttgaaaaggtttataaaaagaaaaaccctaaaagaagtcctcttttcccccccttccttcttgggccggctcggcccagtccctccctctctctctcttcccccgcggcccatcggctcccccgcgcgcgcgcgccgctgacaggcgggcccgcccgccactctcgctgacgggtgggacccacctgtcatcgccttcctcccgccgcgcccgccgcccgcccgtgccctagcgccgccgccgccgctgaatccgccgcatcccgcctccccccgcgccttaatgaggggggaattactccccgcgtttccctctcccgtttccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgacgtcgctccggtcctccgcccgactcggcgccacctccttcggcttcgccgagtggttgccgaccccgtccgccgctccgcttcgcccgccgactgccggagcaccgtcgccctcggcatcccgaaccgcgccgtcgccttcctccgctccggttcgccgccgccgtcgctccggtcttcctcccggctcggcgccacctccctcggcatcgccgcatcgccgtcgacctcgtccgcgccttcgtttcgctcgccgaccgtcggagcgccgccgtcatcgtcatcccgagccgcgccgccgcctttttccgctccggccgccgttctcgtcgtcgtcgttgtcccggggtgagccgtggaccgtcccttccgtttccccctcctctccgctctctcgggcgctgctccgccgcgccgatggtcgccggcggtgaccatcggggcgcgggcgcgttccctcccgtcggccgtgccggcgaggccgccttcgggcgcgccctcgcggctgccatgtggggcccggctgtcagccgcccgcgcccgcgggtgcggctgacgcgtgggacccacggcgccgaccgccgccagccgcgtgcgcccggtccaccgtggaccgagcggctgacgcgtgggcccccacccccgtggacccggtccgcgcgtcccctccctcggctgacgcaataaataggttttttaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgttcctgctgttatgtggagtttattagagtaaaagcctttttcttttccgttggtcgtgtagacgctgcagcttcggaagatccgctcttcgtggaagttgaagccgtcgtttgggaaaacgagcaaggcaagacacatcatcttgatcatattgaatcccattttataaaattatgttgatttaaattattgcattatcgctttatttaaattcccgcgttgtcactgttttatttagccatgcctatttacctttgttacgaccatattattattgttattgttattgttattaccttgttcaccctagattaaacaaaacctcaactagtggacactctactcatggttccactagtatgaacttaggtagatgcttcgctggttaattaggcaacattaggtggtttttataactttagacttgggaaattctcatatcatttggacactatggaattgttggattatgatggaattggacatacacctctcttcctctttcaaaacccctaaaacctgttttcggtggggtttgggtgcatgccaattgtgggaagtagcaccccggccactataaggactaaagctccggccctctggtgcaaagcactaccgtactttcacatgtctaatgggtaaggcttaatttgtggctcagtctagtcataaacaaaagttccccgatttggaaatggatgaagtccggcgtccatggacattcttccaggccaaatg

SEQ ID NO: 35574 - DNA, 11581 bp, Oryza sativa
acggcgcgagcacgattccgacggcgagagtgagcggcgagcggcggaaacgaaagagcggagctcgggaagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcatcggcgcgcgcgcgcgcggggagccgatgggccgcgggagaggagagagagagagggagtgttgggccgagccggcccaagagaggaaggggggggaaagaagacttcttttagggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccagtgctaggtacttctgctattcgatgccagggtcaaccactctaactataagttatgcttcccaagagaaccatcttatcccacttgatatacttttgacgtcttcccaaataggtttactgctggacttcttattgtctgatcgttatccggccaaatttgaagcttcgttgttaggtgtgattttactctgacctctgtagactaccttcgaacatatcacttggttcataactgggaatagctcccacgaacaagcaactccgattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgggtagcatctgataccgagtggaagatttcactctttgccttcatagaaacacttttacctaggtcatcttgcttacttaatgacaaggtgactgttgcgggggggggcaattactatcaggggtcttccttgagcgatgcagagcatgtttctgtttatcaatcacctttcggcctacttctttcatgctagagagcatctttgccaatcccttttatcaatcttctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccaggtaaactaattaccaaccatcgactattatgttctcaaatattgatgtctcctggatctccttaactgttggcaggtatatccgatcttatcaatgtagaggcatgacgggtacccttaggggtttcctccaacactccttatcttgatctgtgaaaggcgtatccaaactcctatcctcaactactgtctcgttggctttttaacccaacacagtttaattgtttttcttttccattcacaggttggttattaactcgaggttagaatatagttcctctgacatgagaccctaggtctcctttgtcagtaaacaattatacacatgatcacatatccgcatctttcaaacgaatcctcatggaacttgtctgtattacacatttctcccttattacatgaatacgaggcactgccttaaccaaaaagggacggtgcttaacatcggtacattgtatcctcaacatgaatcatctctaaacatagcgagctcactgtttacagacatgattatatttatgaattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacttccaaaggtacaacacagatactggcctctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaaaccttggggagacttctcatcttcatcatctgaggagacttgatctgaatcttcactatcagacactctacctccattagctaaaagatgctctgtcaactgtggtgcacctcggaaggtatttcttctctgacgtcttgtcattcctggtgtaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggtatggcatgaggggccttctgggatgttggcggtgcgctgacttgtggtgtgaatgcttggactgcctccaactgcacttgaggttgcatctgactcgggttcaaaattggcatccgatgctgctgtagtatctctataagcaatttgttctggttaatcaggtgttggaccactgccgcacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccaggactccacctaagacatctcctccaaagcttctcttactgaaggggggaaaagattgagcaagaatgagtacaaccacagtactcagcaagtcacaccggcagaatgcatggttaatgcaagggggtacaaggagataataattaggggttaggttttgcagtaaacagcatttaaaagtcacttagttgcccaaagccgttttgtaaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagtcgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgacgcccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaacataagccaaccattccatggtgtccaaatgatatgagaatttcccaagtctaaagttatgaaatccaactaatgttgtcctattaaattgcgaagcatctacctaaatttaaactagggataccacgagtagagtgtccactagttgaggttttgtttactctagggtgaacaaggtaataatcataacaataacaataataaggtcataacaaaggtaaataggcatggctaaataaaacagtgataacgcgggaatttaaataaagcggtaatgcaataatttaaatcaacataattttacaaactgggattcaatatgttcaaggatgatgtgacttgccttgctcgctttcccaaacgacggcttcgacttccacgaagagcggatcttccgaaactgcagcgtctacacgaccaacggaaaagaaaaaggcttttactctaataaactccaaataacaagcaggaacaaagcacaaaaatgggttctttacttcttaaggaaaaattagagacttgaacggtccaattccgagttcaaatggccaagatatggccatttgaagtttatatgctctttaaatggatacttgcgaattcttcatttaaattttaattaaaaaaaaacggattattgcgtcagccgagggaggggacgcgcggaccgggtccacggggagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggaccggagcgacgtcggcggcgaaccggagcggagggagacgacggcgcggttcgggatgacgacgacgacggtgctccggcggtcggcgggcgaaacggagacgcggacgaggtcgacggcgatgcggcgatgccgagggaggtggcgccgagccgggaggaagaccggagcgacggcggcggcgaaccggagctcgtcggcgacggcggagagaagatgcgacggcgcgagcgcgattccgacggcgagagcaagcggcgaacggcggaaacggaagagaagggcacgggggacgattttatagcgccaagagggaaagagggcggccggggaggaaggaaaccgcgcgcggaggtctcgggcgccattgaagacgccggcgaacttcgcgggatgaatccggacgaatccgagggagagagagagggaaaagagggggaatcgggagagggaaacgcggggaataattcccccctcattaaggcgcgcgggaaaggcgggatgcggcggattcggcggcggcggcggcgctagggcacgggcggcgacggacgcggcgggaggaggaagatgacaggtgggccccacccgtcagcgagagtggcgggcgggcccgcctgtcagcggcgcgcgcgcgcggggaggccgatgggccgcgggggaggagagagagggagggagaagtgggccgagccggcccaagagggaaggagggggagaaaaagaacttcttttaggatttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagaagatgatttttattttcgggatgaatttatcaggacgtgacagcggcctgggccgagcaggccgggagggaagaggggggggaaaggcagcccgggagagagagggaggagggagtgggccgagggaaaggggagcccaagagaaggagggagagaaggagagggagagaaaaagagggaggaaagggagatttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgactttgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttgcacattcagccctgacgtattctttttagatttctcttatcaatcacctttcgacctacttctttgttcgataataaacacctttgctggtatcttctatcaatcacctcttaaactttgtcaaccaagtactcttcactccgagagttgtggatgcttctggtgacgatgaggtcctttggcttgctgcctttccgtgaaaccttgaagtgtttcgccaaaagctatactaactgtcgttgcctttgatccgaaaaggacgcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagtaataatataggggttaagttttgcagaaaagcagcatttataagtcacttagttgcccaaagctattttataaagacgatcctagagctacacagtattattaaacaaggccgggaaccctcacgaacctggcttaacccaaggcctacgatgattcaaaccgaactggcaacccgaccctgggtcccaagctcgtccaaggcaacccagggcaaccattccatattttagttgttgagcaaattttaagaattaaaacactgacttgggtacattggtcggcttgcccatatccgagggcgcggctattcgaatagattatactctgatcagaggtgtacatctttacccacaagacacatctccctcacgtgttgccacgtgccacataccaccacggtatacggacgaaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctaaagttataaaaccacctaatgttgcctaattaatcagcgaagcatctacctaaattcatacttgtggaaccatgaatagagtgtccactagttgaggttttgtttaatctagggtgaacaaggtaataataataacaataacaataataatatggtcataacaaaggtaaataggcatggctaaataaaacagtgacaacgcgggaatttaaataaagcgataatgcaataatttaaatcaacataattttataaaatgggattcaatatgatcaagatgatgtgtcttgccttgctcgttttcccactcgacggcttcgacttccacgaagagcggatcttccgaagctgcagcgtctactcgaccaacggaaaagaaaaaggcttt

SEQ ID NO: 35575 - DNA, 2750 bp, Oryza sativa
tgtttttagattttctttttaatagactttgataattgggggtgttgtttaataattatttccagtgctctgaaaattcaagtaaaatttgagggctccttttagaccaaggagaatttaacaaaaaatctccgggccacatttgaatttttcttgcacgtattttagtgtttgccaatttctttccgaattttaattaattctattattccttttagaaaatgaattttatttcgggatgaatttatcaggacgtgacagcaaccgattattttaccaagtgggtagaggctattcctttaaagaaagttgattctggggatgctatacagttcgttcaagagcatataatctatcgatttggtatccctcaaactattacgactgatcaaggttcaatttttgtatccaatgaatttgttcagtttgtcgatagtatgggaattaaaatgttgaattcttcaccgtattatgcacaagttaatgggcaggccgaggcatctaataagagtttgatcaagttgattaagaggaagatttctgattatcctcggcaatggcatactcgactggctgaagcattgtggtcttatcggatgtcttgtcatggatcgatacaggttcctccttatgaacttgtttatggtcatgaggctgttttaccatgggaagttcggatcggctcgaggagaacagagttgcaaaatactttaacagccaatgagtattataaccttatggccgatgaaagggaagatctggttcaatcacggctacgagcccttgcaaaggttactagggataaggagcgagttgcccggcattataataagaaagtagtacctaaggacttttcggaaggtgaacttgtatggaagttgattctgccgattgggactcgggatagcaaattcggcaagtggtcgccgaattgggaaggaccgttccaaattcataaggtggtgtttaagggagcatacatgttgcaaggactagatggagaagtttatggccgagctctaaatggcaaatacttgaagaagtattatcccagtgtttgggttaatgcatgatcggctagtgttgccgatgcatgatagccgatgtgtttgcatcgccttgggatggtcgatattgttatatcgcccttagttgcttttcactattgtaatcggttgtggtttgccgatgtacgaatggccgatattgttatatcgcccttagtcatttctataattttgtcaatgttttcaacattgtaaaattacgggggcacatacatagaaaattgcaaatttttgcaaatttttgtgtcttagccgattacaacagtttcttacagactattacatggaaatcactgagacaagtatcgctggatagccgatatagccctttgcctaatctgatttatttcttcgatggcttgggcgtcttgagcatcggttccaggaatgactttcaaggatttagtcatctcagcaacgttcttgattgccgattttagccttgccttctgctcttcgacagcttgcaggagatcggctaacttcctgtgctctagatccagttcagcattgcattcttgaagttgtgccaagagttcaatcttgcgagcttcaagccgatcaatattggatttgatcaggccttcagataactgatcaagcttggctttctcttcatgaacaagctgtcgattggtttggattgtagcctcgatgtccttgtgttcccggagatcggctaacctctgcctggctttctccagtttgaattgatgctgctcgaggtagacagctggagtaagagcatcgactaattcgtccggaagagaggcttggatatctgcaaatcttgcccggatcgagccacagttggtcaccaggttatctagtgatgctcctagccgatgggagatgtcttcgagtgttttcttcacatcatcagacaggagagctgttgctttactggtggtgtcttcttctgtttcatcgaggtaatctttgatgtcaaaggagaatagatcggctaagacctgcaagagacaatatcatggatgattaaggatcaagatatgattggccgatctcaagtttatgttaataaaacttactggaatagtaggtgcagctaattgttcctcctcttcaacatgatgactacctgcagccgatggagtgcggccgcctgattctacctgcataagaggggaagaaggaggaggaggctgccaaagggataaatgttagatataatcagcccaagtcagttaatgagatgatagaagtatcttactggtggagctggtttaggggttggagtaaccgatttcttcctcacggcaattttctttctctatatttattaaaattgtgaggaatcggctataaagtaaatgactgcaaaagtggacagagaaagttgcttacccttgccaattgagctggagcagaagggaatggaggagcctgcttaggtgaagccgatggtgttttttcagtatcgcttatttcggctgcggcttggtcgatgtcttcctcgatttcttcttcatccagagcttgttcgatggatggatctagggcgggtagatcgtcagctggcttagctttctttgtcttagccttcttcttcggagccggggctgaagtatctgcagccgatgatctggttctccgcttcttgccggcatcggctggttctctgatgagtccttggagaagtgctgaggtctttggggcattgta

SEQ ID NO: 35576 - DNA, 1939 bp, Oryza sativa
caactcaagtctagatacctcaatttctgcaaactgaccaaagagtagctcatctcacctctgagtttgtctccatagaagctgagacagtcgtctgtgttcccacggagtctcagcttgatgacatggccggttctgttgctgcacctgacaccccaccagctgcaacaatcctcgccctgccatgatgcgaggcggctgttcgggtcgaaaaaggttgcctttatggcgagaagtgcggccctctcatcggcgatgcagctccggtccgacgacgtcgatgcagcaaaagggatggatgctgtggctggtgagaacaaggggaggagaaggcacagcaatgctatcttcagagtttcaggaggaggaaacctgggctcagccattctggttttcttctttttctgggggaatgaatggatgcaaatgtaatatgcaaaaatatatatttgctcatgaatgacacttcggatcatgttatatagtgactactgttagaagaaaatactgatcctcttttccttttttctttttggcagtagtattatgttatctctgtcattcgagtcatgatgaagtgtctggtccagttgatttgaatgtgatatttgcgtcctcttcatggaattcccctgcacccggtcatacggcaatgaaatcttactagtcaacaaaagcaacaagtttttgcttgcatttcgacctcacgcctggtattgtaagaactcagatgtgggtgatctgctgctcatttccagtgtgaaagtcagcaggagctactgatagtctgccctactgaagacggtgtgatttgtgcttgcaaattggggcatattttctgtggctgttcctggtcagacgccaagcacaacggctgtagatgggtttccacgcttttaccatgacttgccacatatgatgccatgtctgacagggagcagcaactgagtggcctgaaaggggattctagatcaaccaaagttgaattctgtgaaatcttgtctgttattttgtacacatgtttgatgttattttcctgctggatttaattttcttaccattcatttccaccacttatctatgtagacgagaaatataacaagagggtgcaaaagtttataccttaagtgaaacctacgtgtgtttccaatgtatatcataatatttcatctacaaaaaggtaaatcatatttcacataaaaaaggtacatcatttttaatcctgcttagctgctgcctgttatagcattttatccttaaaattatttcttcatcactgttgtcaaacctataaacaataataaaccgtttatgaaggcacaaaacttgcactgcagaaaacatctgctatggctggtttcctgaattcgataagcaacaaacatcatctgatattacacatggatacagatagaggaagattgatccaacaaaacaatcgcactgaacaaatctgacgatgccgattgtgacgacagttgcatcccccataagcacagttgaattttcatggagctcttcttccatccgtctctttacatcttccttctcttacttgggtttctgccactctcatcagaacttgattctgacttctgttgttgcattgcaggcattggtactctctcagcgtctcagtgataccaccaagaccgatggaggtgaagaaattgatccagaatcttgtgttcttcggatgatccattagaaagattgaatcaaaataatctttcattttaggatcgctcagtctcttattgagttggcgaattccaaggtgatctgataactcatggaacagtatttttatgaaaattcttgaagacgacgtggtatcctcctctgtcaaacggatgtaaaccaaaacatgccatggaagcgcgtcggtggccaacaaatgcgcgaaaaagttggcaacattccccagcttatttgtgtc

SEQ ID NO: 35577 - DNA, 4564 bp, Oryza sativa
  unsure (1)..(4564): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttactttatttacttacctttttattctgattttctacctttattcaaattaatccaaaaacttgtgctattaattggatagatgtcttaactccctcctttcacttgtctttagatgccgtgttacaagcctgagtacctgtttggcgttgagggttttgtccaggagttgcgtacgatgtcctttgtcattggatttgggaatgctcctttttatgcccagattcgtcatgatcgtcatgaagaaaagtgccgagtcaaagtcaccttgaacagcaatagtgaagatatcccctcagtaatgtttgaagctggaggaagaaactacatccatgcatgtcaggaggtggcaaggatcgccataggagagctccgtgatcgctacagtgatcagttggtcgacactgagtatcgctatcatcctcgccaaccccagggaagtgaccgtggcagttaccttgagactgaaggaattgagaatgatgttaccacaagacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagcggatcctccggtcatcatcataagtagtgatgaagaagaagaatccaagcgcatcaattccaagattgagtgggtagcaactcaagatgatgaagatgagccttcaatcgacctcctatgctcggaagaactagagtgacttgttaagtcgttgtcttagatcgttgtgttagtttgcttgttttaagtttgtttgtgtgtgtgggtctcgcatgtgatttacatcagtggtgggatgtaattgcatgtgtttgtttgcttttgagtgttaggaagttggagagtttagtggtgtgggagtcttcagtttgtaataatgaaactcagttaagatcaataaaagttaaagtaattctctgtcctaagtagtttcccccgttttctcttcttatcctatccataccagatggtgaacactcgtagcaatgggaatggtcccaacaaccccaataataacatcaatggagagaatcccactctggcccaagttcttgctcagcagacacagcttatgaacatgatgatgcaacaatttcagaatcagcaaaaccaagggaataatcatgcacctccacagaacaagttagcagaatttcttcgtgtgaggccgcctgttttctctagtaccactaatcctgttgaagctagtgattggctacatgccatagagaagaagttggatttacttcagtgtactgatcaggagaaggtctcatttgcatcacatcagttgcatggccctgcctctgaatggtgggatcacttccgtcttaacaggactactgctgaacctatcacttggcttgaattcaccgctgctttccggaagacgcatataccatcgggggtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaagacaagtacaatcgcatggagcagaagaaacgtcggattgctcaattcaagacacaacagggaaataatcagaagccgcgtcttactttaggaccccagtccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcagcaagcccgtggtgtgtttcaactgtggagatccaggacattatgctgacaagtgtccgaagccccaacgcgtgaaggttgtccctgcccagagtaactctgctgtaccagcatcaaaggcccgtgtcaatcatattgctgctgcagaagctcaaggtgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctttttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaaccgttcatgcattgtcttctgagtctttaaggtcaagactgaatcaaataactttggaagagattcctatagtccgggagtatcctgatgtgttcccagatgatttaccgggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggtaatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatataccttagacagcttttaccactaggtatgggttgttagaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgttgatcctagtaacgtggaatccgtaaccaattggaagcaaccaaagacagtttcagagattcgcagtttcctaggccttgcaggatattatcggaggtttatagagaatttttctaagattgctaagcccatgacacgactgcttcagaaagatgtgaagtacaaatggtcggaagaatgtgagcggagttttcaagagttgaaaagtcgcttaatatcagctcctattttgattttgcctgatccaaagaagggtttccaagtatattgcgatgcatccaaacttgggttaggttgtgttctgatgcaagatgggaaggtggttgcctatgcatctcgtcagttacgtccgcatgagaagaactaccctactcatgatattgagttagctgcagtcgttcatgcattaaagatttggcgtcattatcttttcggtactcgtacagaagtgtacaccgatcacaagagtttaaagtatatctttactcagccggatctgaatatgagacaacggagatggttggaattaattaaggattatgacatgggaattcattatcatccgggaaaggctaatgttgtagcagacgctcttagcagaaaaggttattgcaatgctacagaaggacgacagttgccattggaattatgcaaggaatttgaaagattaaatttgggaattgtcggtagaggtttcgttgcagctttagaagcgaagcccactctaattgatcaagttagagaagcccaaattaatgatcctgatattcaagagatcaagaagaatatgagaagaggaaaagctattggtttcttggaagatgagcacggaactgtatggttgggtgaaagaatctgtgtctgtcacgtcctgataaattcatcccaaaattaaaattcattcgctaaaaggaataat

SEQ ID NO: 35578 - DNA, 1098 bp, Oryza sativa
gcattaaccatgcatctgccggtgtgacttgctgagtactgtggttgtagtcattcttgctcaatcttttccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcagccgccttcccctcctctcctcatgggccggccacccggcccaaccctagccgcgcccccgcccgtgcagcgcgcgtgcgcgcgctgacgccgccgcctgaccggtgggtcccacgcgccaggccgggcgtcgtccccttcctcccgcccggccgtcctctctccctctcccgtgaaccctagctcgcttcctcctctaaatccgctcgattcaagcatgggattcccaaattgattagggggaattaatcccctttccctcctctctctttcccccttaattcccccttgaatggcgcccccaatcgccgggaacggacgcgccaagtccggccgccttcctttgccgccggccgccattcccgtcgccgttccgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacattttctccaaagcttctcttactgaagaggggaaggattgagcaagaatgagtacaacaaaaagtactcagcaagccacaccggagatgcacaattaatgcaagggagtaccaggggataataacata

SEQ ID NO: 35579 - DNA, 1094 bp, Oryza sativa
  unsure (1)..(1094): unsure at all n locations
ttttagggtttttctttttataaaacctttttaactttgtttatttcttaataattattatttgtgctctgaaaattccactaaaatttgagggctctttttagactaaggagaatttaacaaaaattctccgggtcacatttgaatttttcttgtacgtattttagtgtttgccaatttcttttcgaattttaattaattctattattccttttggaaaatgatttttaattcgggatgaatttatcaggacgtgacaaatccaccccccttacaagaatctcgtccccgagattcgaggaggctagcaagaagataggttgggtggtcttctcttcttgtttgacttcttccgctccgtcttcacaaactttcagcaaaacttcacgactcggaactgcttggcttgacctcctgttgcggatggaatcttctcttcacctgacttgaaccagggtgcaccttttagctgactcagactaggttgcggtagtttaatgatgcttccgttccagaacttctcatgattcatatcttcggagtcaacctcatacaagttacccacttcatgtcatgcgtcgagatcagctcgtcattactaggataccatgcttgtcatcatgagaatatcatgcttgtcatttacttctaacttaccactgaatgctttggactatgatatcacgcttatccagcataccatgtttgacaacttgtcactaactgcatcatattagctttcctgctctccgggtgctagctacttctgctattccatgcgagggtcgataactttgcctttgaattatgtttctcaaccgaaccaacttatcccacttgacatgctttgacgtcttcccaaacggctttactgctggacttcttattgtttgatcgttatcctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35580 - DNA, 1169 bp, Oryza sativa
ctccaagcatggcagcctcctcgacccctccgtagcctcggtggcctccatgacccgtccagatcgaggcgccaccgaggagagtgtaaaggtcgtgccaccactcgttattgttgctctaaactacgggcaccggcgaggagaggggagaagggatttggcgccggcgaggagagtagagaagggagatccgcgagccccgggttggatttggccacgccactactctgcctggtgccgtcgctgcttgggtcatcgctccccgtcgcggcgcggtggactgaggagagcacaagcaacaagcaaggcaacaagcaaccaagaagtcacacatggagaaaatatgaggaaaagtcacaaaagcttgctgcaagcaaccaagaagtcacacccacgtggagaatatcaggtactaccgcacagtagcgtgctacatattaccaacctaaaaaaaatacatcaaaaaagtcaaaaacaatatgaaaaaaaattcgagatgtgaaacactatgacatttgccatcacacaaaacatcaactcaaaatacaatgtgcacaatgagaaaaagaaacaattttgttctccaatagtatttaaacaaatcagttttctattccactgagatttgtcattttttctatgtgtatatgttgtattttgagctgatttttttacatgtcataggtggtgtttggatacagggactgatcctgtcatatcagatgtttgaatactaatttaaaagattaaatataaactaataataaaactaattgcataaataagagctaattcgtgagataatttttttaagcctaattaattcataattagcacatgtttactgtggtatcacatggactaatcatggataaattatgctcaatatattcgtctcgcgaattagttcaggttatggattgtgttttttcattaatctacattttctacttctaatgaatcaaacatccgacggtaactaaaatttagtcctcccatctaacagccttgcgcttgcacctctcaaaatttttctattctttttttttttgactttttcggtgtatttttcgataaggggactcatctctcaagtgcactgcttctcttcgtctcttcccccatctccggcgagccgtactggtccaactccggcgggcaacgacccc

SEQ ID NO: 35581 - DNA, 548 bp, Oryza sativa
ttaggttttatccacttggcttaacctacagtcgagatggctctgataccagcttgacgcgaccgggaaaattgccttttcccgaacgctagtgcattaatccccgtcccaggaaaagccggggtacaccaaacaaacatgatacaaaagacacatctttattatatcgataatatttacattattacaaaggcgcttaaggcctgacaatcaaaaataaacagcagcggactagcgggcctacagctccatcttcacaggcgctcaactggggtataagccaggactccacctaagacatcttctccaaagcttctcttactgaaggggggaaaagattgagcaagaatgagtacaaccacagtactcaacaagtcacaccggcagatgcatgattaatgcaggggggtcaaggggataataataggggttaggttttgcagtaacagcatttaaaagtcacttagttgcccaaagctattttataaagacgatcttagagcttcacaatattaataatcaaagccgtggaccacacgaaccttgct

SEQ ID NO: 35582 - DNA, 1016 bp, Oryza sativa
ccaaaatttaaattttggccaaaattcagactggaatttcgggtctatcggtacaccgagagcacattctcttcggttgaaaagtttggattcagcaaaattagtttaattaaattcagacaaattttgctgaaattttaaaattaattttgtccggaaatttccaacatctccaaaaccgattgtattactcctcaaaatattggtggtttccgtaatattgaaccgtggtcattaattattactagctacatgatcaacatgtctgaattaacgttggcacgtccgtactgtacagtacgtactactcccttaccaggttgttgccggtctcgggcctgatcccggcggccccggaggcgaagttgaggccgcgggcgaagtcgccgggctgcgccatggcgtacgccgggatgagcggcgggcggaggccgagcatgtcggcgagcatgtccaccacggtgaggccgttggtgaagcgccccggcggcgccgcgccggagaagtcgatcccgtagggctggtagttggcgcgcgccaggctcaggatgttgttgttgttgccgctgtccaccagcgagtcgccgaagatgtacatgcacggcaccagctgctgctgctgcgccgccgccgccaccaacgccggcgacgccgccatggcgacgacgagaagcacgagtgctacaggtgatctagctttagtgtgcattgtgggggcgctagctgcgctgtggcgtcgatggattatttatattggtctttgtgaatggaggagtgtgggtgtgtgtgtatatatagatatagaggtaatataatatggttggttggaagatgatcgatccgtcgtggatgcatgcacatgcatgccggctcgtgaaatttctgactgatcacgggaaaacgcaagcagactgtattgtgttgtgtggctgggccggtgactggtggaggttaaagtaaatgactcggggtgcctcagccgaaaaaggcgttgcgatcaacatagcggcgacaac

SEQ ID NO: 35583 - DNA, 451 bp, Oryza sativa
tttaaagaggtgggaggacgaccaaggggaccctaaggtcgtgctccatctgggtgggtcgcaccccacataggccccacttgggccggggtcccaaacgaagttacaagcccataggcccattacaggtgacgcaacaccttgtttcttcaattgcggatgattgggatggaatttgacgatgaggctggatccgttggaaagaggactccgagagctttttatcaagtactaggatgtgtcagatccctccgaaatcccgtacattatgggataaatggaatagtatctaagtcacatcttactactcacttggtgaatatatattgtgaatggcctaatgcggctaaactggtgtcattgtgtatgtagatccctttctcctactaaggccattcacagtgctccgacatgctgttaggccaaccctcgacgcgtcagaaatttgcgg

SEQ ID NO: 35584 - DNA, 218 bp, Oryza sativa
atgccatcgtcgatatgggctctcacaaaactgaacattttggatctttgttccaataagctcaatggcacagtcagggaagatcaattaggaaaccttacaaatctagtgtacttagggttgggcaatacacatctacagattaaagccagctcagattggattcctccattcaaactgcaggtagttctcttctattctttgcagctagggtcaga

SEQ ID NO: 35585 - DNA, 701 bp, Oryza sativa
caattgtggtgccaagattttttgagctcgaggcagcattgcctgtttcgcacctaccaaagttctttgacttctgaaacgcttccaagatggaccgattttgagggaccgaacttgttgcctgctggtcgctttcgttgttaggaggtgagctgttctcctttgcagaatgcaggcgtgaccgtcttttcgccgatgaggtaggccctttgctaccagaggaaggagagctgaatttggccggtttctgaagcagagatggaagccgtcttctctttacagactcggcacttccctgattaacaatggaactctcctgaaaagaacacaacattacagtacagggtggtatgtaaaatgcccaaacatttgattccgctgcacattacgaacaaaatccccacataatttgatgaacagaaatgtcaccttcaatggttgcttgtcgtctgcatcagcaggcacggaattgtcagcacaaggatcgggagtagcagcctcctgcttctccatcgcttgcaacacctctctcgattcaccagcatggacaccatcctgcttgtgatgcgcggctccatccgcatccactccgcaagaggagccaaccccaccatcggcgatgacatccagctcctccatctcttccaccggcccagcagcgacaacgcccgaaccaacgacgcagctcgtcgtctcctccg

SEQ ID NO: 35586 - DNA, 543 bp, Oryza sativa
atctatccgctctggtttgattcgatgcccaaattaccagtttccgaataggagtcgtaggaggagtaaattttaatttcttcctagtttccgactaggatgggggccatggtgcgatagatatgcgttatactccctccatttcctaatagatggcatcacaacaaaataaattataattacgtaaatttttttataagacgaatggtaaaacgtgtaacaaaaagttaacggtgtaaactatcactacaccagatcctcacacctctgacgggataactgtgataggcaaacgaaatggtcactgatgaccgtcacctttgacgggtcatacgggatgccgtcatcggtgagtcatccggctgcgacccgtcacaggtaactagtcacttgtgacgggtttacctgtgacggatcgcagccggacggcccgtcagaggtaaggtttactcacctcaaacggctttaagtcttagcccgtttgagatgacttctgccactatatatatatatatatatatctcctctcccagcggggcccat

SEQ ID NO: 35587 - DNA, 286 bp, Oryza sativa
caagcgtccattgcccattattgcaagcttaccctgctcacggaagatgaacagatgatgatgatctaggccagctacggcgcgccgccgcccaccgtcgccgtcttcttctccttctccggcgcgtccgcgtctacggcgacgtgcccccggctgctcggcccggacggcgggatgcgccatgaccgccagtcgaggtcgtcgtcgccgtcatccccgccgccgccgccgccgccgtgctccttcctccccggccgatggcgaagcacgcggcgccacggcacct

SEQ ID NO: 35588 - DNA, 590 bp, Oryza sativa
gggcataactttttctcccagatcatacgatcaataatacactcggcggatcaatcccggacaggagtagggtattacttctcattgagaggccctgaacctgtataaatctcttgtcttcaaacccatccatttttcctgcttgatagccatcctttttattgccgaaatcttgtttcgacactcgtcatctacatacacagcctaatgctttgctgtaaagattgcaaaggtacaacatttgaagaaattaaagtccaattaagctagacattgccttttgcctccctgtaagaacgaaaacagcttgcttacgttaaaaccggccactaattcgggctagttgtcgtttgtgcgcttgaattgtaccatgagtccatgagcacggccatcactcatcaacatttgctttatctacgaataaagcaaggttaggagttgggaatgcatgggccggtcagcaaattaatttgggttatgacattatttaggcccattttgcaccaggcccactctatccttgccaactttatgttaagctcctagggcttgatcatacgtggtttaaatcatcaccgtgctgccaaaaa

SEQ ID NO: 35589 - DNA, 809 bp, Oryza sativa
gtgataattctgtagctcatgtttagcaagtttgagtatgacggaaagctgaacccaacatttacagaaggttcatttgagctccccttttcaagtattagagcatacataaacgagccaatcactccaaggtttgttctttgtactagttttactatatgacatcatcagaataaatgagcactgtaatcgtccgattgtttggaagtcatcaagactcactagaataaatgacaattctacttgcaggtttgtccatgttagttctgcaggagttacaagacctgagagaccaggcctggatttaagtaaacaacctcctgctgttcgcatgaacaaagagctgggctccattctaacttacaagttgaaggtatgcgccatttttcctttattattgtgcatttgtgcttattgattcacatcatgtctaaatgcttatcgcatgtcctttcagggtgaggatttaatccgggaaagtggcattccatatactattgtgcggccatgtgctctaacagaggaaccagctggagctgacctcatatttgaccagggagataatatcacagtatgtagaggcagcatttgtttgttggctttataagatgccacgccattctttcttctccataagatcaaataaagcatcagtttcatataagtttcctgtattttttttttcagggaaagatatcaagggaagaaattgctttcatttgtgttgcagctctggcaagtccaaatgcagtagagaaaacctttgaggttaaaattctgcaactcattgcaagacactacttgggaca

SEQ ID NO: 35590 - DNA, 1096 bp, Oryza sativa
gagactgatggaatgatatggatagctgatgacgatgatgatgattcatgctgagggaaaaagattcagattggtgtgtagtttgtgtgtgtgtgtgagggacaatggcagggagcagcaagcagagaggcaagaggcaggtgagctgttgtgtttgcttggttgcagggcaagctagctgccaagatgaacaacatgcatgtgtgtgtgtttttgtggttgtggggctgggagtgagagagcagaaagaatctcatgctgccttttctgcagttggagattgtggttagaggggacttttaacggattaggattcacgtccacggtgacttaatcattgacatgtgagccaaggtttagagcaggtacaatagcagactataagctagctgcaaacatattttaagaagataaataaggagagaagggtagcgggctacagatttgtagccagctgtagcacggacttcaagacgcaatgtgtgtatgacatgtgagaccaggtattaatagagtagtatataactattgtatgaatgagctattagattggttatacatgaattggagctagtagttggctatactattaaacttgctcttatggggccaatatattagtgacaattaatgtcacctgactttgaaggttgaggatgctagtttctttaaaacatgcatgtagcatactatctctatccataaatataaatatttctagcgtttaaaatttttccttaaatataaacatttctacagtattatatcattgagtatgatgtttctcaaaatatcaagttttggggcgtatcaagcaatttcacaacaaccttaaatccttaattttcacgtaaaggcttatatttgtggacggatgaagtaactactgtctaaaatcatttaactttataactaatgtttgagggtaacccaaatagaaacatgctcctataggattttctctttaccggtgttcagtgttgtgcatgcagggctgcatcattagtgcatgcattgtgctaggccaacttttcacatgcctgttaattttaattaactaaaagttgatgactctggttaactcctactagtacgg

SEQ ID NO: 35591 - DNA, 253 bp, Oryza sativa
ccgctcgccgaatacccgttcaccacgcgtctctgggaggcgcgctccacctatgcgaccttatgcgcttgtgcggcgagtatgagacaaccgcatgtcccgtacggctttcgcctccatgccctcgctgcgtcttgcatctagccaggcctcatctgcaactatcgtcttggaccatcacctggaccagcatggttcggcctccctgccaacaaggctgctagccggacgccttaccgcctccgtcttgggt

SEQ ID NO: 35592 - DNA, 538 bp, Oryza sativa
ctaaaccgcacatggaacatgaatctaaatccagctaaacaagtggcttaccaagtctacatcgggccccagcatgctcctcgccttctcttcatttctagcctgaattgaaatttgaaatgttagatcaacattaagagcagcaaagatccaacaaaagagggagaagttggactatccatgtaataatgaatgaaaacagagaagccaaaagtagataagcttgacaagtattgtaccaatactcgaacgggtattcccttattccgcaggatatcaaccactcttcgtccaacgccaccggtagctccagtgaccagcaccacatcagaagattccattttctttggcacctcaccaggagcagagccagtgaaactgctaagaatggactctacaatctacagattgaacagacaaaacatgagcacaatgccaaatgtgaaataactgtaacgagaagaggtgaaaaaaaatcccaatacagtgagtaaaccttgagaggattcggtggcccgttgaagaaatacagcgtcct

SEQ ID NO: 35593 - DNA, 513 bp, Oryza sativa
gggacatctataggtataaatacaaggccccctagaagaagaggggacacaaccaacagacacggacaacatagacgccacaaagccacaagccaatacaagcctacataggccaagacaagctgctagatatcgacatcagagataagcctaggaaaacccgatatggacctacgggaaccaaagagaggaatctagcgctatctctgatctcgctggatgcggatttgaggaggaaggctaccctgttgtcgactacgagtcagatcttcaggccgccacgtcgacaacagttagataggctaccccaaatattgtactggtgtgattatgatgaataagatcaacgaccggcttcggccaacaggatgtagggttattacctgataattcaggggcccgaacctgtataaaaatcctcgtctctatctcttttacctcagtctcacgtatatcttagtaccaacaatcctcatactatgcaaataccggaatcgcgacatcaaatgtcga

SEQ ID NO: 35594 - DNA, 450 bp, Oryza sativa
aagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcatcaagataaatattatgaaaaatatgatataacatctgtagcccccgactcactactcaatggaagaccaattggtgtagtgaggcagaggaaaaggaaaaatatcatataaagaataa

SEQ ID NO: 35595 - DNA, 531 bp, Oryza sativa
cgctgttgggcgtctacgacttcaccgccggcctgcctccgtcgccgccgattggtgcctccgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcatcgccggcctgcctccgtcgccgcggactggtgcctccgcctacacggctggcctattatgc

SEQ ID NO: 35596 - DNA, 706 bp, Oryza sativa
ggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcccactctgctgccgttgatgggaaacttcgtcatcatagtcggctatctctgttgccgccaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacacaaggacaagctatatgctcaggggctcatcaactcaagcgtgaggattatatctccaatttggact

SEQ ID NO: 35597 - DNA, 1021 bp, Oryza sativa
gtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagatatataggcagcatcgcatcctgagatcgcaagtggcaattcctctttggtgcgaaagaacaatggcatcgcattctgcaaaactgttcacagcacaaatggcagcctacctttctctctctatctatgtgctgtctggactgcaaaatatttttacaaagaaaaaatcagacaagaagagaacaaacgctgggcatcgcatgcagcagcggcctctcgtcgcgtaacacagggtccacgtaggctgtccaggaaagacgcgagatctatctccaaaatcggaataaagctaactcggattcttggcatttcaccctctcttttcttttcccttttttttcttccatggcaatatggcatcgccgcatcggccgtcaaatatcaatacgacgaaaggggaaagggctctcgaattcagctggagaagcaccaaacattgtgctgccggatatgccgtttccg

SEQ ID NO: 35598 - DNA, 1928 bp, Oryza sativa
  unsure (1)..(1928): unsure at all n locations
gtgggaaccgtgtaagagaaagaatatttaggctctacattatgatttaaaggcaggggctgacccggccttggtcaaggcctatgctagcccattgcactttgggttaagattgaacttacatgatggaattttgtactacgtagtgagatttcaatccaaatcctagcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttaccattagaacatttaaaatcccaaaaataatccaaaactcatcaagcgggcacatttgtacgtggtagaatttgggcttttggcccattttgtggttgcatcgaagcattgggccattcttttcgctgtcgttcaaaaggccacttaccacaattgggcccatccagaaacctcttggtcgcagccaccgcctanggttgcgctctctcttttatcccagcgccgncacgccacctttccttcttcctcctcgncgncgacgaactcccggccatctnncgcatggtcgcctcctccctcccttncttccgactcatcgctgttcatctcctcaacctaacaccccttttncgcgtgcgtgtggtgagttgtggtgcagggtcgagaaaagcagtgacccgatcggagatcaaggtgcagaaggggnccttttcgggtttccccccttccccaaaaanccaatttctcccagtncggcgagaagcggcgaccgcctaacccgcgcctccaaggtcaccaacccccctccccccaaaattctcccaaccctcctctcgccaacctccatttcaacccccctctctctccggttcttgcaggtgctggagcagctcagcgggcagaccccggtgttctccaagggtaggttaagctctccgccattgccgtctctctactctagtttactcttagcttcgttgtggtgatgacgagagtttgcgggggg

SEQ ID NO: 35599 - DNA, 583 bp, Oryza sativa
gccattgccgtctctctactctagtttactcttagcttcgttgtggtgatgacgagagtttgcggggggcgctttctttgcagcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtaaaggccccgttactctttctcggatgaaacatttcgcttttcgtatctgcctgtttatgttagtcctgtgcctagaagattttaaagcattcattgtctccattcccttttgtgacctaggatagcgcttccaatatttgcttgaaattgcctcattcaatagatttgttttggattgatgtttacaagtgatagaattttattagttgtaagttgctaaacctgaagatggtttttttaagtgttctcgggtcattgacaattcatttggtacctaggaattgttagcatactgctaatg

SEQ ID NO: 35600 - DNA, 272 bp, Oryza sativa
aataaattatgaacaaatatgcaaggcattaggttgtgggatgcttcaaactggaactgggttaaatcaagagcaatgccttcaaagaccaggagatactcgttggagttctcactacaaaactctcaaaagtttgcttgacatgttcccaacaatagtcaaagtgctagaatttgtggaaaaagatgacaaagatagaacaaatagagatcaagcaaatggtcttctagtgtatttccaatcttttgagtttgtcttctatttgcatctta

SEQ ID NO: 35601 - DNA, 107 bp, Oryza sativa
cctagcttctcttctagatctggaagaagctcttcccttaatttcagagccttaaccttaatacaagtaacagtttgtttattccccgagaagtttgaacccccatg

SEQ ID NO: 35602 - DNA, 539 bp, Oryza sativa
tttttcttcaaactttcaactttttcatcatatcaaaactttccacacacacacaaactttcaacttttttatcacatcattccaatttcaatttcaaccaaacttccaattcattccaatttcaatttcaaccaaacttccaattttgacgtgtactatccacaagttgtcctgcctttgtttcagagctccaacaaaagctgctcgaccattttgagtcatacgcacgccaccaatcgtaagttcgtaatgtaggggtaattctctttggtttactaggactttatcacgtttcataatggcaaattaacaggcctataagtaaggttaatccttgattgtcaattaaccgcacaacatatttccgcacaacactaaaaagagggttattgccgtgttcttgcggtaacagttgaacatctttggatgatattcttatatgttcaatcgttcgatgcctctgttaaatttggcatatacaaatttactgcttttatgattactcgtatttctaccaatataaacatcaccctgtcta

SEQ ID NO: 35603 - DNA, 471 bp, Oryza sativa
cccccccccctcccccctctctctctctcttccgttcagcaatcggtggccatggaacaggggccagcgacgacgacgacggcagcgggtggcagacgacggtggcgacgggagggcgggcaggcgagggtccgattcccctagtgggaggacgaggggatcgtctgcgagcggaatccggcgtcggacctcactcccggggaagacgctgctccggtgacgccaccatgagccgatggtggggagcaagcaggcatcaagggagcaagatggagggcaggatggcaagctcgagctcaccgattccaatcccctctctctcgcctccgtcttctcaccagcggtctcctccccttactccccgtctccttgctcatgcatgcggaaggaaggtgatgaaagccataagcctgaaaggtatcgagatcattcacttctcctgtgttcttgttattcatctgagtgatgagc

SEQ ID NO: 35604 - DNA, 14047 bp, Oryza sativa
  unsure (1)..(14047): unsure at all n locations
nnnnnnnnnnnnnnnnnnnnnnnnnnnnnnnnnnnnnnnnnnnnnnnnnnnnnnttaactgcatatatcggtaaatatcagtgctgttgaaaaagtttctgcaagcaaataatatatttgcaaacacatatagatgtacaaatcgtggctcaaggttagcctatttgggtcaatattatttctgcttgttgctgcacctggtgtcataatgtaacagggggttgagctcagaaacagacacaggtttaatcctaagatgcccacaacagcttattaacttgcgcatgtttctctactgaatacatgaaccgcaatggaaatcaggatatacacccatcagctaatagcctcgcccataaaaaggcgatggaggcatttcactttcaattagattaggtaaaaatgtagtaaacaacagtatacctagtgcaagaacaaccaagactaacccatgcaagctgagagttggaacctaaaatgatcatacatttatgaacgaactgtcatcaccaataatattttccctacgagcatcacaatatgcaacctggtgaacagagaggggtgtagtaactaagaaggttggcatgctcctatacaattttgttcatacaaaacatgttcgcctctcttcctttcactttgatgtagatagtggagagcacaatgcttcacaaaagatggggctcacgttccataattttggctcacatagcacttgtgctagaaccacaaaaaagagtaattaacaagggatctccatgtaccatgcactataaataagaagttaaagatgttcacagggcagtgaagataaatgtccagctaacgaagcactctacgcatcacaaaattcagttcagttgtaaagaaagaaaaaaatccacatggaatcaggggcggatccaacttgggacatgggggttcagtcaaacttttgggtgaacaaacaaaaaaacaaacaaactgttactagctagttgtattaagagaggtttaaggctctcaaattaacaaggaggaggagaagagcttcttccagatctagaagagaagctagtagggttaacgaacgcaagcgaattcaaggtcccagtggggtgggggagagagatgaatcagaaagaggctcaccaggatcccctcccctactctcctcgccagatggagatcggcagccgcgactcgtcttggcggcggcgcaaggagcggaggaggagccaacgagacgggagatttctctcttttacgcgatatactcgactactgcccaaatgggccgcccggcccggcagcgcccaggcacgaccggacctaggcccagtcaaggccccttctctttggacagtgccttataaggctgcactaagtctattttgggtccccaactatttttctttgacttatataaggctgaattgagtctatttaggctggattttccggattgaaactacaaagcggtatttttgtttgaagctatgggatcaaagtccagtgtcctcgatgcaaactttgtctgatgaattgacaacaattaatcagataatacagttgcatatgaaaattactagttatgtatgtgcgcagataaagagatacaaaaccacacatcaagtgtttattctatccatatactgtcaggtttatattggctgtgtgtgacggggcaaatatcgatcggttgtgtgtggcggggcgactgatgactagagaggtggagatattagggatggggggagagaaaagggggaaggggtgaggtgacctttggaggggtagaacagttggtgtgctagcgacgacgacggagctcgcaataggtgtagggggccgagacggtgtagaggcgataattgaccgccacgccgtgcgtggctggcgttgattagggtccgggggcaatggagtcggggaggattgaaggcggcgcgcggcggcagaggagagatgagggcaacgataaaaactatggcgagctggcgcccttgacagctcttgcggggcagaggacgtacagtgcagcggctaatagggaggggagcgctgataagcatggcggagcggtttctggcgttagcacgtgcaggagcagaattggggagaggcgcaggggtgagtggggatgtggtgcacgattgagagaggtgggattgatctcgattgttgggagctgttgagtgatgaatgaaagaacgagtgatgagtgaaaccacttgctacactatatggggaatagatagaggtagagaaatgggagaggtttatcctctctttctcaaaaaaaaaaagaaaagaaaagaaaggacccaaccgtgatcaaccactgcctcgattcccttggtcctccgagaatctcgccggcgatggctgggagttggttactgcgccgcgttctcccaccccagctggttatttatagtgcggcggcactcctccattctcctccattccctaatttgtataatggttctctttgcaaaaaatgtgctggtgaccaaactaataggagaatggttagggagtctaagattcaggaggtctcttgtggataggaaacatttggaatgggttaaacttaatcaactttgtcagtcaattgaactgactggggaggaggataaagtggtttggaaactgactaaaaatggcattttcactgttaaatatttctataaagcaatgatgattcaaaacactggctttcaattcaagaatatttgaaatttaaaatttctcctagagagaaggttttcctgtggctgatgttgaaaaattgcattttaaccaaagataacttgctgaaaaggggatgaaaagggaaggaggcaaaaaaatgaaactgtggagcatctttttaaaatgcccaatttcaagactcatttaaaacatagtgagttgtgtgtttgatttgaaaccaatccataatatacatcacttgtttgggaggtggctttaggattttcaaaaaaaaaaaaaagataaaaactttgtggtggtgggaattgcaggcagctattgtttggactatatggaagttcagaaatgctgcatgtttcaaaaaataaaagaacacaagatcctttagagctgatatatgctgtttgctcctggatcaatctttggtccattttgcagaaatcgggggacacacaagacaggcttcaacgggacgcggctttgttaaagacggtggtcactgacttctacaacacaagatttggatagaatccatatgtgatgcggatacaggggataggatgaagatttatgccttctagtggctgcagtttctgttttttttttctctgctgaatcttgttcccttttgctgtaagactgttaaagactttgtattcttatttcgttaatgaaatgggagaggtctatcctctctttctaaaaaaaagcccaaccgtggtcaaccaccgctgcgattcaaaaatttcaactcaaattttaaaattcaaaactttcaactcagaattcaaaaactttgaaatcaaattcaaaaattttcaagtcaaaatttgaaaccttcatatgaaaatccaaaacttttaacccaataattattcattttttattaaaaggctaaatgataagattagagaagggattagacgacctaagcatatacaggagtatcgctaagcgctaggattagtgcgcgcagctagcttaccgttgtggcgcgtgcgcgcgcactggcagcccccgaggtttatcctttttttaaaaaaaagacaaaaaaagagggaaaaacaaccgtggtcaaccaaccaccgccgctattccctggcgcaccgggaatctcgccggcgatggccggtagtttgttacggcgcctcactggctatttatagactacagtgcggcggcagtggcactgatcccattctgcgtcgagctgcctagctatcgatcttcgtacgtaaatacgtctccctcgtctccggcgagccaccggccgtgagagatggcgccgccgtcagccatgaacacgtcgagggcggaggagaaggccatcgacgactggctccccatcacctcctcccgcaacgccaagtggtggtactccgctttccacaacgtcaccgccatggtcggcgccggcgtcctcagcctccccttcgccatgtccgagctcggctggtacataattcattcatcatttctccttctccatttcatttcatcgtccatggatgagtgttcgattttgtttttttttgtaggggtccgggggtggcggcgatgatcatgtcgtgggtgatcacgctgtacacgctgtggcagatggtggagatgcacgagtgcgtgccggggcggcggttcgaccggtaccacgagctcgggcagcacgcgttcggggacaagctgggactgtggatcgtggtgccgcagcagctcgtcgtcgaggtcggcgtctgcatcgtctacatggtcaccggcggcaagtcgctcaagaagttccacgacctcgtcgcgccgccctccgcgccgccgatccggacctcctacttcatcgtcatcttcgggtgcctccacctcgtcctctcccagctccccaacttcaactccatcagcggcgtctccctcgccgccgccgtcatgtcgctcagctactccaccatcgcctgggccgcctcgctccaccaccacaaccacaacaatggcgctgccgccggaggtgtggactactcgctgacggaggcgacgccggcggggaggacgttcaacttcctgagcgcgctgggggacgtggcgttcgcgtacgcggggcacaacgtggtgctggagatccaggcgacgatcccgtcgacggcggagcggccgtccaaggggccgatgtggcgcggcgtcgtgctggcgtacggcgtggtggccgtatgctacctccccgtggcgttcgcgggttactacgtgttcggcaacgccgtcgacgacaacgtgctcatcacgctggagcggcccgcgtggctcatcgccgccgccaacatgttcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtctgtaagtgtgctagcatgcactaacacacacacacacacacacttgattagtgatccaattaattaattaattaccccctccaaaacgggagaatttaccttttgccatcctctcaaaataccagttctcaaatgccactctcctaaaatttcatttccaaataccacctgggtccacatgtcagcctcttttcccattcaaataaaagtgacgtgggactggatggtgtgtgaggctgatatgtgggcccgggtggcatttggaaatgaaattttgagagagtggcatttgaggactgacattttgagaggatggtaaaaagtaaattatcccctccaaaagtattttctattataatacatagaaatattaataaatatatgattttattgaagtacttttttaaaactaatttacacatacggttttcatatttttaagataaatattttagaaattattaactaatttaattaataattactctctctgtcctcaattataaggcctatattttttttacacggtttttaataacatactttaactagtatcttttccatttcatgatccaaacaaatataaaattagcatcacataaaagtactttaaaatataaatctattttgaaatataaatctattttgaatttactgatataacatgcataaaatttactgatataacatgcataatatttagtatagatatagttagtataattattaataaaactactaagtttgatttttcttaaaaatagagtgtcctataatttaggaccgagcgagtagttgtcaattagtctatcatatgttgttaattaggatctaataaatcttaatttgtactaattttggagtattgaatttcgcagtgttcaccatgttcgttgccatcgcggtccctttctttggtggactgctaggcttctttggtggctttgcgtttgctccaacgacctacttcgtaataatctctaccattaatttctttattattagaaccttcattaaaaatgtatataatttaaaatctctcgtgcgtattaatctccgttttttctaactgaaatatgaacaattgttttttcagttgccatgcattatgtggctgtcgatcatgaagccaaagaggtttggcttgtcctggtgcatcaactgggtaagtagtattatccattaattatttagcatgtgcatggtcaattaactaacttgataattatcctcatctgattgttaattatatatcttgttaattttaattctttatatatttttggtgcctcagttctgcatcatcatcggcgttcttctgtcggtgttcgcaccaatcggaggtctccgctcgatcatcgtgaatgcccagagttacaagttcttctcttgagtgattaattgagagaaaaggtgttttaccgttcaattaagtgtgttcttaattaattaggggattgttttagataatgcacagagttctatttaattaattagatgaaagagaaattcgtgtgtccctatgagacatctgtgtggattgatatagtagtcgatcaaatgaaggcatattatttatttggcctttgtttgtcgatctagtactctagcgttaatttaattcgtgtcgagtttatcccaatttttgatgatgtttgtgctctattatcacgtggtgtggcattcgttttaagggtttatgattggttcaaacttcgtcctagtttttacacgatttgaacttgaaatcaattactttcaattcgactcttgcgcgagtctcactaaaaaaagttatcgagtaagaatatcgagtaagaaaaaaaaggatgttgctgtaccacgggaaagcatggcagatggcgagaaccaggtacatgaacaattaaccaaaacatcataaacatcatatgtacaaatcagcacaaagaaacttcagccacgctacaagcagttcgctgggaggaggtaaagtctcttgtacactcaagtaatatattgcagtaggagcctctccaactgtttttccgtcaaaaaaaaaacctgaggagagccgacgctgaaacaaaatttgacccaacctcacacctctgggaggagagtgccgatgctgaaacagaatttgacaaggtttaagagatcacacgatttcaaactgaggttgacgataattgcgccccattcctttggtagggtactttgccatatcagatatccattgcctcggaggccgatgaagcattcttcttcttgttctttcttttcttgtccttagggtccttcccctgcttggcggaattgctctcctttctcgcagagggtggctgtgttgacaacaggtgctgatggatcgccgcaaacgggtcgagctggaactgcggattggtcagcacagcattcagttgggcagcctcccgttgcctgaaaggagagacaaagccagtcaaaaaccataagtggaaagaaagcaaagaacgcaagtggaggggcagatgaggcaattacactaaagcttgcttcgatttgcagttcagttttgcttcggtgtgcagatttgaggcatctgtttcaggaaggaactcagagagcattgagagatcatatgctttcagtttcttctggcggctcctctgtttagatttctgcacaaagaaatttaaataatcacaacccataacactgatagtgcaaagtaaagcaagtgtaacttccagaaaactacaaatggagtagcccagctgcaataaaaagaatcagttgtaaggaaggacagtgtggagagattaaaggccaagaacagaacggagagactaaaggtctcatttcagcatctacaagtatatttactctaaaatatagatgcattaacatatgaaatgaacagaattaatgttcgcagtttgtgtctagaatatatgaaaccacaagattgtaactatatgttgggaaattcatgagtcaagagccaactggtcttggcatttgtttttccatatggagttaggcacgtatgggtttcctaggatcctagtcatcccatcacagtaggagggaatacaggagacagtggatcatcagtgcaagtacaaaaagcatattagggttccaagcaggtcccaagtacaaaatccattctcatatctgtttatggatatggtgtggttattttgctagtcttcacatgtagacaagcatttggatgacaatataatactttcttacgcagataatttttagcataccacaaatacacaggacaagagactaaacatagctagcgattgagaaaatcagacttacaaatatatacttgaccaatacatacaatttggaatttatccttgaaatatctaagcattggttgcgttatacgcccacgccactcatggagcaaaacaataacagtaaaaacaagctgcaacaacagaagctacagaaaatattcaattgcaaccaaaggtgaaaagccatacacccatagaatctgctgaagtctgattcaagctagaggcatgtagatattttttgccagggcatggcttgtttctgtttatactttacagctgtcatgtgaacaagaaacagctggtctagttcacgtatggtggacaccaacacccctagtttggatttgttcagcaggtttattagatgaacgctccataatattttttggttcaattagtgaacaaataaggccccaaataaggaggacaatatgcttaatattattgcatagtgtaattgattccccttagctaggtgttggctgtgttgagaaggattcaaaggttatggtcatcaaggccatgttaaaaacagagaatagctcctgatttctttgctaaactttttgtggcttgtgctagtgatgcattacattataccagggttacaaacatgacaaaaaccagtgagtagtaaccagtgcttggttttcttgcaatagccatacccgctatagtgaactggaacctagacaagcaatttttcgtctcgtgctattagaggaactttttgttcaaataagttttgccagaaagtgcctggttctgctcagtactggatgggttggatgtgcagagcacattccttaagaggtaaattccacctagcaagagactagctgaagagtgcacccacactatttaaaaacccagtcttgcagaaattatttactattagtatccgggaggtcctatttctttcttagctacaacctacaaatgccacacagaggttaattggggaactgtgcacagtaatcagtcatgaagcatagatatttcagttctgagtgtaacctaaaaaatatgggattacgaattgagatctagcatgcaaaactggtgtattaagtcaatagaaacagaaacgacaggacatgatactaggtagttcgaattgtcaaaaatccattttttgggcaagatagtattcaatgtttgtgtacgaggaacacacaaatttgcaatgctgaagagaattaaagaacactataataataaacgagagggtctataagcaccttgcagatagtctttgtagcatttagggaggttactgcatctttcacttctgagaaacaaaaacaaaaataaatcaattatactataaaccacagtaaacaaaaaaacatgctattccgcaaaatatagtcaacgactcaaggtagacaagaaaaaggtaggaaaatgaaacagagtccagctagcagtaagcccaatcataaatcgtaatctatcaatgtttcgactttcgagtgcagtaccacaaactaagctactatctactttacaatatacatgttctgtaaacacaagtaatctacaaaataaaaggtatactaaaaaggctacaactatttatagaaaacaaaagaggttttattatcacaaaacactaaaaacaacaagcatggaacatgaacgaagaagtatttttattcatggataagatatttccaagctttcactattcaagaaaaaaaaaagcattgccccttttacagacatattaattttcttggaataaactaataattagttgtccttctttacaaaaatgaataacaagcatttcagaatagcagtgaagtaaaacataacaagccaataccaccatcctctggtcttttgaatcaatctctatacattaatcaacatttgccttatacactccctccatccaaaatataaggcctatcagtttttttacatgttctccaacattgtattttggaaattaaattatcttacaacatattatcagcaattacaaaggtaccgttgtatacgaaataccacatgcatgacattaaacatatacattgttagttcaattactagccaaagattgcaaatgttgatttttcctggaataagggagtacagccaaaaaataatggaaaggcacacctacttgtgtagaagctgagcttcttctcaagcttctgtttggacttcagttcatgcttcttaggtgacccagtcctgaaagcaggggcggatccaacttgggacatggtggttcagttgaacccccaaactattcggtgaacaaacaaacaaacaaacaaaatgttactagctagttgtattaagagaggtttaaggctctcaaattaataaggaggaggagaagagcttcttccagatctagaagagaagctagtagggttaacgaacgcaagcaaattccaggtcccggtgagagatgaatcggaaagagggctcaccaggatcccctcccctgccctccccttttgtgctcggcagatggagatcggcgcgccctgccctgtgtgttggcggcggcgcaaaggagcggaggaggagacaacgagagagagagacggccgagttctcttttcttttacgcgatacgagacgccagggcccaggccctatccgaggtggggggggcccgctgtgccgtgcccacaggctgcattcacgggccagtctatgcacaataagactctggctatgccagccgatccaaaggcacgatagtccatcgtgcttttctacaaaataagtctttttccgtctcttatctctttgggttgtgtcatatatgatggaataagtctatttatgtccttctctttggacagtgccttataaggcagaattaaccccaactatttttctttgaccatgccgtgctgggcagccccaccatgccaaggcattggcccaagcacggcccaattattgggccaagctggcacgagcccgacaataattgtgtcgttccatgcttggaccaggccaaatggtcgggctgtcgggcctcggccttatggccatctatagtctactccaactttatcttaatatttttactattttaaaactagttaatagtatttctttatgatgactggtgacccacatatcatcaaaaattaacaaacacagttagcgattgtgtcgacaacaaatttctcagaccactagcaaccactaactgatactccatgcaccgtcatcaccgctctttctcctgagccaccatcgttcctcctctttgcctttaccgtcatcaccgacatttctttttctcctccactatcgttatgcacactattgttatggttgcattgaggtcggggatgtcgggcgtgaagggactgggaggcaggagttgacctaacaaaaagcgaagacgctatatccgtgctccttcttgctatacctagcagttatcaaacggagggaaaaagaaaatggagagagagagatagtgtgcggagtgattgctgagtcatcagacttggagatggatataatagggtggtccaaattgaaatgtaaagttagctattgtgtaaaagaaaagaatggttaaatgatgacataatatgaaaacttttaagaatatttaagaatacatagtatggactgtaatttactccctctgtaaaaaaaggaatctagagatatgacatagtgtagtatagcaaatctggacataggcatgtatagattcgttttacttggatatgtcacatccagtactaggttggctttttttattggacagagagagtattttttttctctagcacaattaaagatgagttgtccattagctgaaagtagggatatgatctaaaatgtatcggatggttgaaaataaatgaaaaccaatggttgatatgttttttctcacaactttttaaataaaatacatctaatctaacctaatggtctaaattatcgggtccaccgatttgagtgaaaattgacggtgagattaggcattgccacgtggtggtctaggagcgtttgtagatgtgccacgtggaggcttgagagcgtttgtaggaagtttaatggacctttagtatataactaggaaggtagcccacgcgatgcgcgagcatgtattagagattatgtttgaaaaaaaattaaaatgatagaatatcaaccagatgacacttgccatttcaaaaatactgtttatccataacttatcctcatcagtgttgcttttataatttgtccaatctatttgttagcttttaaaatatataatatttaatacattcctataaacaattatctaacaatatgtagaaaagagttagatttaatttgtatggaaacatgtagtgttctgtcttgtttaataaaatgtttaggggctttcttttttttagcaaatcctaaataacattattgttaatgaatatgttttatttgtaccaccaagctagtcctcctatttggttcaattgacacaatttgttatatatatatatttacatataaatttctaagtagaccacccttccctgatatatgcgtgatctatagtatcgtttattttaaaaaagaaaatacctagtcaatatgagttagaacattctagtttaacaattaaaaaataacttcttaaccaactgtaaagctaactttgtgtggcttatatatgcaataatatgcggaggaactcataatgtcatgaaagccagtaatatctaagcacttaaaagatgttatggccatgtaacatgcaatagttgttccaattttagtgaaaagtaggaaacaatgttccttttatatttcttgtttaattttatacaactcttattttaagttcaaaatataggtgttatggatctttaaattgttggtttaattatgaatagagcaattagattagaaaccagatgtgtggataaaaaattgtgtatgttttaatattattgattatttctccttttagtttgagagctataaaaatatcgaggaagggcagaggggaaagtgcgagccgaaggggactagtagtgttgtgtttgtgcgcatgtgaggaggagggcaaagttttctgtgtgtgtgttgggggggtggttctttttttataaatgatttaagtgaaaatcgatgatctattgttttgtttctaaaattttcaaatatttttttttctaattattaagatgtaacacctagcggcttaagattttcattaaaagtagatgtaatggttgaaaataatggatctacatatttaactcgaaacatgtggtcaactgtttttttcctataatttctaatattttatttttaaatttaagatgtaatatgtgacatatgtgatactgttagtgctctatagataatgtacgagatttaagatgatatagtaattattatcaattttttatttttctatttttttgtttggttgacacacgtaggtgtctacaaatgatgtactatttacagcgaaatatgggtaatatggatcttgaattatttatttatttataaataaaacaatagttcaaccgaacttgaaaaccagatataacttaaaagatagtcatttagttttctaattgctgtgtgtttatgtattaagtttttaattagttaaaatt

SEQ ID NO: 35605 - DNA, 2023 bp, Oryza sativa
aatgctttattgattgattaagatgtatcttttttttcttttcataaatatatttatatgtatacactacaaatttaataatattattttgacttattataatgtcggattgagaggagtattttttgggaattaggttcatttagttttttcatcatatatatagtttaattactgttaagttatatacagtgataaaatctatatcactctttttttccataattttattattttttgaattggacacaaaggtcagaaaatataaccaaaagttacatattttattcatagttgaattatagtgaatgtgggcccttaaaagtaaaataatataaagaatgtagtccgtgcataggtaagatataaatcaggttcgacattgaaatcgaagcagattctgcaaagagatggattcgaagaacagagtatgcatcggctgcgaaagcatcggctggagtctgcatcagctgagatggatcggatagaaaacagccgatagaggtggtgcaacccgattccgacggtgatggcttcaaggatgtttctagaatcaatcaacgtgcttaacaaggattgccacgatggagataaagctcttagaaaggcaattctatctattaattaggatatcttacgtaaattccttagagatatgtttgggtaaaagtctaccgtaaaaacttatggtatcttagagtttgttaaagataagagtcgtgttcggcaaggacatattttgtatctcgggtataaatatgacccggacccatgtaatcaaacaacaacagttcaatacaatctcagcgcatcgccaccctttttactttcgttctatttcgatgagttcttactttcgggttgagctgcatcgattcgatcttcaactagaggtaaacttgtcacttgtcatggcggattgcgttctcgggattagtgcttccatctttatgacactctaatcctgtttatgtaattcgtcgagttatcatatgcacgttgcaatctctgttagttgtgttatataacttgttatcggttgtttctcattgttaggaagtgaccgatagggttatgtttcgttattaagttagattatatcgtgtatctatcatctcttagatgttttcatcatcttgcttagatcttatacttatctttatgcttaatgttgcatcagttgagttcgatctattaagtaatacctataattgtaatatctggcttgttttatgatcatcgagagagatagcatcggggtttcagtcgatcttatctgatttagctactttgtatctcatatgcttgattgacatgctagatctgccctttatgctaagatcttatagcattaaggtatattaggcattttgttcgatatattctgcttgttttaatatcttaatatagagtggtatcggagtattagccgatacatgctagatctatctgatcggctatgctataaatgtctatataatcagtactttaatgtatatttcgacttaagtgatttatactgtctcggcatggcgaccgatctatcctaatcacttagtttaaatatacatcgaatgatcgattatatgtcgttaatatctatagccaattgagtagatttagttttactttatttatacacaactgccgatcgattccaatatgacatcggcatcggctcgaagataaatgatatgccatcggcaactagccgatcggctatcgtatatggatttaaccgtggttttcttgtctttctttcttgttgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaa

SEQ ID NO: 35606 - DNA, 1024 bp, Oryza sativa
taattatagtgaaatttggtcttcaaccgtgaatttggtcataaacaatctaaagacatccatggattaaaaaaacaattatatgatttagatgtcgtagttacttgattttttaacaaataaagtatgaaaataggataaagaattaatggaaaatagaacagggaatcgaaggaagggagggagtaagtacataatgctcggtggggccgggtttaggagatgatttttaaaaaaaaaaattataatagttgtaaataatgggtccaccgaattgaatgaaaatcgacggttattttttaaagtgcaatgtgacggcttagaagcgtttataggatgccacgtgatgacttacgagcgtttgtagaaagtttaatggacttttagtatagatatatgatttttcaataaactacctcttattctaaactgctcatttcaattttattttattttcttattacacaacaaatgcacacgcaaactacatcactacacatagtcacatacttaggcaaatgtgcccctaacacatgcttaaaaagacataaacagaaatcagcagcatatctctgatcttattaaaaagacattagatttgaactctgatgggtaaaatcatgctgacccaccgagaaatccgaagtctgaaaaacagaaattcaccaaaagatgaaacggaaagaaggcacgtgaatccatgttgaaaattttacttgcgtatgaaatactgaatggggaaatgcatgaatgggtgacagcaattcgatttctgtgtccacattagacacccagaggaaagcattatttttgtttaatttaaagtacttgacaacgaaattgttaagaaatatatatatatgatctcatccatccgatggaataggcattgcggttgccatgcctcccgttaccacaaccggcagagaagggaataaggctaccatgccccttctctccttcggcacttcttgacaactggcgcgatggttcgcgctcctgtggttctgaccgtatccccttg

SEQ ID NO: 35607 - DNA, 1125 bp, Oryza sativa
ttagagttcactttaggatcatctagctttagatctactcgggtagtcctcttgggtgtttgaacaaatatagagatgaaagagagggtttagagaccgaccagtaaaggtggaggaggagaaagtgccggccatcgtcgttgtcgtcgcgtgcttgtcgtggacggtggcgacggtgggcttgacggtgatggcggtcgtggcagcggcggtcgtagccgccgatgacgaggcatggtgcagcggtgatgcttcccgtcactggctacgccccctcgatcggttagggttttgtgggtggagttggcggcggaaccgaacctcatatcatgtgccgccccggcctccaccctctatttatatggcgcaaggtgacgggggcccaccagtcaatgggctgggcgcccccgatcagggcgcgggtcaaggtccccttgtgtcgttgggctcaaggggagggagatctatctaatattctcccccttgatctcactatttcttttagcttttttctattccatcatagatttgcacatagagcatgtttcatcgtcacggttaatcactgttggatttgacagctactatacacatctctattcagaaacatatactttaacttttgggccctgtagtccaggattcataaggcttctcttaaacccatgccggctacatgttccttgaacacgttgggtggtaggcctttcgtgagcggatccgcgagcatcctttctattctaatgagctcgagactgattgtttgatcccggactttgtccttcacaacatagtactttatgtcaatgtgtttggcagcaccacttgactgattgttgtgagcgtacattactgcgggttcgttatcgcagtataactttagtggtttctcaatactgtcaaccacctttaaaccgggtatgaacttctttagccagttcacctgccccgtggcctcatagcatgctataaactcgacatacatagtagaccctccagtgatagtctgttttgagcttttccatgaaatagctcctcctgcaagggtgaacacgtatcccgatgttgactttgcattatcttttgcaaaatcagaatctgaataccccactatctggagcgatt

SEQ ID NO: 35608 - DNA, 2413 bp, Oryza sativa
atactttttcctccaaatctccatttagaaataccgtttttacatccatctaatgtaattccaaatcataatgtgccaccagtgccattattatcctgaaggaatctttacaagagactggagaaaatgtctcattgtaatcaatcccttctctttgcgtgaagccttttgccacaagtcgcgctttaaacttttcaatattccctctggagtcatatttggttttgtagacccatttacagcctaatgttttggctcctttaggaatctcttctaaatcccagacatcgtttagtttcattgatttcatttcatctttcatgtcttctaaccattcagatgagcgtgcgcttctcatggcctcttcatatgaggtgggatcatcctcaatatgtgactcttctatattataaacttcatagttatcacggatagccaatcttctgactctttcagaccttctaggggcctcctcatttggcacattctgtacctgagactcttgttgagcctcccgttctggcacattatctatttgaggctattgcagctcctcctctggtgtggcaataatttctgttgagtcctgtagaacaggttcctcattttcattcattgttgccacaggaggggtaacaacaggtgctggtaccgcaacgtcatgcattgcaggcacaacatcagcaggtagagagaagaaaggctcctaagtcgacgaagcgggtacagacacccgcctcttctcaagatcaatttctcgaactactgagctccccctaatcattttgtcttccaagaagacggcgtgtatcgtttagacagtagaaacgataaccctttgatctagaataaccaacataatgagattcatttacaaatgtaataatgttctcacctttctttgccatgatcattttcaggaagtcaggataatctttatagtagttccttttcttgcagtggagacactgatccttttcaactgtgaactgttgttgctgaggcagatgctgaggctgttttgcttttgaggagggtgtcttgtagttcttttccttgttatctttaacaaagttaatagagccaccattggactcttttgattcttttctcctcttgcacacaattagcgatgagcttttcaaaattccatttctttggacttattttgtagttgacaacaaagttgtcaaagtgctttggcaatgaggccataaccagatggatcagaaagtaatctaagatgcccaaatccattggcttcaacttggaagccatgttgctcatcctaagaatgtggtctcttacaccacctccatggtacctctctgtcacaagctgctttatcagctgtgtagcataaatctttgaagaaccagtaaactggctctttattattttgaggtactcaaagacggtgtcacactttgggattaagcccaatatagttggctcaattgtgttctttaccgcagccaaacatttcttgttggctaaggaccatttcgcatgctcaatgtcatacgacattatgaggggagcattgtccctctctctcttttgccagtcagcatctgactctttttcacctctgacaagtgcagcaggttctatcggatatggggtggtcaacacccagtccacctttcctaagataaaagcaaggtcgagtttttttttccattctgcgtagttatctcccttcaaggtcggaatatctttaatgcaacccataggagtagccacctgaaataatcatgtacagtgagaacaaaattaacattaaaatgttatgcattaaatctacatcaccgttaggcaaaaatagagataacacataaggccataactataacattgcaattaacaacgttggtcagaaaattacaacatcatagtacagaattaatgttcctaaaattaaattctcccgttggttcgaaatttaaatttagaaacactaatttttatcaatttcatctatttgcagcggaagatctatataaaattcatatgaacagtagcaaattatgttatttacactatgtaaaaattacacctttggttcaaaatttaaacagaggtaaggcatgcaaaatcgattaaaaaatctattgaaatttgcatgaaaatagacaaaataaaaagaaagtcgctaccgttccttttcttcattttggcccatcaaagaagtcggcccatcgccgggcgtgtgcgggcgcccccctccccccaggccggaacctgggcctgggcctgaaagcccgccgcgcgcgccttccatattgggctcaatttggcctggctgacgccggccatccaatcgctagggtttcgatcggatggccaggcggagagatcgggcggtaaaataaacccgacccccagccgcgcggcaaaaaccctagcctct

SEQ ID NO: 35609 - DNA, 7044 bp, Oryza sativa
cgagcgacgacgacggctccagatccgcgcgccgccggcttccctcctcgccgcttccgccggccacttcctctcctcccctccgtccgctgccgtcggcgcccgtggtgaggccggcggcggcgccccatggttttttttattttcctgagatgattttcacagccgggctgtggcccgcctgcgaaaatggtctattttcccagtcgagatggtagcggcggtcctctcctccgcctgcgaaaatggttttggaccgcctggaaaaatcttttttctagtagtgctaatctactgctgcatggacggtggagcccgggcaactgcccgtggtggccaggtcctggctccgccaacataacacaagctttttttttttcttttttcgcgatcgatcacacatgaaaattgaaaaggcagaattatgcatttttcatattagttttgttaacgtaaatctatgcaatttgatccctgttgccagctatttctgaaaggattccatggttataatcatgaaaatgatcctgcactggtccatactttttttctttggtctcaatcctgcacaatagtttctttacagagttttcctcctgacaaaagaaaatgatatataaaactggcacaatttattgacatttgcatcataattggttagtgccctaatggcaagtgttctactcaagggactgtcctgagtattaacttaagaaactctgaagttgccatcgattgcaactgttcatagtgaccacattcttaagttaatacatcatgagtttgttatatttctttccacttctctatatgtataaaaaaaatagtgttctctgaccatgcttttttgcgattatctgacaatatataaacaatgtaatgttttctgaagacatttgtatctctgtatccctctcccccatcctttttgttctgtggggtggatggatgggcctatcaaaaggttgttccattatcatttgaatgcacctataataagaactaacaattggcaaacaacagttttccttcagaactagggactgttgtttcaatccaaaaatagtcatagttttactgccatgtctcttatagcttttgctgctgtgcgactagcccatcatgatgatctgacttacaatgcttgtgtctcttgctcttgatctccttctatcagtcactctaggtgcagctaatttctgttcgtctcctgacatttctagggatgcaagatatcgaagatcgatggaaattgctgccgcctacaaggtgcaagaaatcatcacatccggcatttaagtgtgtgaaagactggttctgatttttttttttgctttgttgtgtttcttctctgtgccatagctagaagctagactgaaaacaactatggtatttttaggcttttttatcttagtgaattcatgtaaaaatatttagttatggttctatccagtttttgatggttgttcttgaagggtactagttactatttttagcaggagtgccataggagctaatttagctaaacttgttgcatcggttaataacaccatcgaatatttcatttgccaaccttttgtagacctgaattttgaaaaccaattagaaagtagacacgggctataatgagcgcctcttggcgcgctaattttttaagtatatcagtgcattcacatagtactcgatttttttaaataaatgttttgattcgtgcatgaatcactgttttgcagccataccacaagctgacttaaaaattgcaaattgctgaaaggtacaatcgtataagaaacaaaatgattttcacatcacttcgcaaactacattttttccctacaaccaccggaactcaatatagttcctacgcagcttcatcattcataacagaacaactagcaagttcaattcaatttaaagagatcgaatggtgattcacactctaaagcaaacttagactaaaaattaatagtatctttaaagattaaccttaagggtaaaaaaatctgcaatccctgcaaacaataatgcttgcttcaatatggtatacttagtcatatacatggacattctccaataaaacattttgttttttttgacgcaaataataaaacattttgtaatctacagctcataactcaaaccatattgaccatctcatgaaaagtcacattacacatcacaaattaattccagccacaacttttagttcatgtgctcacctattggatttgcatgaaaggggcagggctgagtagcaaattgacgcacagtaacagcagatgcagatccagtagagtgaagggagcaggattttagtgggaatcaactttcgtaactgtggcatttggggagttcatataattctaaactaacatggtaggttgtctgtagctcatatacaaataatctgcacccaaaccagtgccaaaatatacgaacaaatgcagaaattcgcttaggcaatactgcaaacaccttaagtgcgcaaaaaactgaagtaaatttaaacgatgtaaatggagaggaatgaacctgcagatgtcacagtgttcagtgcagatgtcgatggtggcaccgcgatgggcagaaggcgggcgggccgcagggcgctcgacggcggcgagtctctcccacgagctaggtcaccgggcggcgctacggcgcatcgatgggcaatgccgcagcgggcgacggtcggccgtcgacaaaatgcctccaaatgctgtacatcctgtagtgtctgaggatggtaggtgggtttggccaccaaccaggcaaaaccacacaattcccccatccttggccttgcgcttgcgcattagggtgagccaaaaagaaattaaaaaaaaaaacaactgaggtttctttccctcaacacataaatacccgacaatgccctagccgctcgacgttcataccgcagcatagagcacacgcttggtgtcgcggcggcggattgatggcagggaagacggatatcatccgcgatatcatcggcggctgggtggtggacgagacgtgcgtatatatttttgtctactactacattccctgattacagaattttctgtgttggagttagttttcttcttcttcttcttcttcttcttcttcttcttccaggtttggttttgctcttgtgattgatgggatttccgaggtacatcggtttccggtttccgagtaatcgctctactattttaggtcgactacgatcttggggataattacattgcttccttttttcttgatgatagagggtctatgtgaatgctgctatactatgaatatgattaacgtggacaacggctgatggatttgattcgatgcgagcggccgttgacatgtgggccccactccaacaatgactaaggttgctcattttggcccaggtcatcgtgaggcccattaagcccatctgcccacgttgtgatgcccagatgccctagttgcaaccgccgccgccgccatctctgcggcggtgtccggattcttcttcttcttcttcttccctcgtcatccgggaacgcggcgaggaggcggcctggctacaggacgtcttcttcttccctctcgtcttccccctcttctccaaccttctcttcacgggccaaaaaaaatctttggtaattggtacggtccgccatgcgggcggtccttgtcgagctcggaagacggcatgagtgctgtaatattggttggattcagttatgaaattaagtagtactgaataatgagattcgggttggatcaaatttattcgaacgggatcggttttgttcttttgtttttggaaagaaccgaatagtttctttttaactatttcctcattttaaagaacggtattatgcgattcaaatcaaatctacgcaagtcaaaatttcaacaaccagttgcgtcaacatgctttttgtctggttaaaagaactgaaagtacgtactatgctttttctctgctttgatgtgtgatcttagtccttttgttcctttcttgttattctctgaatttctcctgtccgtattctaaattggaaaattgcattgatcatgagcagtttgcgttgtgtgtcacaaaatcatgaggattcaattaattacttgttcatgagggtggtgtatatgccattgtgatttagctttctgaggattcaattaatctctcatttaggggataagaggatagattctgaaaatatataagatggcacctggatgtcattgtgatttagcttttaattaatctctcatttaggggataagtggatagattctggaaatatataagatgacaccttgatgtcattgtgaagctttaacattttttttaaggtatttagcttttacttcgatctgaatttctaaacccaccatttttttcgtttgtgttcaaccagagatgcggcattggctggacttcgtgtggcagagcgtgcctattggaaggaatttgtggacagagtattgaaagataccagcagcattgatataactgcgtcaaatatagctgttcccacaaggctacctgtcgagctgcaagtcctgatcaaggttatgatccaccagattcttaacactcagcctggagcaatccctccactagcatttcattggtgttgcaatcagcttcttcagcatttggtgaattcagtaagaacccaaggacagccaactgttgaaccaaatgtacatggacatcaacgttgcaggggtgcaggttggtcatcggggattcccgaacgattggccgatcgaaatgtttcagaagatggaggtattggaggagttgattcgaggaggaacattagagagatgaatggtaaaattaaagagacaaatgcaagtcgtgagtcaccccgaatcctcaagcctactggtgagccaaacccatccactggtggcatacggattcagaataatcggcaagagcaacctgcagaaatgaccattttccatccatggaaaaacattactgatagaacatcagcttatgagctaagccatattgacaacttggttaatcatgaagatgatgagacaaagaggcagaaagaacagagtgttcacatcactctgttgtatgagatcaacctcatcaacgaagagcttttcgataccgtgatcagtatcaccggtcacaaacatggtgggacagtgatcaatttcagctacaatgcagtgtctctttgcaaagacatggagctaccatttgcagcatacggaaccgtctctctcaagccgggaagcttatttgtcccagctgattatcctcgaagctccccggtgtacgaagatggtgatgaacagcaccagggaatgtacagcgtgatttcaggcatggttgacaaggtgttccagcgtgccctgcgtaaactcccggtgccaatgtcgatcaggaacatggcccggcagtggggcatctccgtgcgaacggtcaccaacggtggaggaacgttcagctccgggtatggccagtggaagagttgcaccgatgagtttgcaagtccatagtccatggatagacccatgaagttttgcaggaacaagtgatatgaagaataatgctgatctgctgttttgctgtagggcagatgcagaatccagtgtgagtgttgtgagagaatatttatatttttgttatgcattaagaggctgtgtggatcatctgtttttgattaaaccggttttgcttaaaaaatatttcttactacggttgtgaattgtgatatttatctgtttggactgtgtaattggaatgagcgaatttgctagtaaaacatgttttctgaaaactggttcgtatcttttaagatccaaacaaccacttagagtttttattggcaaatactttggtcgttaatcttgcacgtgcaggcttatgcaattattgtgcaacagttcatttcatacttcatactccgggcaagtagtatgaactgaaatgttgcaacgggcttatgcaagtagtatatatatgttcgtctgaaaatttttcacaggaattgaactgttttagttcgatgcaacaagatggaagtctgcaatgcatccgggtctgacattttatttgccacattctgcttgacacatggagttcctcatacagatgttcttcggctgcgtctgacaaagtttagcaaactgaaaagtgaacttatgcctatttagaagcgcacatatctcaaacaaattttgtgggcctcatcgtttgccctatatagaatcaactactactgccaaagtttaatttttaaaacttaattttgaagctttttcattgaaatttttagaattaccttttaagtcgttaaaaacatagagtatataaaagtttttacctataatttttagtccctccggacaacattattttttgtgaacaggctgtacggcgtattctcagtatatagtttttaagcagaagtttcagtctgatttctccatgaacctgcaagaaagaaaaatgcggaagtactgtccttaaccatggaatcctttcagaaataactggcaacagggatcaacttgcatagatttacgttaacaaaactaatatgaaaaatgcataattcttctatttccaagaggtaaagtgtttcattttaattttcatgtgtgatcgatcgaaaaaaaaaaagaagcttgtgttatgttggtggagccaggacctggccaccatggcagttgcccgggctccaccgtccatgcagcagtagattaggatttaattactgtgattactgaccttgcagccacatggagtacataaatacaatgcttaagcaaaggcaaagtgctataatcattgtgtattttggtgaaacataattgaatcatatggtaaaacattttggtgtagcgtttgaaacgtcaagtttcaattgttgaaacatccacgcagggacagatccagaacaaaaaatggggggagggggctcaattacactgcttctttaacctccagttatataggaacctttagtttattattcatggtgaaaaaactaaaggggtactccgggggtatccatagatcttgggggtgta

SEQ ID NO: 35610 - DNA, 4889 bp, Oryza sativa
ttttaagtattttaattccttctcagcctatacacttagctcttatatggattactaataaagtctagggctccaaggttcaaatatcgatcctttttttccttttacttctattccttcattgttgttgtcctgacgtttcatggtcttatattttgggaagatttgcctgtggctctgaatgactgccctgttggaatgagctaaccggggcaaattatcaatacatcattattggtcccatgcttcaaagtacaatactccggaaaaataattattcattagccttgcttggtaactttttgaagctgtttgttaactctataatgtaatatttaattcattgttataagtaaattatcttatattatcagaatatgctgcgtcatctaaaaataataggccctagcttagctagggcattggaaaaacactgctccttgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcaggaggctggcgtagtggacgggcggggaacgagggagcgacgtcacctgcatgtggagggagaagagggcggcggcacacgtggagggagtaggggcgacgacgatgtgtgtgaagggagaagcagcaatgaactggtcaggagaaggagggagcgacgtcaccggcgcgcggagatagaaggggcggcgctcgtgcgaagggagcagcggtggtgacactgcgcacagagggagcaaattaaggtggtggcgtgcggaggaagcagatgcacatatcatacgtgtatatgtgtgtgtgagtgtattttatatatacgcatacttttgatgtataaaaaatgtaaacacgtatgcaaagtttgtatatttagagattcaaaaagtttatataagtatgtatataaaatttagacagatgggctgaactgatctcgcgggctgggctgaaaaaagaaaacccaagacggaaagtggacgcgcgcggtctggcgtcacctgggccgaaatggaaaacgcggggtggtggtcgcgcggctagctgcaaattagctatctcgcccaccacgaccagctctgcaatgtaaccacagctatcgtctgccctagagagagttgagaccacgctgcctagtaggttgactccgccgcctcgaccagcaacgctgccgccatttgcacacgctagctcgacctcttgctctgttgtcgtcgttctcgcttccgatggcggctgcaggcggcggatcgttgctggatcagtcgaggcacgccatgcgcagctgggtactcaagaatatgtgagtagtatttctctaataatccctcatccaattatgtgaattacttttgctgcttctgcagctttttttcccgctgttcttgtgatgaattttgttgttgcataattattggtttctttccagtttcttgattaattccttcgaattgttccatgctagctccacgccctatactagaagattctcctactacttagagcggagtatctgtttttgcgttgcctacaaatcgatcgatttgccttgattttgggttaattttcgttactttttcttgattgaggatttacatctactacttttgaaaggatttttatcactaaacggctaagattagatatattttgctcgccaggagggtagttaagagctatagccaacaagcttgtgctcgttgatttagagctgccagcaagagctaattgatcaaaagctcaagatcgagcgaggcttttgaaacttggaacgcaagatgtagatcacatacctcagctggtaacgtcacccaaaatgattaacgcgtcagcctcattgctgcaaacaaattaaaccagcagaaattaatcaagcttgtgctcgtggacggccggatcgcagtgaagcaggaacgcttcgatcggacggtgcatgttgcggcatagctagcaagctcgcgcgatcggtgggatgagaagaacgcgtagtaggttaccaaacactacggctttctagttttatacatataataatgattctctctcggctgcatcgtcttagtactagctattttcttctttcctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtggtttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgc

SEQ ID NO: 35611 - DNA, 4789 bp, Oryza sativa
atgtcggtatccacgtacatcgggacattcccatcccatcccctcctcctctcatcttgtttctcaagctacaattaatggtggatcctagcgggcgcgctctctctctctgggtcatgaatcttctgataaaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattataggtgcgtataaaaactgagcagagctaagctgttggtccttatcctcttgaggcagataaggggaggaggactcggtctctccccggtctcctctctctcccggctctctctcgctctcctctctctggctctctctctatctatcgatctctctctttgtcgcttaaagtcaacaaatagttgcatcaaaagctttaattttgtctgctttgatgtatgatctcagtcctttacttccttctggattgcttcagtacttcctttgaaattggaaaattgcattgagcgtgtgtggtgatacattctgtgtgtaacaaaatcacgtgtttatgaggaatcatttaattacttgttcatcaggcaggtatagacatagtaggaacaggttctggaaacatataacatgacactaggtaggatctcattgtggcatcaattttttttgtcgacatttatctgaatttctgaaccctattctttttgttcaatcagagagaaattggcaggacattatggtgcagagttcaactctttgcgggcatttgaggacagggtattcaatgagaccagcagcattgatgattatatttctaaaatatcaacgaagatggctattttggagcgaccgcagtcttcttcaggtatgcagcatcaagggcagatgggaaatcaaacgaggctgcctactacagttatgcaagaacagccacagccacagcagcagccgcatttgatgtcaaataatcatcaccaaacacatggaggatggcagagcaatgttgcaagggtacagatgatcactggtgttggagaagtgaattggagggaggaaatgtttcagaagatcagcgttttaaagaactctttcttttccgagcttacggattttgaccgtttacttcacaattgccaaaaaacagaagaacagttgcagtcactacctaaaaagcaagctgaccaatacaagcggataacaaagctcaaggatgcggttaggagtgctctggatttattgcagctccagaagagcagcatcgatgaaggcatgaaggtgaaattctgcaagtacgaaagctccatacatagcctactcagattctacagggaaacaaaagctaaaattaatgagatgaatgcaaatcgtcataacaatcagcaagagcaacctgcaggcctgccgaggcaaagaattactgacagaactccatcgtcagctcgtcggcaaaaccgcaatgacaacgtgataggccaatcagaggataaattgcgatgcagggttgaatcagttgtagccaagaagaagcccatcgaccgcctaatcaacgctctgcggcacagtgtagaggatgaccgtacggacgtcaagaggcagaaaacacggcatgttaacagtgccctggcgaacgagatcgacgccatgaacgccaagctgatcgataccgtggttagaatcgccggtgagaaagatggtgggacagagattgaattcagctacactgcagtgtctcttgcactagacatgaagcagctatttgcagcatatgggacgtctcctgtcaagccggtgaaactattcgtccctgctgattaccctcgaagttctccggtggtctcgaacaacaacgatgatggagatgaacagcggcgaggaatgttcggcgagatctcgggcatggtcagtgcggcttttcactgcgcgctgcgtgagctcccgccgtccatgtcagtcaagcagatggcctcggagtggaattcctgcgtgcagatgatcatgaagaaatttgcgatacggcacggtggaggaacgttcagctccaggcatggccagtggatggattgcaccgttgaatgatttagtaccgtgaggtaccgatacctcgagatactttttgttgtaccgaagcaaatctcttaattattacatgaggatgaagtgatacggagaaccgtatttgatctgttgtattgctgctggagggtacatgcataatccgctctgtgtatcatttgttttgattaagctggtattgcttttgatatttctctgtctggattttgtaattggaacaagcaaaatcgcttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaattttgcatgtgttcaaaataccggaaagattttgtgaggagtatgaacagatggtgagaaatttttggtagggacatgataaaggagaacggaaggtacactcgattggttgggaaaagttaatgagtcccaaactattccgaggacttggttttcgggacattagatgctttaaccaagccttactagcaacgcaggcatggagactgttcgataatccagataatttatgtgcttgggtgctaaaggtgaagtactatccaaatggatcactaattgacacggccttcccttcaagttcatcgccgacttggaagggcatcgagtatggactagagttgttgaagaaagacttgatatggatagttggagatgggcaccaaattaaaatctagaggagtcaatgggttgcacatagggaaaacccagtgattctgtagaagaaggcctggaatcgtctcacgtatgtacatgagctcatgttgccggaaaccaaaacgtggaatcagcctttaatcagacatgtgtcacgcccagaaattcactagtaatttccgaactaatttgtgcattaaatcctcgtccaggaatcagccaaggtacacaaactgacaatttaatatacagattcatcaaattaactaaaacgataaatacttacttaagaggcacttagttctcaccatgaagaaaactgcagcggaaaataaaatctagcgaagctccggctccactcccacaggcagctcaactggggtatgagccaaacgtcttctccttctgaatcctttttcttcaactgaggtttgatggttattgcaaggtgagcatatgacatactcagcaagccacacaacaaatatgcaagtgcacaaggataccaaagaatggtataatatagggcttatttgcaaaagcagcatttagcaaacttttgagaattgtaaaacagtagagcaattaatcatcaatattaatcaacactgtacaacacacccatgctgcacaggcccaaccatcctgaacaaccatacccggctgtacagatctatctccaaaccaggaatgtaccattccaaaccaggagctaatcaaattattatcagttatagcatcttttattatggtgagaagtgtgagactaatcacgaaagacattgttagacccgcccataactgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcgggtataaataacatctagctgaaccaatccaatatataaggtccatgctagtcaa

SEQ ID NO: 35612 - DNA, 10023 bp, Oryza sativa
tgtgacagtacccctcgcacaacacaatccaccacagtgcaccgttcttggatcataatcacccccttataaacaaggtatggactccccagcgacccccgtgggcttatctccgccacttctcagtctagtgctccgcaatgaaccatgctatataaaaggtaaagccgttgcccccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgacctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgaccacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactcaacggcggcagcggcgaccgaaggcgacgaccacagcgacggcgcggggctgctggagcggcggccggaggtggagagagaaggcgagcgcggggagagcgattccggcgagattcggcgcaagggaacgggtggccggggtagctctcacccttgcgaaacccaaggaggctacggcgcatgtcggggtcgaccgagaaggcggcgcgacgcggctggagggtcaccggcgtcggcggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaatgaagaggagattgagaggattccattcccacaactaatttggaaataggagcaacggagaggacgaatttgatggggaggcggcgctgtacacgggcacggcagggaggatatcggccggctggaggttaggggcgacactgtagcagagggggacaaaacagacttatttccgggcttcatttcctcggcccgattgaaggaggaaggcaaatagaacttcgtcagagagaggaagagaagatgcaggctcgggttgggccggcggaagagagaggaaggaagggaatgggccggattcggcccgagacaaagaagtggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattcctttttttacaacaatttataatatagcgattttcagggtgtgacatagtccaggaaaatgatgcatccgaaattctgaagatcaaaatacctggaagggagatgtcggactttccagcatggcatcttgagaagacaggaattttcactgtcaggagcgcctataggttagcatggaatcaatcagggaaggctcgtgtggaatcttcatctagcacggcgacaaatggtgaaaggaagctttggaagaatatatggcaaacaaatgctcaaccaaaagtgagaatttttgcatggaagctagccaggacagattgcccacttggggaaataagggcctgtttaattcgcgaaaagaaaatttttgggtgtcacatcagacgtttgaccggatatcggaaggggttttcggacacgaataaaaaaactaatttcataactcgcgtggaaatcacaagacgaatcttttgagcctaattaattcgtcattagcacatgtgggttgctatagcacttatggcaaatcatgggctaattagactcaaaagattcgtctcgcgatttcccccctaactgtgcaattagttttttaaaaaatctatatttaatgcttcatgcatgtatccaaagattcgatgtgatgtttttgggaaaaactttttgggaaccaggattcttgtggttccggggaatccagctacaggagaaccaggaacggggagctctcccctgccctaagagaaagagaaagatagaacagagtggcatatgcccgatctgcgggatggctgaagagaacgggtttcatgtacggtggagtgcactctagctagaggtttacgggaggcaatgagaacacattggctattgccggttgaaacgagttttgcatatacagggccggactggctgttagtgctgctggatagttcgcagtgttcagaaaaggcacatgttatgtatttactctggagagtttggcacctgcgaaacaacatgatccatggcaaaggaagtgcatcaattgctgatttggtcagtttcttggttagctatgaaggccaactgttgccaatccgacaacaagaagatgaccacaaaggaaagggccctatatacatggaaccgaaccagatatctctctctacaagtatcagcaaactgactgacaaatggtgtccaccgccggagcgcttcgctaaactgaatgttgacgcaggttatagggaagaaaccggggatgctagtgtcgggtttatatttagagattgcaggggtttggtgctattggcggcccaaagaaccctgcatcaatgtggctcagctgtctaggcattggcgctagcatatatcttgagggactcagagcggcgactgacttgattcacatgcccattgtgttggagatggacaatgcataaattgttagggatttaataagaaaggaacagctgaaatcggcctgggcgacgacaattgaagatattaaaggagtgatgcaaagtgcaagtgcacaagataaagagagaagcaaatagggtagcacatgttttagcacaaatggctgtcttgagggactcagagcggcgactgacttgattcacatgcccattgtgttggagatggacaatgcagaaattgttagagatttaataagagaggaacagctgaaatcggcctgggcgacgacgattgaagagattaaaggagtgatgcaaagtgcaagacttgattcatatgcccattgtgttggagatggacaatgcagaaattgttagagatttagtaagacaggaacagctgaaatcggcctgggcgacgatgattgaagagattaaatgagtgatgcaaagtgcaagtacacaagataaagagagaagcaaatagggtagcacatgttttagcacaaatgacaatgagttgtaggtcctacgcggagtggaggttgtgtgctcccgcaagaattctagacttattaaatcaggagtgtaatcccttatttaagcattaataaagctctctttaccctcatttttttttgcatgtgctagaatcgatcgcagaatgaatacgaaaatgcgtgtgccatattccgttctactccagttgggttgaggccatggcttgcgtacatggtggatttgtgggcttctcgttctgggccagaggaaacgagggacccaacataagaatataacaggctgtgggctcgtgggctcaattttaatacttcccagctagcattcgacaccgtttttggatttttagttttccaaatttatttctgtttgttttaatactttgtcaagcaatcaagttataataataaaatataatgatttttttttaaaaaaacagtcaagataggtttgtacttacacttagctcttatatggtttattaactaattgagtgaaatatagtttgggccatttttatggttgaagattcactttggacctccttttaaggtaacattttcactttgcaccattttaaggccctgtttagagtctaacttttttttccaaacttctaacttttccgtcacatcgaactttcctaaacacacaaacttccaacttttccgtcacatcatttcaatttcttcaaactttcaattttggcgtggaactaaacacatcctaactctattttcttttagccacatacaacttcgtctctggtaaagaagtagattgaacacaagtgtgagagattgccagcatgtggatgtaagtgcgcttgaggctgttgatgtgcttgagaaaagagttgttgtggttcaaactgtaataaaggtagatttatctagtccgaagtaaaaatattagataaagatagttcaacgtaaaacattggcaataaaagttagtccgatccaaaccacagttttaggcatttgatttcaagcttcaaattgtgctcgaatttttttatagttttttatggattttttttgagaaagagagcgtaagctccccatttcattaacaaaatgcaaattaccacatgttcagtacagagttcagaaaactaaaaagaaagaaaaacttgaaatatataatatataacatttcattaactaaagttcagagttttttatggaatatataatatattatgagtccctaatatggatttgacaccaacctctttaaatttagttttaattttcttcattcattgtcacgacgttccaaggtcttatttaatctggaagaagtggaaaatttggctcgtcgatcgtagctcaaaataaccatggttagcattcgaatacgactacaaaataaacatgacatacttttcaaaaaaaataaattgtgaagcccatacactagaacaggatcgcttatctgtgacgggctgaaagcatcatcactatcgggtaaggcccccgtcaatgggcaaaggtcactgatgtgaggaaaaatctcaatcgggcaaaagcccgtcacggatggatgttatctcaatcgggccgaaaacaaagcccgtcacagatgagtatgaccagtcaaaccagcgtagtaagaagcctgtcacggatgactaatctcaatcgggcacaccactaagcccgtgacggatgagtagtcatctccatcgggcatttagccagagcccgtcactgataggtttgacgccacgtgttgagtcaaactagtcccggttcggacgacttatctctatcgggtgtattctaaaagcccgtcacggatgactaatctctaacgggctggactctatagcccgtcacgggatgagttatctctttcgggcattagctaaatgcccgtcagggatgagtttagaaccaaaaaaaaaataaaatttgtctttttggctagcctcagacctttgctagccatgcccgctgcaaaaatgacagaagcatatatatatacatagtcccattcccagcaaccccattcccagcatcaattcacatattccatcacagccatttcatatagacccattaccagcatcacatcagccaattcacattcatattccatcacagcacagtcaattcacaaaatcaagcacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctaaagaatataattgtattacaaagaatatttacaaaaatcaaatgtttgtcgcatatgcattgcaaatgttctgccattctgagacgagctacctaggacttcactctaaacatccctttcggtgacaagatatcatctagtatgaattgtgctatctcctctctaatgatttcgaagttgatttctggaatccttgaaataaattcctgcatgttcggcgccaagttagtctacatacttgtaaatttgtcgtcctatgtgtatataaacaattgaattacacaccttagggtcgagcaatgtcaccttgtctgcgaagctcctcatgttatggcagacatggaacccacactggttgctaacttgttgacatattgggaagtctttcttgtgaccgagtttgggatgcccatccttatgcctcccgcctcttgccacgtattggtcccatgcctcgttcaaggaagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactgttgattgtaggcgcacataatgaagtccttgtcttgacgggcaaataagcagtccttgatataggtcaccatgtttgctcgatcatttttcagcgttgtcacgttgacgacagctggatcgagtaaggcaatatggggtgctttacgatggacatgcttccaggttaacctacaagcaagacatgagtcagggtaagcgtaatttatggacagtcgctaccatatcgcgtaccaagaaatacttacaaggagtagcacttaaggaggttggtgtcgatcgctcgcaccctatagaggtcccatagatctttgaagtctacggcgatgaaggcagtaggcccgaggaacggctgaccatcgtgctggcccaacatggaggtctctctattcttcctccttgcattggacttctccctgtagtacctgtgcaactccttgcatgcagggcccatcttgaataaggcatcgtctccgaccaatggcatgcccaatgtgaattctgctggaggctttggaggagctactggtgccttgccaagatcaagcttctttggggctaatggcacctttatttttcctctccccgttccagcagcttttctgcgtgtgtcaagcttgggtggagaagatttcgccctcttgctccttttcgcagaaggggggaggtgcggcctgctgtcaacctccataccgtcgtcccaaaaatcagtatcatactgtaattggagatcttcatctctttgttcaacggcaggagggagagatacaacagtttgatggggatgcgtcggcggcggacgagaacttggcgctggccttggagttatattgatctcaatgttgtgcttgggccattgaataaaggtcccacgtgcagccccaagggtcagaatctcgtcattaggtgggtgtgggatagtgtagccaacccaatcgggcttcactaagtccacctgaactttggcattgccggcttgctgctgcgccccatgcactcgggtctccggggtaggcttgaaagcttgaccctctgcggcaggaattgcaaatcctggtgtcaccctaacgactagggtacacgatgtgggttcctgcgatagattcattagtgtccttagtatatgttgcaatgtattgtggtgctaatataatatatgcgttcctgcgatagattcattagtgtccttagtatatgttgcaatgtattgtggtgctaatataatatatgcgttattaagttgtttttaccgttatgtggtccaccgcggcggggccttcaggctgttctgtcggagcctcagttgatgcgcagctgctacgcctctgcgtggggctcacttgtactatgggaccgggagtggcatcggtcgacctatccctgatgcgtgcctccatccgagcctccatatctaacagctcggcagtgagctcttctctaagctcttctttaagctcctcccgaagttgggccttaatgcgtgcagctttctgtgccttggaaagcttgtgcttcttgtactgccacgcgtattggaaaaacccaaacttccatggaacattggagccaatgcccttagtttgtccacggtgttcttcatttcccaacgctttcgtgcggatgtcatcctcgcgtttttgtgagcatacctcttgggaggcctgtctctcagcattcagttcgacctggggtacagttaggacgcgttagacgaagaacaagatacaacataatgaaacttattctatgtgttcaatttacgattttctggtacaccgcttgatcttcgggatttggaaacgaaagagttccgtcactattcttcttcacccttgcccttgcccagttccttgcccgctggaccgggatatcagcaagcacttgcggggtgttagattccgctgcagcttcatcctcgttgtcccattctgcctgtttccccgtgtagcctccggtgccaagccggtgcgggtgaaggttccttgcctgcagatcacggtaggtctggcttttttctcgagactctttcgtttatttggcggcatggaactcatcccacacgggttgggtgatgaatgggtatttcccaaatggttctggctgggcggggttgaggacgtactccgtgtccagcgttgtcttgaaatttttccaacaattccccatcttgcggatagcctgccgcttcagtcctgcctcggcctctgtagggtatcagaagctttccttgaactacctccaggcctcttctttttcttcttgagggaccagatcgatgtggtccttcagaatagtgaagttccgcctccctaggactccgcatatcgtagggaactttttgacagctttcgtcggagccgtcggatatccaacatcgtccacctctgttatggtgtagacttccttagtaatcttattatgggtcctaggattctggctcgatgtagtcccagtagtggtcatcgacatcggttcgccttgctgcgacatgtcctatgtcactgttgtacgggagaaagtactttttaaacacaaaattgcatctatacacattctcttatggtttgatatacctctatctcctacctgcgttcgcctcgtcgatggaaccatagcatccatggtcaatagggccggag

SEQ ID NO: 35613 - DNA, 418 bp, Oryza sativa
aaaacattatgaaggcaccaacaaattttagcagctagacagggcatattaactactccctcagtttccatttacatgtcactttggtcactttaaggtttcaaaatacttgtcactacacacttaccaatgtagttatttccattttgccctttgtgagtctaaaatgataattagttggcatatatatttagaagcttctagattatacatcccactcaagtaagagcccttttgtcatgttaccttgaacaagttgatttacatttggtttgtatgcatgggcacaagtgacaaataaataaaaacggccgtagtaaaatgtgagcctggaccaactcatgtactactagcaaagcgtagcaacaaacaattttgcacacagggttaaggaaaaatatgccattcatattctatg

SEQ ID NO: 35614 - DNA, 338 bp, Oryza sativa
acagtagctcatcattaaccaactaccttgtacggttcccatctgccgccattttccaactaactcgagctactacaactaataatcatcagtaacacgagctaattaaaagcatcttccagcacggcaggaggagcacacatccctcatcctctgacaccgacatgtgggcccacaccacaggcacttgacctgtgtcggatccggacccgccaacccgacaggtgttcccttcaatgggaggcgagctctccctcccaagagaatttaagaacagagagaggaagtggagagactacttcccccacctccgcctttatatcgatccatctgccccc

SEQ ID NO: 35615 - DNA, 524 bp, Oryza sativa
cacatgacatcggcttgaaataaatgatatgtcatcagcacctagccgatcggctatcatttataggattaattgcggtttctttgttctatctcttgttgattgcaggatcaaatcaactggcacactcatacatccgaaggcgagctttggacctgcactggagttaagcagatctcccaggcctcgtgttttatatcaacagttgtctgcaggtttctccctccaccctccgaattccttctgctggttttgaatttctatgggctttctcttctgcatttgaaccccaattccattgctttccttagcgtctttgtgcatctttgcgaggcctacattggggtagagccctttcttgatctgttccgcttttactacgagttgcgctggatggaatccaatagggtatccggttgcgtcgggttccgacttcgtgatggcatgaagtcgcattatgtccccttccaatgtccctcttctcgcaacaaatggcggaacaggtggttttaccttgaaatcaa

SEQ ID NO: 35616 - DNA, 591 bp, Oryza sativa
gggcgtgtcacatcctcgcgtgtgtaaggttgtcgcgccctgaactcgatctgcgtgatatcttggatcagggggcggcaagcgacacgcgtaaggaggtgatgaaaaaagtcagtgacctgggggagtctgtcctccccctttttaaagagtaggacttcttgtattttttataatttgcaaatcttgaactctggttgctttcgggcgtatgattaccatccttgttcagtgttgatttcgaaagtttttcttgtcgattgtagagatgctggtacgaggatgttcagcagcgcgggtagcccgagtcactagcgataattccggtacttgagtttgaaccacgcgtctcacatgacgtcgaggaccaaactcttgatgtggaggtcgagatggggacaaccacctcaagtgagtagcctttttaacccgtgttgggttagtggtttccaggttgtcttagtggtcgttatgtttagcagatctcgaggatgcccttgcaacccaagatcgtcgtatccaatattagaagacaaaatttgaagtggcggaactctcgagaaccatgctagccgtgaagaaagagcaagt

SEQ ID NO: 35617 - DNA, 385 bp, Oryza sativa
cgcgagaggtacagctcttgcagtcccggcatcccgccgagctccggcggaatgctcccggacaacctgttgcccgtcaggttcagcctcctgagccctttcagcccactcagagatggcgggatgcttccgacgaacacgttgcgggccaaatcaaggaactccaagctctggcagctctccagctcggtcggcacctcgccggagaagcggttccccgacaacgccatgaacgcgagcttcgtgagctggccgacgtcgggagggatcgggccgtccagctggttgtccgacaagtacatcagcagcgacagcgactagagggtgaacagctcactcgggacatggccggagagctcgttgccggagaggttaagcagtgtca

SEQ ID NO: 35618 - DNA, 896 bp, Oryza sativa
gctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagcttactcaagggcagcttggtcagcctcggcttcctcaacgacaacgtggcataacatcagcggtcacttgttcccaacagctacgcgatgagcttgaacttggcttccacaatgatccatgctttcatcaagtgtggcgccgcataattgcagcatactagtgtcgagttcggcgacagtcagtcactggagaggagaaataagtactttagactgtttttttttatgtttcagccaatatgtttttgatgttcctttgtattggatcaaaatcttgcagtgaggttttttgtattgtttcatattctgtccttgaagagtgagattcgtggatgtttcaaacgctacactaaaatgttttaccatatgattcaattatgtttcaccaaaatacacaatgattatagcactttgcctttgcttaagcattggagtatttatgtactccctaccattgcatgtggctgcaaggtcagtaatcacagtaacctactctactagaaaatgcatttttcccgacgtggaggtcttattttcacagtcggacatgactcttggagccaaatgaccgtctaaaaaaaatataaatcggcatgacgttcgctgtccgcctgcaaaaatctattttcgcacgcgcctctttttcacagg

SEQ ID NO: 35619 - DNA, 316 bp, Oryza sativa
aaaaattatttttgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaatcttcatatatacttagcgtaggaattatattaaattaaatgttaaaaagtctaattaacatatgtaaatgccacatgcatgatttaaaccttttaaaaattcgaatagtcatatataagtagcatatg

SEQ ID NO: 35620 - DNA, 4130 bp, Oryza sativa
  unsure (1)..(4130): unsure at all n locations
agccgaattcacctgaaaacctcttgtacgtcctccattagctgttccgacagctgtgtgcaccatgtttacaggaaaaggattaccatcaaccttcatcggcctcttggaatcatcaaatttgatcttgcctccttcaatggctactagaatttgttgcctgaagacttgtaatcattagtagaatgagacccagagttatgccacttgcaataccttcttttgcctaattcctcggccgatggaatcgtatgaccagcggggagttgaatctgcttctctcagagcaacagatcaaaaatcttgttagccttggttatatcaaagtcatacctctcctcttttctagaattctttaccccctagcatggtataacctttttacttcttacccattcagctgcagctatttcacagtcatcatcatcattatccgatccatatatgtaaggacaaacatgattaacccttttagggttctttctggcttctgcagacctctgctcgtgcagggttaccttttgtataagatgtgacaagctatcaaagtcctcagatgagaatatttccctgatcggagcaatcataccctgaaaagccaaaacggctaactgggcatcagtcaaattcaaactatagcacttattccccatctctctgaacctttggatatactcatgcataggttcatcatgcctttgcttgattgctgttaaatcggacaatttcatctcatgaaccccactgtagaaatagctgtgaaattgcttctccaaatcggcccaagtgttgattgatccatatggcacagaagaaaaccaagtaaaagccgatccagacaaggacaaccggaacaacctaactctcaaggcatccacagccgatgcttcaccacattgagctaaaaatcggctaatgtgctcataagttgacacaccatcttgccctgagaattttgaaaaatctagaactttgaacctattaggaagaggaactctctcaaaccactcagggtaaggttgccgatacaagtttccagcatctttcggcttaagcccgaactgttccctcatcacatcggtaatcacatcagcccacggtcgttgctgagttgctccttgcgactgttgttgcttgggctcgaattgattgtactgaagaacaaactgagattgagtgggcccccctgctgatattgagcttgcggcgaaggaggttgatattggtaattcaaattgcccccctgataattctggtagttcggctgaatattacgcaccgagtgttcaggaacaatctgaggtaccaccgtctggtccggctgcacatgatgaactaaatgctctgggacaacctgatttagagcatgttgtcctagctgattgttaggtgttgcaaacccagccgatgcattcattaacccttgctgatgaatcggttgaataacctgttgcgttaatggcatttgctgaatcgactgcaaaacctgccgtcttggtggcgtctgttgaattggttgcacaacctgttggattgggggtgtttgctaagctggttgcacaaactgctgccttggcggtgtttgctgaatcggctgctgctggactagaacaacaataggttgaggtggtaagaacatggccgcaacctgatcttgcgtagccgattcacatcctgccccctatgctgtggttgttctctcatcaacaaccgaggactaactagttggcctggtgccgacgtagacgcagcaagtgcgggagccgataccggtgccgtcggctgagctgatggcgcattgggaggaactgtttaaacagatggctgagtattggtgatcagaggccgataatctggaaagacacctccttgcaaataaactgggcctgtagcctgatattcagccattgaaccatcaaccattgatttcatcatgtttgacaaggtattgactaacaccccagactgattgatcaaagcattgtgcacggcatagtcaacccgatcttggaagttattgaaaagctcatgtgctgcattgccattctgactaagatttccaccttgtaatccttgggaattatcaccttgagaaccaagaccttgaacttcttgaaaaccatcgccttgatttccttgagaaccatttgcaacaccttgatcacctggctgagccataccatctggagcctgttttagttcaccatctttggaagaacctgtcccaggaacatccgcaaccaccattaatttatacttctgaaccaacgttcccttgcgggtctgtgtaaatgaactcaaaaattggttctttgcttgctgcatcattgcttcaagatccttatgctgttcaggtgtcaatttatccagagtgatgggcataatgttgctctcatcaacctcagacagacccaacttaaggatcttagctttgacagaatcaggttctctagccgaggacggtgacggtggcggtttctcggccatgaggaaaactgctgttgtgactctgacttctaatcagtcctatcaggcatgccaaaagcgtattgacagaaaacacgaggcctgggagatctgcttaactccagtgcaggtccaaaactcgccttcggatgtatgagcatgccagttgatttgatcctacaatcaacaagaaataaagacaaagaaaccgtggttaaatccataaatgatagtcgatcggctaagtgccgatgacatatcatttacctttgggccgatgtcatatgtacatcgatcgatagccataaatgaataaaaaggaactaaatctactcaatcggctgtagatattaacaatatataatccttatgtcgatatatacttaaatcaagtgattgggatagatcggtcgccatggggagacagtataaatcacttagatcgatataatctaagccaacgtcgctatttaacctaatcggccgccttgtgttaacagatgttagccgattgtaggttagatgacgatattatcaaagattatataagatatatgataactcgatgaattacataaacaagattagagtataataaagatgcaagcactaatcccgagaacgcaagccgccataacaagtcttacctcttgttgaagatcgaaaccgatgcagctcaacccaaaagcaagaactcatcgaaacaaaacaaaagtaaaagggtggcgatgcgccgagattgtattgatagtgtgtgttaataattacatagggctcggggtctatttatacccaagaattacaagatatgtccaaatcggacacgactattatctctaacaatctctaagataccataagtctttacgacagacttttacccacatttatctctaaagaatttacataaaatatcctaattaatagatacaattgccttctcagaactcaatccatgcgcggcaatcatattgnnnnnnnnnnnnnnnnnnnnnnnnnnnnnnnnnnnnnnnnctcgggtcggctaaaatcgccaaacggggcccagaaccgagccgtgccccggggcgtagtgaactccgggggggaatcagcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgtggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgccgtcatcgtcctcctcgtcggagttgaaggcgaacgcgagccgaggggtcgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtatgag

SEQ ID NO: 35621 - DNA, 9131 bp, Oryza sativa
catcagttaacatggtttttaccttgccagccgaattcgagatcaaacaaaccgatgttgacaaagtagaagaagaatcggctaagttggttctatcaccagaacaagcaatctttgagaagcctgaggggacagaaaatcggcatgctaaaccattgtatataaatggctatgtcaatgggaagccgatgtctaagatgatgatcgatggtggggctgcagtaaatttgatgccttaagctacgttctagaagttgggcagaaacgctgaagatctcatcaagacaaacatggtgctcaaagactttggtggcaatccatcggaaaccaagggtgttctaaatgttgagctgacagtcggcagcacaaccatccctactaccttttttgtcatcgatcggaagggttcttacaacttgttgcttggtagggattggattcatgccaattgttgtactccttcaaccatgcatcaatgcttgattcaatggtaaggcaacaagatttagatcgtgccaaccgacaggtcagtcaatgttgccagtgccaatttagctctttgggagatggatggtcttgattgcttatctggaaaagtttgggatggagattttctaaaatagtccgattctgatatacagccaattgaagatggagaacccaattgaagatggagaacccaggctattattttgaaggcgttgtggagggttcaaacgtctacaccaaggatacagtagatgatctcgatgacaaacaaggtcaaggtttaatgtcggccgatgatttcgaagaaatagatataggtccaagcgatcggccaaggccgacatttattagtaagaatttatctccagagtttagaaccaagctgatagagctctagaaagaatttagagattgcttcgcttgggagtattatgagatgccaggacttagccgatcgattgtcgaacatcgactacctatcaaactaggggttagaccgcaccagcagcctccgagaagatgcaaagccgatatgctcgaacctgtgaaggcggagattaagcgtttatatgatgctggttttattcgtccttgccgatatgctgagtgggtttctagcatagttcatgttatcaagaagaacggcaatgtgagggtgtgcattgattttagagatttgaataaagctaccccaaaggacgagtatccaatgccagtagccgatcagttggttgatgctgcttcaggacataagatattgagttttatggatggaaatgtgggatataatcagatctttatggctaaggaagatatttataagacggcttttagatgtcctggtgcaatcggcttatttgaatgggtagtaatgacttttggattaaaaagtgctggagccacatatcaaagggccatgaactatatttatcatgatctgatcggctggttggtcgaagtctatattgatgatgtggttattaagtctaaggaaatagcgaaccacatagccaatttgagaaaagtttttgagagaactaggaaaaatatggcttgaagatgaatccgataaagtgtgctcttggcgtatcggctggccagttcttgggatttcttgttcatgagaggggaattgaaataactcaaagaagtgtcaatgcgatcaagaagattaagcctacagagaacaagacaaaattgcaggagatgatcggcaagattaattttgttagaaggtttatttctaatttgtccggaaggttagagccttttacaccgttgttgagattgaaggccgatcaacagtttacttgggggacagagcagcagaaagctttagataatattaaggaatatctaatgatttagcccaaggggcatcgggatataagccgatgatcaaagatgttaagattgaagttgctgccataacagccgatgattggagatatgatgtccatcagtatttacagaatctgtctcaatcggcttcttggaagttaagatataaagcgttgaagtatactttgttagataatgagctttattatcggacgattgatggggtgttgctcaaatgttttagtgccgatcaggctaaacttgcaatcggtgaagttcatgaagggatatgtgccactcatcaatcggctcataaaatgaagtggttgcttcgacgtgctggatatttttggccgacgatgctggaggattgtttcagatattacaagggatgtcaagattgtcagaaatttggggcgatctagagagcaccggcgtcggctatgaatcctattattaaaccatggccatttcgaggttggggaattgatatgatcggcatgattaatccaccgtcaagtaaagggcataagtttatattggtggcgaccgattattttaccaagtggatagaggcgattcctttgaagaaggttgattctggggatgctatacaatttgttcaagaacatataatctatcgatttggtattcctcaaaccattacaaccgatcaaggttcaatcttcgtgtccgatgagtttgttcagtttgccgatagcatgggtatcaaattgttgaattcttcaccatattatacacaagctaatgggcaggccgaggcatctagcaaaagcatgatcaagttgattaagaagggaaaatttctgattatcctcggcattggcatactcgtttagccgaagcattgtggtcttatcggatggcttgtcatggatcgattcaagttcctccttataagcttgtttatgggcatgcggctgtattaccatgggaagttaaaatcggttcgagaagaatagaattgcaagatggtttgacagccgatgagtattataaccttatggccgatgagagggaggacttagttcagtcgcgtttgcgagcccttgcaaaagttaccaaagataaggaacgagttgctcgacactataacaagcaagtggtacccaagactttttcggaaggtgaacttgtatggaagttgattttgccgattggaactcgggataacaaattcggcaaatggtcaccgaattgggaacgaccgttccaaatctataaggttgtgtctaagggggcatatatgttgcaagggcttcatggcgaagtctatggacgagcgctcaatggtaagtacttgcagaaatattacccaagtgtttgggttaatgcatgatcggttagtgttgccgatacatgatagccgatgggtttgcatcgccttgggatgggcgatattgttatatcgcccttagttgtttttatgttgtaatcagttgaggtttgccgatttacaatggccgatattgttatatcgcccttagttgtttttatgttataatcgggcccttagttgtttttatgttgtaatcggttgaggtttgccgatttacaatggccgatattgttatatcgcccttagttgtttttatgttataatcgggcccttagttgtttttatgttgtaatcggttgaggtttgccgatttacaatggccgatattgttatatcgtccttagttgtttttatgttgtaatcggttgtggtttgccgatatacaatggcggatattgctatatcgccctaagttttaaactataattaaatcaatgcttttgacattgtaaaattaggggggcacatatatacaccagttacaaattttgacaatttttgagcaaatttggaagttatattaatcggcacaaaggattatcaagataaacatcagtagtatcttagccgattacaaaaatttctaaggtctattacacagaaagttaccgagacaaatagcgctggatagccgatatagctctttgcctaatttgttctacttcttcgatggcttgggcatcttgagcatcggttccagggatgacttttaaagacttggttagatcagcaacattttttatagccgattttagtcttgctttctgcttttcaacagattttgggagatcggctagctttttatgttccatgtccagattggcactgcattcttgaagttgtgccaggagctcaatctttcgagcttcaagccgatcaatattagacttgatcggaccttcagataactgatcaagcttggccttctcttcatgaacaagctgccgattggcctaaattgtggcctcgatgtctttgcgctcccgacgctcgactagtctcagcttggccttctccagcttgaattgatgctgctcgagatagacagctggagttaggacatcggctagctcatctgggatcagagcttgaatctcatgtagccgagtcctaattgagccacaatcaaccactaagctgtctaacgatgatgcctctagccgatgagagatatcttcaagaattttcttcacatcatcggataagggggctaaagctttgcttgtggtatcctcttctccttcatcaagatagtctctaatgtcaaaagagaaaagatcggctaagacatgcaataatgatttaaagagaagttagaggtcaaatagacatagccgatctgggtattttgtgtcaaagaaaagcttaccaggatagcaggagcagtcggttggacttcttcttcaacatggtgaatccctacagctgatggagtctggtcacttgatgactgttgtacaggagaaggaggaggagactgtaaaagagacaagtgttagacaaaatcggctgagatcaactaatgaaagaattaagatgtcattatagccgatttcttcttcacagcagtcttctttttctacaactacaaaatctgtgagtaatcggccataaagtaaaatgattgcaaaaaggatcaaagagagctgcttactcttgaaaagtgagctggagcaaaaggagttggaggggtctgcttgggtgaagccgatggtgttctttctgtgtcgcttactttggctgcggcttggtcaacgtcttcttcaatttcctcttcatccagagcttgttcaatggatggatctagggcaggcagatcatcagatggcttagttatctttgtcttggttttcttctttggagctggggctgaagtatctacagccgatgatctggtttttcttttcttgccggcatcggctggttctctgatgagcccttgaagaagagctgaagtcttgggggcatcatagccgatgacaggaggagatggtccacctccatttggaattaatcccgaggcatattcaatgttcctgccactgttactttggcgaggaggagagaactctgttgtctgcaggtcgaaaggaaagttagtcaaggttagtcggctaagcaactattcaaatgaaattgagtaaattaagacatacctgagggacaacatctggaaagagatctgtcatatacatagaggccgattgatggaatagatgcagtttccattcactccaccatctgtcgaatgctctgctcctgaaggttaccagctctatattatcaatgctgcctagagggggtccttggaggttaagcagccgatccatcattaaggttgacgaaatttcccctcagcactggatcttatcttcaaagaataagccgattgggagttggcccattccaaactgcctggcagaacttattggatgataaaattcataggagacttagatgtttcttccttgatgaatgccgacaggaaggatacatggactgattgcagctgaagaaatttctctgggtttctgatatctttcattgttgatgtcttcgaatatgaagtccaatggattttctagaagtgttgaatcttcatagaggaaccaaacttgagtatgtttttggaaaccctcataaaaattgcagaaccagtctttaagcagctcggccgatagctttgcttctgcatcggttggtatggaggcatattctccgtaagatgtgcatctccgatgagtacgttcttctccatcattgtctacaatcggctccagtcttggaaattcagcttctgttacagatggccaattgacaaacttcatgactaccaaattcagccaggactgcaatagccatcatggtccacctgctccgactactgagccgacagctaacttagccgatgcattgtttagcatttggtacaagtagccgagaagtatttttcttaaaggaaattgtttctttgcttctaaggcttcggctacaaactgccaattggttgtagggccacagcttgatccacaaaagaggaatttctctagccacattagcaagaaagccacatgttctcgaggggtgacggaaccctggcccatgtatgctgctacatagcctgaccagccgcctatgctcttggtcttgaagtcgtattggttcttcgtgttcaagctcatagagttagccgataaggtgacatccagacccgtgatcatgatgatatctatgagagttggggtcatcggcccttggttgaacaagaaggcgttgatggtgttggaccagaaataagaggcagttgccattaggggctcatccttagctgagttggctatggtgagatcgagtgcttggccgattccaatctcgtcccaatgaactcttttgctagccgacatgctcttgaaccatgtgatccaacttttctcgggtcgagttttctcgagggatggccaggatttaaggtgtttttccagtgacctagatctgggttggccaatctaaaaggaatcctattggtttcaccaataaagaactctgtgggatcagggttgccgactgggccgagaaagtagtagttttcatgcgataggctgggaattgcaactaggttggagagatgctacaaatccaaagtaatcgagaaagggaaagcaatataaggcgagagaaaatcgatctgatgctaagaaaggggatctagccgaccgggacttacctcagtgtactcgccgacggcgtggcagacgggctggcggaggacgacatcgccgcaggcgtagatctagccggagatgaagccgcctggggatcgctttgtgcgtcagagaaatcgccggagaggaagagaacaaaattggcttcggtggtgaaaacggaagtaatggggtaaagattttccagggcggcggttagtatttaaagcactgaggataacggtcagaaaatggcagagtgcgaaacttactcgaagtcgatacgcggcaaatccgaaacattaccaaatatcccggacttggggggcatgtgttaacgaccaaatttggtaatatcaatatcggatatgaagattaaatcgaagcggaaccgaagataaggattgtcgcggaaacagagtaagaatcggctggagtccggatcggctacgactgggatcggctaagtccgagtctgactgggttaagtgatacagccgattccgacaatacgacttgtgtacgacatcgggtttgagttgataagcttcaagatgattgccgcgcatggatagagtcctaagaaggcaattgtatctattaattaggatattttatgtaaattctttagagataaatgtgggcaaaagtctgccgcaaagacttatggtatcttagagtttgttagagataatagtcgtgtccgatatggacatatcttgtaattcttgggtataaatagaccccgagccctatgtaattattaacacacacgttcaatacaatctcggcgcatcgccacccttttacttttgttttgtttcgacgagttcttgctttcgggttgagctgcatcggtttcgatcttcaacaacaggtaagacttgttatggcggttttatgatactctaatcttgtttatgtaattcgtcgagttatcatatatcttatataatctttgataatatcgtcatctaacctacaatcggctaacatctgttaacacaaggcggccgattagattaaatagcgacgttggcttagattatataagatatctatcactttatgaaacatccagtggcttgattgtctagatattgttcttcttttcatactcaatgctgcatcagttgagtttgatctattaagtcgtgcttagaatttcaatctctagcctgccttctggttgccgattagggtagtatcggagtttcagtcgaccttacctgatttaactaccttatcttatatgcttgattgatatgttgaatctgccctttatattaagatcttgctgcatttaagtatattaggcttctgtttggtatatcctatttgctttaatatcttaatacagagtggtatcggagtattagccgatacatgctagatctatctgatcggctatgctatgaacatatataatcttgttgttaatatatatttcgatctaagtgatttatactgtctcggcatggcgaccgatctatcccaatcacttgatttaagtatatatcgacataaggattatatattattaatatctacagccgatcgagtagatttagttcctttttattcatttatggttgtcgatcgatgtatatatgacatcggcccaaaggtaaatgatatgtcatcggcacttagccgatcggctatcatttatggatttaaccacggtttctttgtctttgtttcttgttgattgcaggatcaaatcaactggcacgctcatacatctgaaggcgagttttggacctgcactggagttaaccagatctcccaggcctcgtgttttctgtcaacaacgcttagtattcatctagaaatcataaacatgatttatccacaaatatctacagaaaacaacctgaaaccgaaatcgacacatattcggccgatcagaccgcgggctgaccggtctgaccgcgcaacacacgccggtctgatcggcaaccacagttcgctctaactggtccaaactgacagcagtccctatttatcatctgaaaatcaaccttctccaaaaccacttcaccaataatctaaaaatatcaaaacaataatctcaaatgataattgttcatcacaaaataataagagtaaagtccatcaccggtccctaaacttgtaccgctgtgtcatcccggtcccgaaactcgcaaatcgactgttcaggtcctcaaacttgttcaactgtgtcatcccgatccttaaacttttagatcactcgt

SEQ ID NO: 35622 - DNA, 8127 bp, Oryza sativa
gacggtcctgtttagggaccggggtgacacaactgaacaagttggaggacctaaacgagtgatctgcaagtttaaggaccgggatgacacagtcgaacaagtttgaggacctgaacggtcgatttgcgagtttagggaccgggatgacacagcggtacaagtttagggaccggtgatggactttactcaaataataatcaaacactctctgattttacagcaatgtcaagattctgaattgctgatgccacccactccaaagcaggaacagttatgttgtcctatggggatgttcagcaagattacgattaaaaaaaatgttcctatggggatgttcagaaagattacaattaaaaaaatgtcatctcaagactattgtgttgtccaatccttgtgtctttttttctgccaaatttaagggaagtgaataatgaacgggagggattcatatgtattccctccgtcctaaaataactcaattcctgcgtttctgtgtccaacgtttcaccgtctgtctcatatgaaatttttttatgattactattttcattgttgttagataataaaacatgaataatactttatgcgtgacttatcattttaaattttttcataatttttttaaataagacggacagtcaaacgttggacacagaaactcaggaattgagttattttgggatggagggagtatagctgagacagtgagacaagagataatcaacatgacagggatgaaagactaatgacccacctacaagatatttttaaatatgattttttattataatacacacatgtatataataagtagatattttattttctcaaagtatttctaagacttatctatttgtttgaaaacataactactttattaaggtagaagcaaaggacatgcatggtttaaggtaacatccccaaaggggttggataataacatctccactgtaggacaagtcgatgaatgatgatagatatgagtgatattctggcatattttttaaaacctgtacattggcaacagttgcttttactttttttgataaataatctgccattttgtttagttttcttggaaccagccgaacattaagcgattgaccctgcagtagaaaattaagtaattttaagacttatctacacatcgtgttttactgtctccaaacaaaatattctgtaagttattaatggtcaaaagttctaatttttttatgttaaccttgtccaaaacagctagagcaggatataatactaattaacatggtgtttgctttgggtcttcaattaattctataatcagaatacatgaaaactaactttttttttaggtaaacgacggcaggagctctgccggaatttcattagaacaaaaacatgtaatattttgcaactggtttgtttgattatcagaacccactatatctggactcaccacttctgtcatcatcaggtgacaacgccaaattttcaccacagtcgcatagtatttcatatttatagtgccaattaatttatacatgcacccctgctcagcttaactgttttctcgagtaatggtaatcaccagtcgttatgaccctgaacctggcatttcataggaagcaggcaatcagcttcactcttttcttgagtccatcctctgtttttttcccagtgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgtactacgaaataatacatgaatataatccgggttttgtggataatagtaaaatgttgcaacaaagccaaataatactgatgagattcggttgtatcactggtgaccttttatttcgtgaatgaatcatcgctgtatgaaacaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacaactgactgttctgagatatcattttcctgatcccgcgcattccaatcagcaattgacttgtttattgtcccccatgggctgggtaatacattcatatttcaattgaaatggaattaaatgtgaaaaataccccctacaaatcacttgtgtttcttctttgcctactactacttaatttcgtacattaaacccccacacaagacaatttctcctaacctattttcatctatttctaatgattgtggttggtctctcacaacctccttcctcccttacagtatctgccttcccaaatccccatatgagctaagatgatggcagaacacgatggcacaacttgtgcgccagctgtaatttctataataccaagttaccaacctatcgaggtggcatgagttactattgtcccatgacgctggaggcccatgcagcactagaaattgaaataactaggtgaaataattgacaatgggactgtggttaaagttaggacataaattaacttgttgggaggattttctgtatgaaattgagttgtagggggaaatagaaaaactagtgagttgtagggggttatttggaatttcactggaattatattatgagcaaaataaggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtaccaaatatgacaacgatgaacccgatcaaagtgaggcgtgttccacacatgccaggcttgccaatgttcgccttggtggatccggatgggaagatgtgctaattgtaaaggatgcgactatataagcaccctggagtggactggaagcttgaaaattaccgttggatcaaaaatagatgtccgagattcgtcaatgtcacggttaaaattttactcatagcaaaatttttactcgtgatgacatagacaaatatcagacgtctatttttcgatccaacggtagttttcaggtttccactacatatgtactttgcaccatatatttttccgggttagacacagatggattgggttagtgatcatattagtataggatgctgctagccaacagatggggaattgaggtttaaggaattactaagctaccattattaatattatttgttgtttctagattatcctttcgaaatcaaaggtgcatattaattcatttaggaggtacctgggtacctctcaagcacagtaaaatcctctcagaaatgtatgttgatatgagattgatcaggtagtgaccaacgcagtgtttaattagctttcttttgtgcttacgttttgcaaaaaataaatgaatgaataaataattagctcagatttgtcattttggtcttatacaatggtcatgatatatagagtcagaacttttgaaactttaactatcattagtttttctaatgctcattttaaaaagggaaaaaatagtatatatgcttagttttccctgaaaaagtattatcatggtataaaaacttattagatattctaatacaaaattgatagtcaaagtttgtaagtgagagattttacggtctggaggtaccacattttacctctcgttgtgtttggtactaggagctacgggtacctcttagtaactcttgagtgctagctgtaaaatttcaagtcaaattttgttctaaatattaagtatttatgcccggatggtgtatatgatacggatccgtatcctcaatacttcatgcagtttgtccttgatataaagttctgaaaaaaaaaaccttttttttggttgggccgggggggggggggggtgggacattgacctgctgtcttctctgctctgaacattcactacccacagatacacaccttctgctcttcttgcccgatcacctatcccttattattacaagtctcattttatttttcttattttcccatcactgcatgctgcaagtgttaagctactgcttagctgtgcattcaactcgagtcctgaataagttttggagatatatctgagcctagccaattgaatcagatgcatcgatttctgattcgggtgattggcagacatatcattaccagctagcagacgagaagatcaatcacaattaagttcagaactctttcctttagtcagttcatttgttggccctaattgttggtaactatctttgcatgggattgggaggtactgcgagatgtaagaatgctgattcgttggattctgcaagtgcatcgtgaagaaatggttctgggatttccttgctggaactgtatgtagcactgatgcagtgatatgtcgctaataccagatcatgtcgtaggattgtttcaggaggttagcatctctaggtggctacgagaatattaatagctagtatatctgtccataaatgtagcttcggagttttaggatgggatattatctaagaatatcaccaacagtgctcctattttatttctaaaaccaatttgagggattttagtttaaaaaaaactacttcaccagatactttattcttttgcatgatttttggagttccctaccctgaaattgtctgatacgaggggaagcgagccttttttggtagtttaacagaatagctcacttttagtttttcaaattaaattaaagttttttcttgaagagattatttttttcacttcctattttcagattaagaagccaaaaacaaaattttgggggtgaattatttcaattctgccagtgatgctataatattacgattggcggttctagaaatcttttagctgaacaaatataacgagataacaagcatacatataatctatataattatatagaccatttatgatttatctataccgtgctgttgggtaaaaccaacgtgatcaattaatgtagcatgggctagactaatatatttctgcgatggccttaattacttttgtcgaagcaagatttcgacaataataaaagggggtggctatcaagctaggaaagtggatgggtttggagataagaaattttatacaggttcaggccttcttattcaagaagtaataccctactcctatccggggatgattccgccgagtgtgttattgattgtataaaatggaaaaggaatcgccccccaagaggcacacggaccctcttatatagggaaaggagtccgctttacaaaatacagtccatatcctaatagaatatgggattatagataaaatacaatcgtaaccgactaagatcccgggtatttccttgacatacaagtttagaacctaacccgaatcttcatagagatattccatctatatttagtaccgtatatccgactaaattacaaccgtcatgtagatatggggtatccataatctccacagtagcccccgagaccttcgcagttgacaaaatagccttctcgaaacaaaaaaacagtagtccgagtgcttcaattcaacttgctccagcttgccgagtgctaaaaattaaaaactgtgaagggcgaaaataaaacatggtgcatcgagtagatgcacctaattaggtgtagcccccgagtatgtgattagttgaaaaactaaacatatagtcaagaaccgagtggttttatagcgaagcacgaatggtacttagtaagatacccagccgactgcttctcaacttgaatatatcaaggacaaaaaatacaagaagggccgagtgataaacactcaaaggtccaaaaataaacatgtttgataggaatccgagtaagaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaacaaagcttacaaaaacggtataacacctttctgtcgggcacctttttatgtgcatcataataattcccaagaattattgaatcgtgttaaaaaggattttaacagcattgggccacaccattgtgaacacaaatcgccaaagcaaaaagtgcctaagtccctagggatcacaacaggccacgctgattatagtattgggctgaagtactgtacaggcccaggcccattagtactcccgataccctaataataccgaagtgaaactcgtctcttcgtcttccccgccgagactctcgccattttccccatttcctgctacagtgcaaaactgcgccggccaaactagggttcatcaatccgctccaatccctcctcaaaatcttcacgaaatttctccccgtatccaccgctcaaattccccatccctttccagccgtatctcgaactaaatcagaccatccagttcacattcatggcggaagaaagagaaagcttcaagagtcagtgggcgccctccgatgtgacggaagacaatctgaaggagatggtggcgcacggcgttcttccagcaaaagagatcatcgggtggcaaccggcatttggtgaggcatttccaacacccgatacacacgaaatcgtggtatttgctcatttcttctacggcggattttctcttccaaccttaagatttttccggggaattctgaacttctacgggattagcttgcatcatctgaatccaaactccatagtgcatattgccaactttattcatgcctgcgaagcttttctgggcattaggcctcatttcgccttgttccgccgcatcttcttcctcaagccccaaccaaacaagagtaaaccatgcgtcgttgggggtgctggtttccaactcaggggaacactaagccaaaaatacttctccatgcccttcaagacctcaaataaaggctggcacgcaaattggttttatgttcaaaaccccgagcctgttcttcccgagtactcctgtcttcctccagtttatcgggatacttggaattcactgccaatgggagacgaagctgcacaagcagtagaactgatcgagaggatgattaagctgaaagatcagggccttcaaggaaaacagatcacccggcactttatcaagtgtcggttagctctaatcaaagaaagatctcgcacagccttcgaatttgacggcaagcatgatccaaaccgtgaagatccagattctcttgacttcaaggtcatgaaggaaaggatgtataagatcttctcaaacgccatcgttgttagctactctcacttgctgccagtcataccgttcaatgcattcaatcctcctccactggtacgtattcatacacttcaacctttctcaaaatatgatcttgctttcttgttgaatcagttaacaatgaaggatattacacccaggaatttgctttgatgaagtcggatcccccaatcgctcaacgccgatcgccccgccatcaaactgggcaagggagcggaggaccaagaattcggtctgaaactcaaccaagtgcttctgatccaatcggccagtcagattctcgaaagaagaagctggttctaagtgacgacgaagccgatgataccgccaggaggcctggagaccgagagacaaccaagaaactaccaaaacaggctactccaaggaagaaaacatccagtcgccctgtgccaaagatcaggaagtcttctaggtgcaactcatataacgacctctcttgcattgatgcgcacccattgcggcaataatactgataatcaaatttgcaggaagccatctgatatagatccgtctgggaaagactctgacccaactaacgtggacacaagttctttcaaagaaactgagcccactgctgaggatcatccgagtgacaat

SEQ ID NO: 35623 - DNA, 12656 bp, Oryza sativa
  unsure (1)..(12656): unsure at all n locations
caaaatatgatcttgctttcttgttgaatcagttaacaatgaaggatattacacccaggaatttgctttgatgaagtcggatcccccaatcgctcaacgccgatcgccccgccatcaaactgggcaagggagcggaggaccaagaattcggtctgaaactcaaccaagtgcttctgatccaatcggccagtcagattctcgaaagaagaagctggttctaagtgacgacgaagccgatgataccgccaggaggcctggagaccgagagacaaccaagaaactaccaaaacaggctactccaaggaagaaaacatccagtcgccctgtcccaaagatcaggaagtcttctaggtgcaactcatataacgacctctcttgcattgatgcgcacccattgcggcaataatactgataatcaaatttgcaggaagccatctgatatagatccgtctgggaaagactctgacccaactaacgtggacacaagttcttccaaagaaactgagccaactgctgaggatcatccgagtgacaatcaaccggcaaccgataatgtagaatccagtgaccaacccccgactggaatccagttggccgaagccgaagccggagttaatcaagatcccccgactggaaaccagtcggacgcagggccaagccaagagattccagaagtcgaaacccaagcaaacaaccctcgcggacaagacgccagcaatgaccggagatctggatcccctttaaaagtatccgaatccactcgtcctcgtcctgaaatcattacaggtaaacactttgtccgaaaccatgttgacccaaataactctgatcgattgtctaacctttgtcattggatgcattaggaccaatgatcgatgatgaagaagaaattccccgtatataagcaaccgaagattcgtgccctcctattctggtcaagtggtgggatgacaacttgcaacctcaaggaattgtaataaaccggcaaaaagaagacgaagaggtatgcctgctgaaaaagggactcaaccaagcgactcgcattgtaaatgtaagtttctttgatgcctgacctcagccatcttgtttactgtctagctcgagcgctgattaaactgctccgcagaggattcatcttaggaacgaggcgaaaaccgcaaccctagagagactagttcctcatcttggaaccctcgaagccaccaggagtcaactgcacgaggccagagaacttgccaagaagaatgaacacgatctgagggatcggattgctgagctccaggagtccaatttcgaactgagtggctcatcaaaaggttcgcgcaaactctgcccaactaatttgtgctgttatctttgtaaccttgattaaccgaagttaatgtagtgcaagctgccaagatatctcaactagagaagcatatccaaactctggaaaatgacaaggcagagctggcaagacagagggattcggctttaaaggaggttgaaggtaccaataatcaatacttcaaaagccattatcttctacatgctgattcattaatgtgaatctgttgacgcagaccgcaagatcaagtctcaagcacaatttgatgtcttagttgacaagatcaacaagcttgaaggagccagggataaagtcgctaatgccgctactccacttatccaggccatgttcttcaataacgccggttcgagtacacttgatgctgccgaaatcttcgacaagctgagagtcgctccagatacttacttcaagaacatcaaagaagctggaagtatgggagcaagtctggcattggcgatgaccaaatccctttatccaagagttgacattgatgccattgatggctttgcagacgggacgagcaaagaagctgctcttgacctcatcaatgatgcgcagaaagcggctgacaagattgctgctgatgtagttgagagattccaatatgtcgaccttcggccgactgggtctaataagtctgatgatgaaaaaactgatactgattgatataacaatgattttgatgatcaatgacggtggaggctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattactatcataatagccccctgactgaaaacttcaaggagaaacttgaagttagcagtcaaataggaaagatacaagcgaaatgcctaagcataaaatcgacgaaggtgttcaatattccaagaattgttgatgagagtaccgtcttcgcgcttgagtcgataagaacctggccgagtgacttcagcaattatgaactgtccttcccataagggagataatttatgccgatcctgtgttgtttgaattttcctcagaaccaggtcaccgactaaaaaggctcgcgatcgaacattccgattatgataacggcgtaacccttgcaaatatcgagtcgactgaattaaagctgcttctcgggcttcttctagtcggttgatgtcatctactcggccctcttcatagccctcctcgttgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcatagggacgtagtcggtcaaaaactcgtgctttgatcccttgcaatatcatgccgttagcgcgctcgacttgtccgttattcatagggtgcgccacggaggcgtaaaaaattttaatgccgaagtcttcacaaaagtctttaaatgctccgccagtgaattgagtgccattgtcagtgatgatccgattaggtaccccaaaccgatgcacaatgttgatgaaaaaatctctaactttatctgttgtgatcgtgatgaccggtttagcctcaatccacttggagaatttgtcgatagccacaaagagatgcgtgtaaccaccgactacccttttaaacgggccgaccatgtcaagcccccagaccgcaaatggccagaacaacgggatggtttgcaactcttgggctggcaaatgaatttgtctggcaaaaaattgacaaccttcgcatgttcgcacaatcttgtcagcgtcggacaccgctgtaggctagaaaaaaccttgccggtaagctttgccgataatggtccgtgcagcggcatggttaccacaaataccagaatgtatatccttcaacaactgtctcccttcttccaaagacacacagcgctgcagtattcctgacggacttttcttgtacagctcagtctcatgaataatgtaaagtctactgcgcctggaaatccgctcggcttcattttcgtcttgaggtagttcttgtttgctcaaaaattttataaacggttctctccagtcggcttcgatcatgcttacgccttgaatatccatggcttcgactgtctcttttctgggcacggtcggttcgtaaaggtgttcgacaaacacatctgaaggagctgcttcccgttttgaaccaaaattggccagtctgtcggctgcctcattgttatgtcggaggacatgggtgagctcgagtccatcgaatttattttccaacttgcgtacctcttgtcgataagcggtcatattatcatctagacatgaccactctttcatgacttgattgacaaccaactgagagtatccacggacgattagtcggcgaatacttagagatattgcaatccttagtccatggagtagcgcctcgtattccgccacattatgggacgcagaaaaatgtatccacaatacgtagctcaatctttctccagtcggggagattaaaacaaccccagctccagtgcctgtaagcctcttcgacccatcaaaatgcatagtccaatattccatcttttcctctggcatgtcttcttggcactcggtccactcggcaaggaaatcagctaaagcttgtgacttgatcgaagttcgtggtttgaacgatatgtccaaagacatcaattctaaggcccacttcgcaatccgtctgtttgcttcgcgattatgaagtatatccccgagtggaaacgatgtgaccaccgtgaccgagtgactttgaaagtagtgagataatttcctgatggtaattaagacaccatataataacttttgaacctgaggataccttgtcttggagtcggctaaaacctcgctgacaaaataaattggtcgttggactttttgaatatggccttcctcttcacgctcgacaaccaggaccgtactcacaacctgggaggtcgccgacacatataacagtagcggctctggtggatgtggtgaggccaaaactggtggagtggtaagaagtttcttgaagtcttcaaaggctttttgtgcttcgggtccccactggaaattgttagtcttcttcagcagcttgaagaagggcatcccccattcgccgagtcgtgagacgaaccggctgagcgccgccatgcaaccagtcagcttttggacgtctttttgggagcttggcggtttcatgttgaggatggcgttgattttctctgggttggcctgtatgcctctttgagataccataaatccgagcaacttccctgatggtactccgaagatgcacttttccgggtttagtttcatcttgaaagcacgtatgcttgtaaaggtttcttctaaatccgcaatcagatcatccttctgcttggtcttgacgactatatcatcaacataagcttcaacattacgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatttgatgatatcccgagtaacagtccaagaagctgagtaactcgtagccggccgttgagtcaaccacctggtcaatgcgaggtaacccaaaagggtctttgggacaagatttgtagaggtcggtataatcgacacacatgcgccattgccccgtctttttccgaaccaggactgggttagccagccagtcgggatgaaggacttccttaatgaagcctgctgctaacagcttggttaattcctccttgatcgcatccttcctgtcctgtgcaaaacggtggagtcgttgcttgatgggtttggcgtcttccttaacatgtaaagagtgctcaatcacctctctggggataccaggcatatcggatggtttccacgcaaaaatatctttattattctgaagaaaggtgatgagcgcgctttcctatttacaatctaactcagcgcctattacagcagtcttatcaggatcggagggatctaagggaatctttttcgtcttggcatcactttcttcggtcttcgtcagcttggttgcaggcacttctccctcgcttgccgtggtcgcagccagtcggatctcttcgcgggcgagagtagtctcgtgagtttgggccatctcgcaactttctttgtcacatgtgacggcttgcttgatgtcgttccgtagtgatatgacccctcgaggaccaggcatcttgatcatcatgtaggtgtagtgtgggacggccacgaatttggctagagccagtcgtccgagtatagcatgatatgctgtctcgaaatcagcaacttcgaaacaaacattttctgtgcgaaaattctcccgagtgccgaaggtaactggaagagtgatatggccaagtggtgtagctgacaatcctgggataacaccgtggaagggtgcattactcggctttaattctgtgcgaggaatctgcatatcgtccagggtcttagcgaaaaggatgttgagtgcgctgccaccatcgatgagagttcgtcggagcttgacgttgcgaaccactgggtctagtaccagaggataccgccccgggtggaccactcggtcgggatgatctgagcggtcgaatttaattgctatctctgaccaccggaggtattggggcgtgttaggctgaactgcattgatctcccgttctgttagcttctgctttctcttatattcataagccaggggtccgccgaagatgtgattaagttctttgcgatgatcttgaaaaccagtcggggcatcgtcttcatcatctttcttctttgatgtgccttgatctccgtctgagggcttacgtgcgttcttcacgtattgctccgcaaattgtttgtagacgaagcaatccttggccacgtggttggagttggggtgatgcggacattgggagttcattatcttgtcgaaggtgttgacgcggggacgttgtcgggaagatggagaggttgtggccacaagttcttcgggcttacgcttgcgatccttgtggttgttacttccgctccctcctgcagtcggcgtgtccttctttggcttccaagtggtgcccgactgcttggacgctgtgatagcatcttcggctttggcatactcattggctttttcaaacatatgtttgaccgtcttgggaggtttgcgtccgaacttgccgactaggtcctcgtggcgaatgcctttagtaaaggcggcgatgataacatcgtcggtgatgtcggagatcttgttacgttgctcagagaagcgtcgaatgtaatctcgaagagattctccagacttctgaacgatgttgtagagatcgaagtgtgtaccgggccgttcaaaagtaccttggaagttggcgatgaagtggtcgcgtagctctgcccatgatccgatcgtgccgcggggtagcccatgaagccatgaccgggcagaatccgctagggccacaggtagatagttcgccatggctttgctgtctcctcctgctgcgcagattgcgagactatagacggtaagccaagactcagggttggtggtgccgtcatatttctcgattccagtcggcttaaagctggctggccaatccactcgacacagatcgcttgtgaaggcagcaactccgtccacgtcgtcgtcgtagcgatccggtgaatgatggcctcttgtgcgcggcgctggttgatggtgtcgcgaagatcgatggggcatcttcgatgtggggactgtggtcgttcgacttggcgctccctatatcgctcgggaggcgagcgaacggaccgttcatcatgtcccctgctcctgcgactagatttgacgccggcaatgctgaggcttggctggtgatagtcttgagatcgaagatgagggactcggctaccagttggggtgcgggtgcttgcggagttggctggaaccgaggcagcgatcatggtcttcgtctggttcaagatgttgactacatgataagcttggttgagtgcgtcttccttgaggagggtgtcgaggagagtgattgctgcaaccgcgttctgctggggggtgcgaaagaccgctgtcccatcaacgtcttgttgcccaatgagctctctcgctcgccgcccagattccaaggcgcgttgtcgtcgatcttcagcctcctttgcaatccgttcgtgatcttgttgctcacactgtagtcgttctcgctcctatcgctgtcgctcttcctctagtcgatgacgttcagcttcttgtcgtgcgcgatcttggtccgcttctcgggcttggtgctgttcctccatttcattgttagccttgaatacgccgaagaagaggggcgtgtagttatcctcatagctgtcgtcgaagttgtcgaggtcgccgtggtcgtagtggtagccgaaatcatcgtagtcgaggatctcggttggtcgagaactgacgccggaggagctgaggtagccatccaactcttccgtcgagactgtcccgagaggttggagtataacgccaaccttcctggatctagatcggatcggggccgaagccggagctcgcttagatcttcgagtgggagatgtcttgactgtgaagacagcggccaaatcatcaggaagtttcgtcaggattgagggataggacccgtcgtcttgatctggtcgcggaagagtagattggatctcgtccgagtggtttgaagccgagtcgggagagatgatcttggagtaggcctcggccgagttcggaataccgaacggcacggggacctggtctctccccgactggtttgaatccgagtcaaggagagagatcttgccgaagtcgttggtgatgaagttgaggctgccaaaccggaacacctgcccgggagggaaggcgaagtcgtcgatgccagaaacgaaacccatcgcacttagtcggcgagaacttgacgctacccctacctggcgcgccaactgtcgaagcaagatttcggcaataataaaagggggtggctatcaagctaggaaagtggatgggtttggagacaaggaattttatacaggttcaggccttcttattcaagaagtaataccctactcctgtctggggatgattccgcctagtgtgttattgattgtataaattggaaaaagaatcgccccccaagaggcacacggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttggtaccgtatatccgactaaattacaaccgtcatatagatatggggtatccataatctccacaactttactaatttccttgttaatcaaacagggtacgtaataatgcagtgggcggagctctggcactcgcccgtggtggctgggtcttgactccgccccttaatttttcggactagagtagtacttgctatgtttgggaggagagattgaaaatattcttccatgcattgaaaacaatattatttattagcacatgattaatcaagtattagtaaaaaaacttaaaaagtagattaatataaatttttacaataactttcatatatttcttttttataaaaaatgaatcgcttagtagtccaggaagcgtatgcctagctaggaaattaaggagttgacgttgggaacctcaagaaatgaactcagatttatgggaggactgcaatcctttagtttttcacacacgagaagaattatggagggtcgattgatccccttgtgctcaagaaacaggaaacagataatccttatgcagtccatttctactaggaaccgcataagatagatcatcacaataccccaactaattaagctttggcatcttctttgtcacatgcttctcaacttctgcatcgatcttcactactgtttcagctcactgttatttaaaccactccttaggatttaggtccataatcttggtctgcagaatatgtctgctgtgcagagagcttcatcccgatgcaactcattccgatgaaaacacttgatccattaaaaagaatgatgttaattgtacatgaatggttaaaagaagacattgttaatattggctaggagaagaatgggaataaatagagcacactgctagggtctgctccaccctccagacgggtaaatggagtgaataattaggaggataaagatcttttatatatgatctttgttaggtaaggcgagttacataaagtttctacataaaagtaacaatgtgatcaggaaataaaccccaagttccctttagaactaaaataaaaccccatgttcagaaaacgtacataaagaaaaaatgggcaacgtttagcagtttccagacgattgatgaatgtcaatatatacttgaaaatataaaactattcagtcaccgagttcaagagataaatctctgagaattcgtaatcattagtacgttttgcaacctagtatatgatggtttactagctaacgtgatttcaagtgttcatacatcaaatttactaaatgaacttttctttagcaagggtaaacaatgtcaactctttttttttgttgtccattccatcattccttctcaatcaaagacacgaagacctccttcctgttcttcaaaacaacagaaaataatcatgtgaataaacagaaaatagcaaggcttcaggatcgatgaacacatcaatggagctaatatttcaacaaacctttcattcaataaaataattaaggccattgatccctctagctatatataggtacgaactaatctacgtggtgtttggtttgggtgttcaatgctgtaatgagatcacatgaaaatgggcaactttatcaactgtttttgtttgcttgctttgttatcagaaccaactattttaattcacaacagcgtcatcaggtgatagtgcagaatttaggcacagtcgcattgtattacactggcgattcttacatgcatcccttccttatctttcctgtgttttcgtgttccaaccagctggtgtttacaatgctagacctggaatctcatagcaacttgtcatgtgtagttatatgtatcatcctgtccaccccctcttatttttggttctttccttgaatccttttattttgatttctctgaatatcttacagtttttaacagaatgtaaaaggtaaccaatctggtgcgattaatcgctgcctgacattcgtgtgtctgaacctaatacttgcagaatagaacaaggtgttgatttggtgaatggtgctattgatttggatggatagatgatatatatttattttagtttctgaatatcttaattactttatagacatgcgcaattctacttgacgttacattcgacattcggccgttcggatcaacgagtacacacctcaataatcaaaggacggaccctaatcactatgagtaaaacgctgatatatcctagaaaattcgtttctaaggggagtcgaacccagaacctcagatgcttctgaggtttgaggctctggtaaccacaaggctacaggcccttccacaatttgatgcgatatgttgcttttcagtctgcactgttggacatgacaaggccgtttgattttgtttcacaagttactatcaaagggaagtggagatagcgtgtacaaccagcctattagtttgtatgatatgatcccagttccatcccagcctatcagtatattccctcctgttggaaatcaaagcaactcacgcgaacacagtggacacgaatcacaattgcacgtgaagaacacagggaagaagagaacacagtaccgagcatatttgtggcaccgcacatatacaactagtgccttttctcttgctatttcttcacaaaacaaacgattacaaggagcagctatttacaatccatgcatactactaatcgcacatacgcccacgtccggtttacttggccgcaaaactccacaagtatcgcaactgcttgactcaggccgcatctccactacggaagatgatgttgaaataaagattaagtgttcacacaaagcgagtggtaataacatgtgattaattgagttttaattattataaacttgaaaatagattaatctgaaattttagaacaactttcatatataaagtttttacacgaaacacactggttagcagtttgaaaagcgtgccacttttatccaaaattttattcacgtttttaattggattcgaacatgagtcctcccagacgtcgttgcttgcaccaaccaaataatatgcatgcatgcacatgcatctgcaactaactaacactaccagagaaagcgtttttcctctcggtttgtagccccctatactcctagttttataaccagaagtacgaatccgggactaaagataggtatctttagtcctgggtgaaatacctaggactaaacatccatctatagtcccggttggtgatacaaaccgggtctaaagatggcaacgccaatcccggttggtcaccatttctttcttttttttttcattgtttctttccaaatcgagttgtaactgcacaaatcgagttggaacggcacaaatcaagatgctccctatatccccaatcatatccccaaatcaaaatcaaagtatcaacacaaacatagattcacatcacaaattcttaaaaaaaatacatctcaaattctaaaagaaatacatcacatatccaatgaattacaacatctaaaagttctcagaccaacgaatcacaacttctaaaaattctgaaatccaatatatcacaaattcttaaaaaaaaaagaacaacaaaatcgagttgccgctgccgcctcccgcctccccttcggcagaggggagggcgccgctggccggcagctcccgccgccctcccatccgcccgccagcgcggncacgccgncacccgccgccctccgccctccgccctccgcacgggccgccgctccagtagtcgccgcctgggctcggtcgcctggagaggaggaggcggggagcgggagggggaggagagggga

SEQ ID NO: 35624 - DNA, 1582 bp, Oryza sativa
atcgatggaggctgaggctgagatggataagatcaacgcgagactgagatgggggctgaggctgttaatttaatgaggaagggggaggggataagatcgacgactgaccgagatcaaaatgaggcctgcgttctcggggtgaattttggtcccggctgatataataaacaaccgagactaaagatatttggggccctgactcgacctgataacttgaaccgagactaaaaatgatatttattcttggttggtaacatcaacagggattaaagataacaatgttgttagccaggactaaaaataatatttagttccggttcctattcgaaccaggactattgtggattttggacgaccaaccaaagatggtttctccaatagtttaatgcatgcaagactaattcaccacataatcctgagactagtcccaacatgcacgtacgcactacttggctgccaatctactttaagcattcttccaaattttgtgcttcacatgagattagctcgctatgccataacgactaacgcatgcagctgacaacttatagtctactcctatatatgatgacatgcaacaaaataaacatgatcacctaatacaacaagattatttctaacatctccatcccaaaataaaccaacatcgtatactagaatgtgatacatcgtccagatttatagtgttaggatcgatgtgtcatacctagtatgaggttggcttattttacgatggagggagaaacagctagaaccattaagccagcgaaaataagtgcaagacgatactgtgagttaaacagcaccatcatacactcacaggcacccatcttcttgctcaacaagatgcttcaagctctcattcactgacgagattgtgttcttctgacgccgctcatttccaatgcaatcaccatgcatatatattgtcccatggttgatcatctatcaccgttacatataaaatttaattccatcctatagtagatgaagataacatagaaattatatacagtttggatcaaaagttgagagaaagagaagaaagctaaaagatatgaggagggagctaggttgtattagagtatgagggtttattatattatgagcatcagtgacatatggaggctttttaaagcagtcccattgtccaaattggtggacactaccctcatatctattttgtttgtaaaaatagataaagataccataaatctagtcctatctgcaatttttgcaggcatgatcttaagtggtccgctagcaaaaataagagataatttttgcaggtgtacctcttaagaccacgtttgtgagaatcgattttcgcaggagaccttaagatgtccatctgcaaaaaaggtcataccacataaaaatcaccacctacccggctagattccatttccacccgctatgaccggcctctctccctccacccctctcagcgggcggccatagtagtcagcacagccctctcctccctctctcctagatctgaccggaggaggggaggggcagcagtgggagtcacaataagcgacagtgcggaggaggagctcccctcacctcccttcccact

SEQ ID NO: 35625 - DNA, 12186 bp, Oryza sativa
  unsure (1)..(12186): unsure at all n locations
gagcgacagaggcggcgctccccacccctccctatctccattcctactagatccggccagaggagggaagcgatggtggtggcggccaccgcaggcggcagtagaggcagcactccccttccctgccctcccctcccaccctccctcccttctagatccggctagatgggggaggacagcggcagcggcccctgccaacggctggacagaaggtgcctgtgaaaatagtgtattttcacatgtcttgaagtgtaggcggggtgaagagccgcctagaaaaatttattttaactctttgtaaaaaatatgttttctaataatgatcttttagctgtcaccagttatttgtcaaattttcaatttctaatattacttggattccctcctacgcacctaaatgggttaaaaatgttttaattcccatgccattgaaatcataaatacttaaaattttgggtcgtaaaaatactatttttttttttgacctggtaaaaaaatctttatttttgagggtagggagtaagagtagtgttgttatcattaagacacaatggtgaaacacccagcgaaaactccacgtgttgcagtggaaaagctgcatgtcacaaaagtagaggtgcaaactggaattgatttgtagcaatgaaatatggtttaatctcatctgatctgtacaattcatactttatcaatcattatataactgttcctttttggaaaatttcatatgatttgtacaattggtacaaccatacaactattttatatataggatttactaagtgttgtgagacaaattagagctattacaaccagcaagagatgttatataacgtctaaattaagtttcttaaaacctcacattttttaagataaaggaaactttattcatctaagatagtcacatcaagatttaaaaggagtctcttccatttttcttccatttcaagcataacaaaattgttttgacctcaaactttaaacccaccatcacatttcacaaataacttgtttcaatttcaaacttgtcagatttcatatgttttaagttctattaagatctttttgcttctttttatgccataacattctcctgaatttcttgaatactgaaaccaattatttaatctcacagagctttttggcctaaaccctgaaacgggctaagccggcttctgtgtcttccccaccttggtccggccagcttacgtcggcctagccgccactgtactaagcatgtagtatgtagttggcttggaacaatgtttgaatcgaacaccatttgcttcttttatagagcgtaggtcctaattaagtggcatgcttataagcctttgcgctccaatcatatcaccttgggttaaccattttacacaagatatgatgaaagtgtaaatgggataccatgcatatgttagctcgctcaatctatagaactaggctaatgcagattttggagcagatgtatcacattatatctatacaacaacgtgcatggtttctatagcaaacaattatatccctaattattgtttaacaaattatacttcatgcggccataatgcccatttccatcgcagcttttgacatgttcttcttgttcttcatgatgaacgattaccagaacgaccgttgaatgccatgacagttatcgcttgcggaaaggatataccacggggcactgcacatcacagcctatccactaggtcgactgtaatcttgcttctttaccactataatcaggttacactggcctcttgtacttcctccgtctcataaaaactaacttagtcttgaatattgacacattctactactacgattcaggacagatgcagcttctgatttatagtattataatgtatcaacgtcaatcactatgttgattttttcggtgacagggggagcacaaaaggatccgtcagacaataccatgattttttattgctgatgtctcccattccaaaacaacatcttttgatgttacgagatgggcatgttcataaagattgtgatggtcaaaatgaaagataaacatctctcatgttttctttcggtgctctcaactttatatacttttttcagcgaacggtatgtataatatattgcagccaaactgaagggaaccaaggacgacggaatggactcatatatacatagtcgagaggaaatcactcaggccccacaaaaaagaagaagaaaggaaatgcattgcagatatctactccctccgtcccaaaaaacccaacgtaaaaggtaatgtgacccctacttattcagattcgttgtactatgagggatcacatctcttcctaggtcatatcccctcctaggttagtttttttttggaaagatggagtatgaagtaacaaatggagtttgtattaacattaatgtatctacaaacctttcgttcaataatataattagggccattgtcctatcgactatatccaactaacctatgaaccccctccgttctagaatataccatctcagtatgggattagacacatgctattataggcaaattgaaagggaactgagcaatgattgagaggagttcatatgtatatatcttaaaccagaggtgagagtaatggctcagccacactattgcagtgtccatggagtgatgaatggggcttatacgtcaacaacattttctttaaaacataaaacataattaaggctcttcatcccaataggtatatacatagctaggtacatactccctccggttcagttgacattttcaataattgaacaaaaatgtacacgatctctaaaacatatttttaactctgagtttatattataatatataaaaaataagtaaatattttttttcttaaagtactttctaagacttatatacaaatcgtgtgtttattgtctccaagatgattattctgatagtcaaaagttataattatttcacgtcaaccttgttcaaaatggaacagggatgtagtagtaatcagcatgatgcctgtgcttcgggtcttcaaataattctgtaatcagatcacatgaaaatgtgcaacttttaaaaactggtattcttcgattgctttcttatcagaacccactatcagaattcaccacttcctcgggtgacaatgccaactttgggcattccattgtagatttatagtgatgattatgccaaatttgggcatccctgccttatagcttcccctttttgctcgagtaatggcaatcagcgaacgttatatatgatcctgaatttcatagcaacaaattttaggttcatcccctgttttttccattcctgatttcaatctgcactgcacactaattaataacagagaaagtatatatgcaagtctgtacatgcaaatttggaatggtgcatattatgtacttttcatcaattgttacttcaatgtctcccgcaattaatatttttatattgcctcttgggctaaaccactataccaattaagtttgagcaaagcttaaactccagcagaagctagcatttattaattgcaactgaatttggttcataactcaacatatcaaatggcgaggttgtgtggtaaatctgccaccaccgcaacaaccaatttcataatgtttgtgtaaaaaaaacaaaatttgctacggaacactcaaagattaaggtctttgctcctgggcatccgaaaaacgtgacaaggttcgtggacactctaaaaacctggtaatttattaggggacaccatcatcattattttattattattcggttaaatggagaaaaaagcatttataaaagacaagcttaccctttgggttcgtaacttgggtctgttttcaaactttcaacttttttgtcacaccaaatgttttaacacatatatggagcattaaatatggacgaaaaaaaccaattgcacagtttgtatgtaaattatgagacgaatattttgaacctaattacgccataagttaataatgtggtgctacagttgtcggtgacatgggaccgggagtatcatgacttagagacttgaggcagacacgatcacccacgtggcctaaccctctcgggggggggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccagtcaaatcgtgggttaggtggcgacaggcggtctgacgcacgcctcgccccatcccgttaggacgagagcctccaagcactcgtccctagccggagccggcgtgttagctcctagagatggcacattggttccggtcagatatatgccaggcttcatcctaaccattacaagcaagacattgtatgaagaggggcgaacatgcagattgataaactaacgcgtttttgacaagaatgaccgatttgtgaccgggctgacactggtcatgtcgtctgcagacagccatgttcccacgttgcgctgcttctggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagtttagaacctcacccagggcccccggccgaaccggcaaagggggggcctgcgcggtctcccggtgaggagccccaagctccgtcatctggcgcgccaggtaggggactctgcgtgtgttcttctaagctctcacactctttcgtgtgcgccaagctttttctgttcagcccaatggctgaacaagcaaaagcgcacaacctctctccgagtgttagcggtgacgacggggagccaaacccacgccgtcgagctcgtactccaccgccccctccacgccaaagtcctaggcaggaggaggcgctcgagagggtcgaaggatccgcgacttcgacatccacgggtgatggagaagggcgccgagatggggagcgtcgcctcctcgtctatggcgacggcagcacgccccagggcgcgctccgagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctccggcgctgctaccaccggctccgtgtcgtcaaggcggagggcgcggcgagcggcggctgttgctcgccattcggccgtcactccttcgtcagcgcctccgacccaggaagatcagcgtggggggccagatgcccgcatcgatatcgagcgccgacgtaatggtcggcgtgctccccacgcaacagagggcgcctcctcgtccggagtgtcacctcaacacggacgcggggatcagccctccgtgcccccggttggtggtgtcggctgtagagcctttgtggcgagccttcggaatgtccgttggcccccaaggttccggcccaccatcgccgaaaaatatgatgggagcgtcaaccccgccgagtttctccaggtctacacgaccgggatcgaagccgccgggggtgatgacagggtcatggcgaatttctttcccatggccctgaagggacaggcgcggggttggctaatgaacttgccacccgcgttggtccactcctgggaggatttgtgccaacagttcaccatgaactttcaaggcacatatccgcgcccaggtgaagaagcggacctgcatgcagtccagcgaagggatgatgagtcacttcgctcatacattcagcagttctgtcaagtccgcaacaccattccatgcatccctgcacacgcggtgatctacgcgttcagggggggtgtgcggcacaaccgcatgcttgaaaagatcgcctccaaagagccccagactaccgcggagctttttcagctcgcggaccgagtggctcgtaaggaggaggcatggacctggaatccctccggttccggtgtggcagcttcggccgcccccggatccgctgctcagacagggcggcgtgacaggaggaggaagaagaggtcagcccataccgacgacgaaggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcaccgagagggtaagtccccggcggttccttccggcaatcggcgaagtgaggacaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcgggcccctactcatgaggcgacgcgccgggcgcggtggtcggaggttgccctcaccttcgaccagaccgaccacccaccgtgcgttgcccgggaaggacagatcgcaatggtggtttcccccactgtttgcaacgtaaagctggggcgtgtcctcattgatggaggagcagccctcaacatcctttcccccgcagcctttgacgccatcaaggccccggggatgatgctccggccgtcccagccgattatcggtgtgacgccggggcacacttggccgctaggtcatatcgacctcccggtcaccttcggtggatccgccaacttccgcacggagcgggtgaactttgatgtggcggacctcaatctgccctacaacgcggtcttagggaggcccgtgttggtgaagttcatggcggcggtccactacgcctacctccagatgaagatgccgggccccggtggccccatctctgtccatggcgacctcaaagtcgcgcttgcttgtatggagcagcgtgcggaccacctcgccgccgcgtccaagccggagggtggcgacgagaggcttagcacatccgcccccgccgccccgaggcagcggatagtcacatgcgacgaggtcctggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggacacttaccccctgcctcgcatagatcagattgtcgactccacagcggggtgcgaccttttgtgttttctagatgcatactctagttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttctaaagacgcgcaaccaagagaccttactctcggatctagcggaaacttttgagagtctccgctccgcccgcataaaactgaaccccgataagtgtgtgtttggtgtacctgcgggcaagcttctcgggtttttggtctctgcccgaggcatcgaggccaaccccgagaagatacgagctatagagcggatgcgcccccccagcaaacttagggatgtgcaatgcgtcaccggttgcatggccgccctaagtcggttcatatcgagactgggagagaaggcgctacccttgtttaagctcctcaaacgctccgggccgtttacttggacggaggaagctgaacgtgctctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccaagccgaacggtggcccaaggcccccgacgaccggagcaggccctgtgcccgcttgtcagacggtgccaggtgcccccgacccccaggatggcccgagggccactgcgggaaggccgcacctatcgccctctgaccccgaggctaaccctgtgccgattcgacccgggagagagcagggagaagaggcccccgagccgaacggtggcctaaggcccctgacgaccggagttggccctttggccgcttgtccgacgacgccaggaacccccgacccccaggacggtcccgaggccactgtgggaaggccacccctgtcgtcctccgaccccgaggtcgtcggcacagaagacgagtgcaccccgcgaggccgcttggacaaagagcgccccagggatgtggcccctagcgaagaggatcggccccaccgaaaagtgcagcggcccgtctactttgttagtgaggccctccgggacgccaagacccgataccctcaggcccagaagatgctttacgctattctgatggcttcgaggaaactgcgccattatttcctggcgcatcgggtcacggtggttacgtcttaccccctcggccaaatcttgcaaaatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggccccccgcagctgcctcacaccgcccattgggtgatgcagttcgacgggctcctgtctcttcagggcgccggtgcgggggttacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccatcggcgcgacccgaccccttaggggagacggacgcgcctgacaggccaccgaggcccgtcggagtccaggcctcgggacccgaggggagcactcccagctcccttagattgattgcttggatcgctgagatccaagcatacctcacagataagactctacccgaggaccgcgaaaggagtgaacgcgtccagcgcatctccaaacgctacgtgctggtagaagggaccctctatcggcacgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatacagagcgtgtcaattccacgccaagcaaatccatcagccggcccaggccctgcagatcataccactttcatggccattttctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgtggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaagtcccctcgggccaccatgtactgcgaggctgatcaagatcagcttcgcagagatgacctcgattacttggaagagcgaaggcgacgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctgtcaccaatgtgggagggtccgtatcgagtgatcggcgtcccccggccgggctctgttcggctggccacgggtgacggcacagagctgcctaacccgtggaacatcgaacaccttcgtcgcttctacccctaaaggggaatcgggtgtcaggtttcgggctcgggccaaccccgcacccccctcgggtgtgcagggtcggtcgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcagcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgtggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgccgtcatcgtcctcctcgtcggagttgaaggcgaacgcgagccgaggggtcgaaccctcgaagctgtggacgatatggtcggcggggtcccggacctgcgcgcgcgcgccatacttggtcccgggagggaactcgtncagcgccgtccatggggagaaggtcggatccctggcttggtaactcgccagtatgag

SEQ ID NO: 35626 - DNA, 13212 bp, Oryza sativa
gccgccccgccgctacgcgcccttgcatccagctcccttgcctgcgcctcgagttcagcggcccgctggttcagtgcggccctctcggcgcaggcactttccagattgcgacgcgcttgttcctcttgcgcagcctcgcggagggacaggctgtccgccagccattgcgccgcggcgtcggcctcctcgagagctcgctcccgctcggtgagcgcggactattcttccgcacaggcggcttcgtgcaccgccagtgtgacctcccgaatagcaacagcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcaatgagggcagccctccgctcctcctccacctccttggcgatctcccccagcaccttccgacgggcttcgagctctgagacgtgccggcggtgtgccttgcggcccacctccaccatggcctctaccgagcgtcgcccctcttcgacacgcgcccatgcggcgtcgagctccgcccgctctgcttgcagggcctccacatgggcacttaacccgtccaacaccgtggtgtttgcgacggccaaggcctgcagaaggggttctgcgctcagtggagcaacggaaggtgtggggaagagccgcctcggtgaggatgccgcgcggctcggcccgccgatggacgtgccagactcagggatgtcccccggaccgggcttgtcctgagtgtcgcccgagggattgggcccaagcgatgcgcccgcggcctcgtcgcgagctgcctcggaagtcgtcgccgcctcggcctggcgaagtctggcctcctcccgagcggcttcttcagcttggcgagctcggacgcccacctgggcagcttcctcggcttctcgaaggcgatccgcggcctcttgccggtcagtttcacgggtcgcctcggaggatgtcgtcgcctcggcctggcggagtccggcctcctcccgaacggcttcctcggtctggcgagcccgggcggcctcccgagcagcctcctcggcttcccgaaggcgatccgcggcttctcgccggtcagattcccgcctccgggcctctgtggtcgccgggtcctcggcctcagactggctggacttggaatagcgggagggacgcgacgggatctcgctgaaacagaagaaagaccagaagacaaacaagatggatgagtgaaaactcgcattgaaggaatgaatacggccacgatgggcgtgggacgaacctgcgagggggtcggttaaacgaccaccttggaggggaaatgaggtttccccgggatggttctgtccccccccatcttgcggggccgtttcttcttccgctccccctcgggctgcgacgtcggcgtggccccctccgggcgcctgctgctggcacgcgccgccccgccccctcggggaggagatgggggaggggttccttcctacttcctcttcccccgggcgtcggcagggcggccgatccccgggcccccgacgcagggcccagaagcacgaccccctcccagggtagattgttcccccctgcggctcccgcccgcgccatcgtggcctcgaggagcccgctcctccgacgccccgaccgcctgcatgatggtcaggatggaggcgcggtctgcatcgcagcagagggggaggactccttgaggaatgagggatgcctccacggagctgagattcagcacccgttggaccactttcttgaagtcctcaggagcccagtcccatctgaccccctggtgggtcctcatacagtcctcggacccggtgtactcccaggcgccctgggcgcgccgctggagtggcgcgatccggcgacgaagatagtcgccgaacaccatggcccctgtgagcccctgggatcgcaggcccgccaggcggtcgagaacggcgtcgtagccatctcccagatctaccggcgtccgccagttggaggcctgcgctgggggctggctcggaagtcggaggcgcgcttcgtcggcgaggggggtgtagaaccagtcgctcttccagtcatcccacttcttgcgaaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatagcggaaccagccctgccatagcaaaagggaggaagaagacggaccgccccgggtagcgtggcgccgggcatccctcgcccagcgagactatctcccggccggtggcagattccggcatgaagcggcgcggcagcccggcttgtctctcgctcacgatgcgggaaggcggcagcacgctaccatgacgccggaagaagagatgtttgagagcgagcgcgtgtggcgaaggtagggcacaggaaacaaggagtcagggcgcaagcggcgaagacaaggggaataatggcgaaaagaaggaagcaaatctcttcctcggtgactttatacccttgccaacgctatgcccggctcctcgtttctcgcgccctctatctgccccctcgtttctcgcgcccacacttccactaatcccattcgcccgtttgcggtgcatgaggtggatatgcggctgtggcagtcgagatggaacatctcgtgcgcgcgttaattacgctcgccgaccgaagcgccatcatcatatctccaggaaaaacgaaccggctcgtcccgattcgcgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgagagtatcatgacttagagacttgaggcagatacgatcacccacgtggcctaaccccctcggggggggggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccagtcaaatcgtgggttaggtggcgacaggcggtctgacgcacgcctcgccccatcccgttaggacgagagcctccaagcactcgtccctagccggagccggcgtgttagctcctagagatggcacattggttccggtcagatatatgccaggcttcatcctaaccattacaagcaagacattgtatgaagaggggcgaacatgcagattgataaactaacgcgtggtggacaagaatgaccgatttgtgaccggtctgacactggtcatgtcgtctgcagacagccatgttcccacgttgcgcctgcttctggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacagaagtagggtattacgcttctcagcggcccgaacctgtatacatcgcccgtgtcttgtgctttttccattctcgcgaaccttccacacacagacaaggagtttagaacctcacccagggcccccggccgaaccggcaaagggggggcctgcgcggtctcccggtgaggagccccaagctccgtcaacagtaaacacttactaataacggattaattaggcttaatatatagattcgtctcgcagtttacatgcaaaatctgcaatttgttttattattaatctacgtttaatactttaaatatgcctccatatccatcaaactttctttttaccaaaacaactaaacacggcctgcatcttcctctgtcactgcggcttcctcgatgttgttgccaagtgcagcctctagctcctaggtcaaccttgccacgatcagcctgacgcgcgtcggccgcgaccacgttcagcgccgccacagggtcctgcagtgcagcgccaccgggtcgagcgaccggtgcgtctccgcgaacgcaacgtgaaccgtgtcccaatggtgtccagggccatgagcacgagcacgggcgcgcagggcgagaccgacacgtatgtgcggcgctgtgcacgacgacccagttattatttttccacttaataaatgtggctttaactgctcatcagtctatcacttgattatttgtcactcaatatatacttgctatctccattttaggcattttcctttaaacatcaactcatccatgcatggtaagaagaacatgtgggggttctgtgtttagaggaagaacagcaaattaaatggttaacaaagaaattttatggaaaaattattcaagttcctatggtttgagaaccaccggttcacagccgcacatgaaaaatttctcatgcacagacgcgatgggctggtgctgaactgctgatcaacttcgggagatacagagaggaggagaggggcaaaaactcgtcttttcaatgctatttctctctcaatttgttctgaaaataataaaataatcacaacagtgtcccttaacaaattatcagtttctaatgtgtccacgagccgtattagttttttcagatgtctagcagcaaagatcatatattttaagtgtcacgtagcaattttttttacaaaaaacagtgtgaggcctataagttcacctgttatttagaaaggcactatatgcagaaattcagtggcgccatatgtagaaaatgatgaaaaagggcttgatgattagagcaagtacataatagtgtcaagacgaaagagaggagagagaccgggtatatatgatgcccctcatagaagaggcagcttgcacatgatcgagctccaagagaaaaggagagaaaacaagtaaaataaattcttagtattggaataagtgtattagggatagtgtagggtgtcgcatatctagactcttaattaatgactagcaaaatgaacaaaattacagatagcaactactccatccgtccaaaaaaaactaacctataacccctcctaacttgagtttttcttggatggagggagtaccattcttattaaacttgatcttacacggttttagaggctttaaaataaatgagaatgttcttctttaattttccgatgcaatgcacatccagtctgcaagcaatgacaaaagaacagcatagggaaataaaaaaatggttttctcccattccattcccattaattattgagatgtatatgcctccttggtcctttccagttaaaggttaaaaaaaactatattgggttttttctatcctgacggaatttttctctgacaagctagtcctggcggaatttatttttctgacattgacacgtcatgtacaactttcctgacgtgttttttttatcctgacggtttttggccgtcataatttaagtaatctagtttctggtagtgtgttcatctttcttcttatcataattatgaaagaaaagaaactggatatcacaagatttcagtgttattaattgtaggaatttatcatctagttctcattagtgttttttacccaaaaatatatatacctgcaatttaatataacaaaagatcctggaaactaaaacgacccatagtcaaattctaattaactatcaaaacatattttatatttctattatataatataaaatatcataatgtagctagaatcatttacaataacatggaacctatgcctaggctggccatgaatcacttccagcattagaattgtttttcctgaagcattagaattgtcacggagatgatactggaagaagggcaggagtcatctggttttatgatggagttagacgaggatacgctcagattagcagccattccgggcgaccttctcaacaaatcttgcttctactgggcactcagtacattgtgttagcctcttgtacgaaaggcaccatcaggccatggcaagattctcagttgctgatgccactcattcctaaacaggaactgtttatgctctcccatggggtgttcatcaagattgcgattgagaaaaatcatgtctctaaatttttgtgtgctcttgcccctctatcgttgttgcaccgcgtatattgtatccaaattgaagcggaactgagaacaatggaaggggtttataagtgaaacagtttaagggtgatcgacatgatgacgaggacgatagtaataaaaagaggtgtttcaagtatcatgcgtctaacatcttcacttgataaggacgagagtaataaaaaacagttatgtacatcagcctgctctcgaatttaagttttgcttttacatgtcgggtggacgattttatatattcatttgttacatggatggaatgactcagtacatttttcaccaatctttttgaaaacaattatataattaaagatacagttgtagaggcacaactgattttatgtgcttgctatggtatatggaggagcctagacatcgggcgtctgatggaggagtagaaaaatcgagcggtgatgtcagcaagatgcatgtgtgcaaaaccactttaaattattttttctcttaaattatttatccaaatcatgatccgattacaccattaaattcattttaattaaatcttcaaaacaagacaacatatggatatatttcgacgaaaaaaattttagcttattattgaattatttttaaatgttgcacgttgttccaccaagtatatcggaattgtttcactaagtagatcgaaaatgtttcgatcgtttaaatcgggtgttgtttcactttatataaaaacaatatttcagcaaatagcgaaagaatgtttcagttcactgcaatattagatctatatatagtgaaacattgtgattgcactagatgaaacatttttagtggaacaaaaaataaaacgaattcccttaattgagggttttcaaaataagtgggtgatttgttgcaacgtcctgcatggtggggacacgtgacagtatggcaggggagacgtggtggggccctacgggcgcgcgcccacgcgtcggggggtgccccattttcgctgcacccccccccctccgatcctaaggattatcgttggtatattttgctctatctaggggttgttgcctacactagctaatcccgggttgatcccaaagctgccactggtgtagcttgcacggttggagaataatatccgtttcggtttttgttaggcgatgtgataggcacggtgggtgccgccctagtgattgtgcgagggcggcatgtgcgtgtgtgagtctgtgaggtgtggtgtgtgttttgtcgagaattggggatcgtcagttggcacgagataaagacttggcagtgttaaatagctaggttttgctttgtggagtacccattatgaattctagagaaataatacagagaattgccccaaaagttctctccgcctttccattgaaaattaactctgtttttgctctctctgaattttgctattcactacagtgcagttaccagggttcttcctgtataggggtcaatgttttatagttctagcttcaatgggcaatagaacactctctgaataggtagaatgcagttatagagtttagcgaactacatgctgggcgaccttctccccatgttcaatcccagaaggttacactagcctattgtaattctgaattactgatgccactcattccaaagcgaggatattgtttatgttttcccatccaatggggatgttcatgaagactgcatttaaaaaaaaaatcatctcccaaaattgttcctctgccattttgcagccaaagggtatatttagccaaactgaaggtaactgaggacaatggaagggtttgatatatagcaaagttcagatctgatcatgacaagcatgagagtaataaaaggagtatcaaatactccctctatttgtaaatatttgtagctattaatttttttaacatgtttgaccgttcgtcttattcaaataattattaattattttttatcatttgatttactgttaaatatatttttatgtatacatatagttttatatatttcacaaaagttttttaataatacgaatggtcaaacatgtgcttaaaaaaatcaatagtgtcaaacatgtgcttaaaaaatcaatgtgcttaaaaaacggagggaatatatcagacagccacctaaccacacgtaacattgaatagcaatgaaatatatataacttttcattaaatacaataattaatcaggctcttgatcccactagccatatactttctccatctagtcttgatagttatatttccaaatctgaaaaatttattttttgatagtcatatttcaatccaacaacctatcattttaatgactttctcggaattaataaatgactcttcactattccacacaagattggctacataggtattgagaaatgtaaatattaatgaatcgcttgtttacgagaaatgactagtagtatgtttaaatggatgataagtagaattgcttatccttgttctgtgtactaagatgaaatatgactatcaaaaatagatggagggagtagtataggcacgtaattaattagtgtggtgttcagttcggttattcaatgctgtgacaaaatcacatgaaaatgggtaacttcgatttagcaattgttttgtttgattgctccgttatcagaaaccactatctggcttcaccacggcgtcaccacgtgattgatgttaccatgctgtccatctcctgtttttttctttccttgatcaatcctcttaatttgatttatcagaacatattacattttcttaatgaaattataatgactaccaaaaatgtcaactgctgtggataatcgatgtctggcatgcatgtgtgtgtctaaatctagctactcttatagcatttctcacaacccaataacaactatatcattcatgttacagattcgaatctggattacattcataacataattatctttacgttctgaatgttcttaactactttggagagatgcctaattcaactgaatgttacatacggcatttggccacattgcaacatgcagatcgaactgagtagtactccctccgtttcataatgtaagtcattttagtattgttcacgtttatatagatgttaataaatctaaacatttataatatgaacattgctagaatgacttacattataaaacggaggaagtatagaatttggcgcgaccgttcgggcaaccacacctcaatatataataaggacgcatagttactaatcacttcttagataatgaaaatggtttatatctctggtctctgctaggaggcacacagccaaagtcagtggataaggcacccccaatctgatgttaatttccagtctatagcctgcactgttggacaggagtacaagaccaggctgtgattttttttctaagacccatttgttgttgtagggacatttaactttttaccacattaaagatgtggtaattaaatttatcacttgatgtctatgacttgtaggtcccgtgacaaatcttttatcaccacttgtaatagtggtaaataattaattatttccatttctacctcatgaaaagaccgtactgtctgcaacgttcaaccggcctatgagcttttagcttcccactgtcctcccagataaactgccgtaccatggagctaccaaaagaatttgaggaccagggtgcgagttaaacagacgtcgctctgaccttgtgctcatttgggccttctcggagctcagatgatccatcgagaagtcatgctaagctgagtttatgttctcctgatactgctcatttctaatcatacaggaatcaaacatataccgatattgcagatcatgttcaatttcatcctataatagatgaagagggtctagtagaagttgggagaaagaggaatgctagaagagatgaagagggatatgcaatggtacagtagttgagaggggggggggagggggtattatattcatgtggagtagaggataggtgaaatatgtattgctattaataattttgcccccctctataagttttgcttttgaggacataacacagggggaaaaatgggattagttggacagccgttggaaggtggttatgcgagcccatccaaatctagtacaactgttaaataatgtttaaaacaatatttaactagtagcaattattctaacttttcattattttaactttatttgttcctcctccatctcaattttttctagcatatgttttcttcagccgacgcgacccttcactgctcagcaagtggtctttagtcccggttttttcttttgttcattgtttttactgcttgcatattgatttccccaaatcgagttgctccctacatcctcatatcatagattcacagataacatcacagattcacaccacagatcaaatacatcacaagtttacatattcacatcacaaattctcaaaaaaaatacatcacaaaatctcgaaaaattaaaaaaagactgaacttcttcctccgtctaccgcacggccgtgctgacgtcgttgagccgttgtcgctccaccgccgcacagcctcccatcccgctgcctcccctcccgccggatctagcataggggagggcgagaccgcggcttctgccgctcggccgccgctgccacttctcgagagagcgagagagagagagagttagagagaggcgaggtgagagagagagagatagaggcaagagaggataaggacgtgtagcacatgtgggagatcgagggaggcgtggaaaagaaaggataagcacatgggagagagatatttagtcccggttggtgatatcaacaaggactaaagatcgttagggacctgacatagcctgacagttattgtattgggacacccgtgactaaagatcataaagtgccattgggcttttgaaccaggactaaagctgatctttagtgctggttcctatttgaaaccagactaatgtgatttttacatgatccggcaaaagatcacttgtccaggagtacttcttgctcactcctcccatcctctttcctccacatcaactgacatgctatggactagcacactaattaccgttgtacatgctgtaggaatagtatatttcaataaaaaaaataataggaatagcatagtacggcaccacatgccctgatgttaatataattttatatgaaatacaatattttgtgataaagttaagtagcctcgtgttgaaacatcggtatatatatatggcggagatgaccgatgagctaaatgtatgcaatgcagatttttcaccaaagatcataaccaaactagcccccaaggtacatagaacaattattcctaggtcaatgatagacaatttgtagggttctcctaccaaaatactcaaatctgttttgaaatacaaggatgacaagattatttagcaaatattgagattaagaaaaaaaagtctttctctcagcaaatatggaatagatggggtaaaataggaagaaattaaagtatatgagatgtgattgaatactatgaataatgtgctaaaaattattatattttgttatattttggaacggatagatggagcaaactcaaaacaagatagacagcggtgcggttcataattaatatggatgcatatgcgtcttctacattaaggtatttaattattggagatacaatattggattaagacgagctaatgctccctccatttcaaataaattacttgcgatgtgggtttgccggttaaacattaacatcattttcttgaatttgtatagtttgataagatgtgaattacatattgcgaaagtatttttcatgtgaatctaaagaaatttagtatgatgttaaactatataagttgttggatgatggttcgcaacttgcaagcagcttgcgtgcaacctccaacaccagcataggcaagacaagcatgcagaccaccaacaccaactggatccacgtctctgtgggccatccgatgaagccaggcccatgtccatgttattgtgtgaggataagtatgttagacctccctcacctcttgtccctgcttgaattgcttccctcaaccacaataccagatctaacgcatcttctatatttgaaaatcagagcaaatcgagtccctcggttgtttgaatagcagttttatcctaactggtgctcgtgggacccacatatcagtaagaaaaaataacaaaaataacaaccccacttgttagtcataatctttttttttctctttttactcacctctctcttttctagggatggcagtcgggtacgacgggcacgggtagtgactacccatatccatgcccgcgaggtaattcatgcccgcgggtatacccgttactatatgacgagcaaggaacactacccatgcccgttgcccacaggcgccatgtgcccacgggcatgcccgtttacccgtcacaaactcacagttcaacatttcaaccacaaatctccacaagcagagagacattatcacaatttaaagaaaggg

SEQ ID NO: 35627 - DNA, 25644 bp, Oryza sativa
  unsure (1)..(25644): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatccatgcccgcgaggtaattcatgcccgcgggtatacccgttactatatgcgagcaaggaacactacccatgcccgttgcccacaggcgccatgtgcccacgggcatgcccgtttacccgtcacaaactcacagttcaacatttcaaccacaaatctccacaagcagagagacattatcacaatttaaagaaagggtacagttgtaccaagttcaacaatacaagcattacaagttcatcaatactagatggtggcatttatactaatttgactaagggaccacatgtcagttggtttttgcgggtaaacgagcgaagcaggcatgagtagcgactacctatgcccgtgctcgtatgcccgttaggtataggttttgacccaataaaaaacccatgggtactaaatggagaacaaacccaactctattaggatttttatccacgggtaaacggacaaacgggttaaactgccatccctactcttttccatctatcgtgcatgccaggcagcaggagcccgcgatcaaagagctcctccccgtgcgtgctgcggccggtgactcctccccgcgcgcagccgcctagcgatctcctggccgtgcaatgccattcggagcttctgcaccgacaccgctgccgctgcctttttcctgctaattgctattgctcctgctagttgatgtagagcacgccgtatcggactcgtagcccctccgcctgcttcgccatctccagctactgcagtgacggcgagatcgagagggagagcccctggccatcctccactgccaccgttgaacgctgcacaggcaccgccgaatgcatggaacgcttcgtggtgctgccatgctagtggatagccgactaggcgtccgacagcggcaccaacgtcgacaaccgaaaccgatcaatactgatgtgggatcatcgagaatgggcgcatcgctgcggccaggtcagtggcgaggccctctatggcgcctccttgttgctccggtgacaacgtctcacctaacgaacacatgctagccctatagatggccgtaaggcccgcccggcacagcccggcctaggcacggcccaccggccatcgggccagcacggcccagtcggcacttcgtgccgggccgtgccagcccatgggctgcacctttggcctaggcacagcccaccagcagtcgaaccgtgccgtgccggcccgaaagcacgggtggcccatcgtgtcttttttaaataagtctatttttcttccctcctcgttgggttgtgacatatctatagctaaaatagtctattttttctctctcctctttgggctgacatatatatatatatatatatatatatatataaaataagtctatttcacgtccttattctctgaaccatggcatataatatgtctatgtttgctccctattctttgtgtgtcgggcctagcctgctggcccatcgtgccgtgccagcccgatcatgccgtgtcgtgcttggaccgggccaaaataccataccgtgggccggccgttgagcttcgggccttatggccatctagagctagccccaccgagcaccaacccagtctggccgactgcgccgccgcggaaccaacctccggccaatctagcgacccctcttcttcttccgcagctacctgagcttatcattaccagcgaccgcgcagcttcatcagaccagaaaaaaagaaacaactccccttaaaaaccgaataatccaaccacaagaacacaacaacttgatcgaattggaggtactaccaccactgctcctgcctcctgatgctgctgattgcataagaaaaatttctacttttttaggttttttttattttctaattaagttatttaagggtgcacgttgatcgacccctgaacccacttgcacctttaaagttagtattatggattcatgatgcagaagtctaataatttatttatcttttaccaattttcaggtttttcttgttttttctcactcaattactacatgcatatggattaatcctatgaccacactacaagagaatggatttttcgtgactgcccctcactctcacgaaaagtcaaaagcctgtcacaaagatctttggttaccacatactgtcacaaaatgtcagtcacgcttgattagtcacgaaatctaatatttggtgaggggaagcagtcacaagctgttaagtgactgtcaagcagtcacgaaaaagcaattcccccaatttgcatgttttgaccatttttctaacagttttgattaaccgttgggaatactttttcgtgaaggtggtagctgtcacagaacatcaatttcttgacagacttttgccattaggaaatacctttcgtgactgggtggctgtcacgagacacgcgatgtgcacgtaattaatatgaaaattcatgtaaatcaatctcatatgctacaaagtgagttcagatataatacaacaaaatcacttattttacccaagtccaaattcaaactcacaaaagcatatattagcattgaacatcgtgagtccttacataattcatagaaaaacaatatttaattatgcactacaaatttctacacaagtcttgtatcagtccaacaattcttgaagtgacaagcccaatataatgccatagaatagagggaagcagccttcggtggccactcataaagcaagctccacgtgaaaaaaggaagtcttctgagctttccataaaagaacaattctacaattatctacaagatatgatataatatattaggaaagtttcttcaaaacaaattagtacatcaaagtgaatcatcaaattgagttgaactgtatcactggacttgaaattgttgccttaaaattcaatgaatgtcacttgaagattacagcaagctacaatttagttattagctaatattattactgaatagctccaaattcaaatgaaatcactagtcaacaccgtaaaaaagcctataaaaagcttgaatcagattaatcacatgaggtaatcaagtagatgaatcatcggtaaattgctcttatcatgcataccgattaaaacactgtactggaatgaagtcattagagccatgcaaaattacaatagttttcttggacctttagcaaatgctccaatatttttgccatgtttaggttcaataatgaatccaagataaaaagaacacacgccaggcagctgtcagataactggataagcacatttctgtgcagagtttcagcatctaagataaaatgaatacatgtataccatgtagcttcagatatctaggaaaaataatttctagatcaaagaacgcaagcatgccatgtagcttcagataacaagggagcacatttgtatgtgttaagtttcaggacatctttaagaaacagagacaatttccttaaatcttgcaagccattaggtaccttcagtatgttctagtttcttaaatacaaagctggtcattttggcataagatgactagtatcaaatcaattatgaccaattaatggtagcatataaatgagtatgataaatataaaaatgactcaccaaaattctagttctgatgcatcaaaaacagcagtcttcctctgtgtcccattcttcagactgattagaacagtctacattagatttaaaagccatctttagaaatgaaaggaaaacatattaaagatatgacacaacaagtaattaaccatagtatttttggaaaagcgaaaagatattacttccaaggcatattaaagatgtcctgttccactatttactagcaacaaatcattaaaaccacattatgcgttgcacaggcagtaaactatatagaacttaagaatggactgcagaagttcagaattaatctaattcccacaatgcattacatctagtagctgtgtaggcacaatggtaactgcatctataagctatccaactcctcctaaacatctgcatagagttagacagtgacaacaacacttgcatgatagccggtnacaagaaaagaacagaaaataattcagaaaacacttgcatggtgacaaagtaaatgaaaagaacaaatgattcttcagttttaccttgtggatgttcaacagatacttcaggtgatgtcattgatctgcagtaaactcgctgtaggatcctataaagtgtaaaattagaagaatttagaactctaacaaacaatatggaattttaactaaaagttagctgattttttcaaaagtacacaacactgacaagtatacgagaaaaatgaagtataatttcagtacacctgcaagtagtagaacaatatttgtgcattatctacatatacaggaaagggaacacaaatgtttataattgagatgaacattaaacaacttgccttaatattttactatgaattaaaatccaattcagaggatgcaaacacatgaaaaatgcagcttgtaaaatatctcactgttgtaaggaaccaaaaagctagtgtacaaaaaccaaggtcagtaaactatccataattgtttatcataaattatcctaataccactatctaatgaaatctgagaatttttgcatccatctaataaaagcattgtgacaaattactggtttaaaagcctcagacataaattcaaccaaaaatcgctgcattggcatttcatcgaacacctatgtgtcaccctatggaaaaaacagagggaactatttctggtggaaggattgagagcatagaggagaaggcaggtcgctggagtgtagagtagcgatcgcgcacctcacggcgagaagagcaatggtgacgcgacccacggacaagacacggggacggcggcgaaacccaccgtgaggagagcagcggcggcacgcccgtcagagaggagagcaagggaggcaagaccaacggtgaggtgagaatgtacgggctccttcgccggcatcactaccggcgacgaatcgacgagcagagttgcggcgtcgaggtggaggcgtggagctcactagggcaagagccatggggaacgagaagagcactctgtttttagtggttcacaatttcagacagaggcagagcagcttggcccatttaagtccatcacacagtatggtgagggctttatattactgcaccgtcaccaactctataactcggtgactggctgctcttcctagtcacgaaacacccaatttcgtgatggtgttctaatgcctgtcatgatatgtcttcttggtgactgtgtttacatcgccatcacgaaatctgtggggcagtcacaaaaaaatgattttccagtagtgccaggtcagccactttattaacacggttaagaaaaatgatagaagctatgataaataaataattaatctaataatattgcatgacaaaagataggcgaaatgataaactacactaactagatgcataggagtatatagataaatgtgatttcgtaggttccagccgtccgacaaattgaagctagaacgaacgatgaatgttgtgtaacataggggcttgcccaattagatccaaaggtatcattgtatacctaaggttttttataaaaaaaattagtatatgcgatactccctccgtcccataaaaaaccaatctactactggatatgactcattctagtactacgaatctgaacatatctctgtccagattcactgaactagaatatgtcacatctagttatagattcgtttttttaagacggagggagtatgtgattcgtttgtgtatgaaaaaaaagcctattcaaccaaagaagcaaataaatccatcttcttatgccggccggccgggctccatcctctcttctctaattaaccaatccgcacaagtttgatgatctactttggcaatttgcacatgccaagtattagactttcagttgtaaaaaaaatacggctatggattttgaatcggttttgcgatctagttgtcgaagggcaacctcaaaatcctaggtcggctccactgtatcatagtataaatttaagtttgtgaaatgctaacattatttatgaagagttccttctattttctgcaaaacaaatataatttttcatggaagtttaaacctgacacatttcacaaatattttatttctactagaaaaaatgcacgtgcgttgcaacgggtgaaggctattttaattttattattgttaaatggtttaactaaggtgaaattcattgtggcaattcgctttgatgtattttttttaaatcatgagctgtggttaggagtctgatcgttacaaataagcatacgagtttttttaaagagatttcttatacgactccttctgtattttcaaaaacgaacgaatttaaaaactgactcaaatatggacatgtattttcaaaagcgaacgaacttaaaaaccgactcatacacggatgacgtaccaaagtaccggtaaaaatatctttaatttttataacagtagagatagagatttcgaatattgcgaattccacaaaaaaaaattgtcttattcattttctcctctaattgggccaaagtcctaaaccagggcaatcctgtttcttgcctatctcggtccaggcaaccaaactccggctcaattccggcgtaggatggcccactcgccagtgtactgcgctggctagcttgcacttagcttgggatgatattcctttgaatggaaaaccatatttgcctcttgcttcaagttaacaccatcatgtacatttttatataccctctcagtcaaaaaaaaaatcaatctaaaaaagaatgtgacctctcatagtataacaaatcttaccagagaagtcttatccctttcttggttgagaattttttgtcacggagaaagttaactagtgaagacaaaataatactccttgcatgactgaccaacgtcaaatatagaaaagggcgaggattcgacggacaggacgaattatatatatcaccatttaattaccgcaacacatacacaaacacacacgcacattaattaatgccactacaagattaccagctgcgaggatcaaactagcgagtacagtagcctccaagtgtgattcactgactgattaattaatcaactagatcatagagagagagagagagagtgatgactaattaactaattaatgagagggagggacggcgcgcagacgacgcacgcgacggacgcggcgtcgtcctcctcgctgaagcagctccgcttgaaccgcgacgccttccccttgttgcacggcagccgcaccagcgctgccgacgcctccttcgtctgctgctgcggcctccctgatcccggcattgacagctgccgccgcagccgccgccgcgcgccgtccgccgccgcccggtgaaccatctccgatgatcagctgaggttgagagaattagttgagagtgatcgagagaggggatcggcttggtcgagctagtgaggtgtgggggagccatggcgatgtgttgcaagcggctatttatagagggagacggagattgtttgcccttgggtcacgaacgatattacgcatctgccatcgttaacggattggctttaattcgaattccatttggaagctactgccggcaagagagggaacgaaatagcattcaaaaaaaaaagaaagaaaacaatgggacatggtactactgcttgctagctagaaaaagaaagatgagagatgagatgcgacgtgaggattccggattgtcgttgggcgtactgaatgatttgaatccacatggaggcaacgcaagctaagctagcagagacatggcgccgttacgtggaggaagagaacatggtagggcatatgcacagagcgagcggcaacagtagtagttgatgaaccgaccggccgggaccaatgggcgatcgatcgatcgatcgcagtggatcggctgctcgtcttgccggaattttgtcgtacgtctgccaccatccgttcaatcgatcgatcgaggacgggttttgttatgttaatacaactttattacttttggcttcttttgggggtaagatttttgaacttttggtatggagggataatactttaggtctctttaattcgtaggatagaaaaagaacagaacctgaagtagtttgattctttcatcctgcgggaataaaaacacatgaaaagataaaaggtacccaagctttgagccggcaagcctcgcctccaccttgcgggggcagctgatgggcaactagccgcgtgaggatgcgcgtcagttcgaccccctctagcctctcctctctctcatctctatacgtatatatgtatgtataaacttataaagtgtgtgtgtgtatatatatatataggtaaagtatatatatgtaaagtatatatttttttatgcatatactcatttgatgtatacaagatatatacacgtatatacaaaatttatacgtacaattttttttaaaaaaagtcatgtatataaactttgtatatttatgtatacatattagaaaaacaaacaaaaagaaaaaacgagaaaaactaaaaaataatcagaaaaaacaacgaagaaactagagaaaactgacacgtgttgccttcaacgcaaccccccctcccccctctccgcgcgtgccgcatggctgtgccgtgtaggcgggagggcgcatgactgaccgctaattggcggttttgctgccttgcgccgccggcagtcggctcacactactttatatctctatcactgttggtttgttggatactaatatgtgacccctggtgttctcattccatctccctctgttttttttcccacaagaagcgcaaaggggcacacagtttaccgccaaacacatgaaaacggcgcgaacgacagacctcttccttattttcatgtaagggatataaccctaaggaatgttttctttcatttcctacgaatcaaaggcatacatatgaaaaaaaatccgtaggattgtgaatcctaaaaaaccctataccaatcctttgaatcagaggatcccttactccgcatgtacagaagggttgacacattttcttaagatactccgtctgttctaaattactcaatgttctagatttgttctatgtcagatctttgtatctccgatcttcaatttttagaaatttatgtagtttaatttcagaaataatttcataatatctaattgacggaatgttaaactacataaaattttaaaatttgacggcgtaatatagaaatgtttgatttatgataaagctagaacgacaactaatctagtaaaatggagggatcagaagtattgttgtttcccgcactgagttatttgcacatggtactgcaaaaccatatcgctagctaatagcccttacaggaaggcgaattctcagagcaagaaatttatatcaaaatcattttgcctagtcaagtaataacctttgtcgagaataatgatagttattttacatcgtgcatttgttagaaaatatatatttatatgtattattgagctagatcactcagtctaccaatcaatgttacaattaccatgctatgttggcacgcacaaattaatttacccgggagctgaaatttgaaagttttttttttctaattttctaaaaaaaggaaaaatgtttaaaatttttaaatgaaatagttcgtgccgtgcagtactaaaaaccatttaccgtgcggtccgaaagaggtttttgcgtgcggcatggcaacccgcatgcagcaaaaggtcagcgaaaatcactattttggcgtgcgggtggcgcaccctgcacgcaaaattaaaaaaccgaaaaaaattaaatccaaaaaatacgaaaccctaaccttagaagccgacaccgacgccctcgtcgtcgctgtcgccggattggccggcaccgccacacctccccacagaacgccggccaccgcgccagcccgcgcgcgagcctgcccgtcagccgccaccgacgagccggacgtccctgccgccggatccacgctaatcctggcggaggacggcccccgccgccaaatccgggcgggggcctccgtctccaccggatccaggttgggaccggtcaccatcaccttccacatgcggccaccgtcgcgcgcctgccaccgcgcgcatgccgtctgctgagatgctctcgagcccgccgccatgcctgctccagaggcagtggcaccgagccggccacctcccaccctccccccccgcgctcgatcggaggagaggagaggagagcacacgaagagaggagagaaagagagagaggagtgaaaataaaaggaaaggaagagagaggaggtgaaaattttgaagcgagtgagagggaaaagagagagaggggtatttttgcgtgtggcctacttaagaggttcgcctgcaaaaataggctcatttgtgcgtgtggtgaacttaagaggtccgcacgcggaaatcgattattctgtgcggtcctcttaagaaaccgcacacaaaaatagaggatgatttttgcagacgcgaccagttatgatccatatgcaatctaaagaggtcattgtatagaaaactcgtttatttgaagtagtgatctgtagactgctttggagtgcgggagtaggatgttcatcagtaccaatttttatttctcataagtttgagaaatttgtagcgtttcaaaggaggccagatgtacaattgaatctatctacaaaacttttaaagctttctacaaaacttttagggcgccaaaagaattgtggatttatttaatttactgaactttaaccatgacaatggctagcattcttcagttgactctgcatatcccaccatatctatccagcacatgcaacttctgaatgccgaggacacgtggcaacgcacacatggtagagtacacactaattagccagctggtcttatatatagaatgtcttcccatccagtgacagacatataactgactatacataactaactagctagctgagaccatctatcaaccccataaacagatccaaactaaatcatgaagaattcagcacaagatcacattgcaataggtgacaaaagaccagatgatgggaggcacatggctgatggctgtcatattacatggctaggacaagccatgtggctctgttgattaggattaataaggacaacagaaacttatgagtactctagctaccttgtaatcattttatttcaaatattctttgtgtgtgaacagcaaataaaatttgtatggactatcttgggtgtactgtactccgatactttcatgattagctaattcataaactcatatcatgtactacagtaaatcaaatattggctttcgaattgtaactgaaggctatgttgaaattttttgaaattgagagaacaccctgtaaccccttctcctctcactccctttatcttcaccccatatatttatattgttctgcttcttttaaatattctgtctttttttattacaatacaaacagcaggggctccctgctgtgtttctctaaaaaaaaaattgagcatatatcaatatactactaactaggtgacaaaattaagcgcatgctttaataaaacattggcaatatatttacatatacttccctggtaaatacaagaaaatgtctatatttggttcacaaatggttctcacgtggtttatttttctttctgcaactctagtgttggatatataattaatgtgttctctaatctattaaaatcatctactccctccttgctataatataagggattatattttattttaaaagttaaaaaaagcaaaaggacggggcatagtaaaggttatggtggtgaaataaagtagtagaaaacttgtaggtggaaggataaaccagtaagaaagtaatgggtaggaaggataaactagtaaaaaagtgatgggtacaataaaccagaaaactcgtaggttaagtattgtattggaattacaaaaactcttatattatgagataaatttgaagagtataatttattatattataggtgaaaagggagtctatatgtagcatagagctggttgtggttaagtgggtggttttcagtgatgtggctgctacatattcttaagcccactcatcatattagttttctaagcgacataagcgtagctaaactggttagatttcttattgtggaaccagttcacccgggttcaaatactagattttacacgggtactcgtatttatggctaattattctttcagtcatagacgatgtacacctcgacagcgaggcatccatggtgacttcgtcaatctcaaaatatactggtataatctttcggaggcgctcataggaataggatttacgtgtctacattcatatgggtgagtgtgcatgcgtcgtgggcgcttgcgtttatactgtgtttgtaaaaaataagattagctttctaaaatgcaacttaccccattctttttatcttattcattggattattgctgccgtgtgtgtctgcattcatatgggtgagtgtgcatgcatcacgtgttttaaagaaaatcagctttctaaaaatgcaatttaccccgttctttttagcttattcactggattatcgctgccgaggaggatttgttggtgtagtatgcttatcgcagcaaagcagataaggtttagcttctatgggtgtggtccaccaatacataccacacaagacacatacattgaagaacatggccggttgtctaacggcaagagcctcagtagggggccatgtatatgcattgcacttgttcctgacccaagatcatcaataattttgcattgatttggtcaaatctcctatggcatacctgagatgataattatggacgccgaatttcataaatatgtacataagacaggtcatctgatttgaaattaatggaaataattttgttttggcctagttagctttagtagtagtacatgccgataattaatttcaccgaaattaagttcacagtaaatggttcggttaacatatatatacaggaatcaggacagttggttcaattctgtcaaaatggaagcatatatctatggtggtttagtcgtggtcatgtaagactacgtactaccgaaattgttttcttaattaacgcatatatatatttatagccataatgaaaactacttcatccgttttcatccgtttcaggttataagatgttttaactttggttaaaatcaaactgctttaaatttgactaagtttagagacaaatatagtaatatttacattaccaaattagttttattaaattaataattaaatatatttttatactaaatttatcttaggtcaaaaatattactatttttttatagacttggttaaacttgaaatagtttgagtttgactaaagtcatcttgtaataacctgaaagagagggaggacgtactacagaaattgtcgagagaggtatcaaaagaagagctgtctctgctatatatgttcatgtatatattatgtacattactatagctcatttgttaggtgatctctggtacgatagtactgaataatgcatatgcccatgcatgggcttagaatggcacatgtatatatgctcgatcgtatactcacatggatgcttgaccagacaaaaacggtcatgatcaacaagacgtagagatagctgaacattcagcgatgatcaatgcatatctatagtcagcattattccctcttgttccttttgcatgactgccaaattaaaagagtattgcacatgtttaatttatttgaaattcctacacacatattaatgataatcaatggagaaacaaattaaagaaatctatctacttctaccaagtaatatactccctccgtctcaaaatataacaatatctagtactcaaaatttatacaaaaataacaacttctccacctatattctttttaaacaatcttccaccattcaaattccacacatattttctgatatccaccaatcacaacattcatacacatttaatttcacctattttttaagtacccgtattaactttagaaatctttatattttaggatggaggaagtaacaaattttggagtgagtaaaacttccaataataatacgtgtccacatgcttttttgtttttccttcaagtctgcaacaactatatcaggagtatcagctggagagctatagcaattcttgtcctgctccagatatctctgtttcaccacttccgattccagcttctgcaaattaatgcatctgatctcatccctgtttcacccaagcagagttagttggcatctctattatctggttatgttaattaagcaaagccaatcttttcacaaattgaaagatctttttgctcaatcgcgcgcctagatgcataatttggttaaaatgcttcttgcaggaactgtgttgctgaacggctcatacattttctaattgtattgtgtgtgtgtctatatatatatatatatatatatatatatatatatatatatatatatatatatatatatatatatataaacgaaaaagaggccatattcaatcaagcctgaaaaataggctattgaaaaatttactacttcaaaatttaaatacactaccttaaaatcctgagtcccactggtggaaaaaccctttgtagtcccggtttgtaaccccctttagtcccggtttccaaaccgggagtaccaatccgggactatagatcgctatctttagtcccgggtgaaataaccgggactaaagatcgatctttagtcccggttggtaacactaaccgggactaaagatggctcaaccacgtggccggctgagccatctactaaagatcgagctgaccctttttttttgcatggccctattgctgcatggtttatatatatatatatatatataaaccatgcatatatatgtttcaatacatatatatgcatacatatatatatattatatatatatatatatatgtataaatagttcagtacatatgtacatgcataatatatatgtatttatacataatatatatgttatgcaaatgcatatgtgtgtatatatatatatatatatatatgaccaaaatatatttacattatagaaaatgtgtacacatgcatatagaaacatatgtagtcatgtattaattacaatccattatatgtcctagctagctacgatttcgacgtagtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcgtgcgaataaactatatgaatgtatgaaattgattagtaattaaacaagaaatcgttacgtaataaaattttgaatttatttgtacttacatcgagctctcttgtggtgttgatttggtctgcaaggcagtggcaatactcacacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgtggaccaaatgacggaaccgataccaagccctacatggagtttaaagctatgatttgtagtagcaattaacataacaagattttcttaattaacagaggaacttatgacggtacctgtctataggttcgaaaaccttgtcaaacgtagactcttttttattcattgagtcatatacgttgacggtgcaggccgacaggtcgaagagtaaaagcacccagtggaatctgtaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctttgtttcttgtggatattggtcgagcattgcgacgtttactctccgagtgtcgatgaatccagtatcaaaaaccctccaccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcatagattcccttgaaattgatccagagaatgtcatctccttgcaagaactccgtgtccctgatcctcgctccgatcatctctctaccggtggcgctcatctccatgtacagctgatggaacttgtacatttgtgtgggtagggactgcagcagctcaagcttgacaagcggtttaccgagttcatacatgtatttctcttccgccttttcgattggtgcgactcctagcaattgatccgtagttagaccggtgtcagtaataaattgttctatcgtcatttctttaccagtcaccaacggctcgatctcctggtttggttgctctccaagctgagggactggtttggactttccagaagatgctttcttcagcgttcgctcatagtccgatagattgatggcctccttgacagatgcagacatacccctaaagaagttcctgacactggggtctataagaatcttcttttctggacttcgaggcttgaattgtctcttgacttctgatgcaacgtaagcgtcaagctcctcttgcgtgcaatcgtaccccgggtccttgttcttggcggcgtcaactttcgccttcttggtttcccttgtgtgggcaggcggtggagctgggggggcccttgactttgaaggtgccggaagaggagcttgcggaggagtaggtgtagaggcccgaggaggagtcggtgcaggatcctgaggaggagtcggtgctggcagatcatgaggaggagacggtgcaggatcctgaggaggagatggcggagccagaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttaggatggccatgcccgacgccaccttcatgttgtgagagattatttattagtaatcaacatatataagcagcaactagcggaatggctaaatctaaaatatataaactacgagcttacctttattgataagttcttgtaaggaatatgcagctcacatggtgtccgctgagtgatgtcatcaacgagacaggtcgattcgtcctgtgtttgcatggcgtccatgctctgtgatcttacctgccccgttgaggcgcagctgctacggtttcctaacgggctcaccattgcaggaggaatggtcggctggggatcatgggaccgatgtgcggccatgcgttcatcaaccttccttgccccctcctcttgcatgctgagttcgtagctcgatacccggaactctagatctgcaatcttcgcctcggtatctctcttactcctcatccgactcctgtacgtgtggatgtcctccttgaaaccaatcttccaaggaatcacccctttccctcgtgttcgtcctgaatgctctggagtctgcagggcgagtgtcagctcgtccctatctctgtccggtcggaacgtgccctgagaggaggcttccactgcatctgttagtcgtcgtgcagcctctcgtatctgatcaccgaagaccagtgagccatcagctgggttgagcgttccaccgtgagcatagtaccagaacttcgatcgttccggccaattggcggttgcctgttcgatacccctctcaatcaagctagcctccatctcctcccacttcggcatcgcgacgctatagcctcctgaccccaagtggtgatggtacttcttcttggcggcattttctttgtttctttccatcatcgcctacccttgttcacctgtcttatatgcaacgaactcgtcccagtgatcccttagctttgggaatgtgtcaaagttcggtgtctgccccttcaggatatatttcttgtacagctctcccttgaagctctgaaactgttctgccattttcttcagagtccaccttatcactttgtcctctgtacccgcgggaagggtgaatgtctcgagcattgtggtccacagcatctctttctccgaatctgggacaaagctctcatgatctccgcatgcccttgttcttcgccagtacaccgtactgacaggcacgttatcccgcacaacccaaccgctgtgacgtacatagttcttcgtggcttcggccggggcactaggacgtccatcttcttccacttccgttatgatgtgccgaccctcaagcttcttcgctgcacctcgttgcccgcgtgccctcttctgtccaacagagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtattgtataatatctgttcctcatcgcggtcagccatctgttgatactagaaacatctggtaagtcacgagacatttatgttttaacaatttaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgttccgtgcgtatatgctaagtctaattaagactacaatagtcaattgctaggagtcgcaccaattccgtactcaataattacatactaattctaattacaaataaagtaatcttatattaaaactcaaataatattacatgctaagactgaaagagtcatgtatactaagtgtaactgtcgtatatgctaagtctaattaagactaaaattgtaaattgctaggagtcgcaccaattccgtagtcaataattatatactaagtctaattacaaataaaataatcttatattaaaactcaaataatattacatgctaagactaaaatagtcatgtatgctaagtgtttcatgcgtatatgctaagtctaattaagactacaatagtcaattgctaggagtcgcaccaattccgtagtcaaaaattacatactaagtctaatttgcaataaaataatcttatattaaaactcaaataatattagaacactacacaatcttatatgctaagtataattacaagtctaatattcttaattgcattacaaatataacaatcatttatattattacgtcacttgcctgcacgaattccttctagggctagctcttccactcccagcttgagggacgactccgacaacacgtcttttctgcaagatacaaaaaatatgtattaggataaatgcaaagtaacatatatatattgcatttcacattcacgttcgttcgctcgttttcattcacgttcgttctcgttcacgttcgttgtcattctcgtcacgttaattcgttcgatcgttctcgttgtcgctctcgttcgttcgatcgttctcgttctcgttcacgttctcgcggcaacgtacgttaacgtgttcgttctcgttcatgtgttcgttaacggcggtgtgacggcatcgggccggcgcttggcatggcggcgtggtggcgacggcggcggcggcggcggtggcggcttggcgacggcggtggcagcgcggtgttgcatgccgcggcggcattgcgcggcggcgaagatgcggcatggcgtggcggcggtggcgttgcgcgcgcggcggcgaagtcggtggcgtggcgtgccagcgcctgcgtggcgtggcgtcggcgtggcgcggcgtcgtcgtggcgcggcgtctcgtggcgagcggcgcgacggagagagagatagagatcggagatcgatgaagggagaggcggcggcggctctcaccccagagatgcggcggcagcggaggagacggaggtggcggcgaggacgacgagctcgagacgacgtcgagatacggcggcgtcggcgcggggatttgccctaggcagtggcggcgaaaggagagaggccgagagagatcgatcggccgaaaatgttaactgttggtggagaagatgagggcgcgcatcaggaatatatatagccctcgatctttagtcccggttgatgagaacatccgggagtaaagatatctttactcccggttgttcccgctattttcaaattctttttaaacctggttagggttaagaaccgggactaaagattatagcactgcatattattttcgcttacatatgtgtttctaaaatagaagttaatgcattaacattatttaaagtacaaagattaatgtcaattacttcgaacaattatttttgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaatcttcatatatacttagcgtaggaattatattaaattaaatgttaaaaagtctaattaacatatgtaaatgccacatgcatgatttaaaccttttaaaaattcgaatagtcatatataagtagcatatgaaagatagtaaattaaattgtgaaaaactctaattagcatatgaatgatagtaaattatgccatacatcaattgatttatatggataatcaatacatccaaaatagtttacatcgtgtacacaataattacggcattacattggcggtgacggttgaccgcacgtactttctcctcactattgttccctccttgtgatcgctgcatgagtaaggggtgtcttcatttgataggaggatgctagggtcaatcgtcaccgtgaaagggggttgcccatccaactgatcgtaatcctcgtcagtcttgtcctcaactccgatgatttttcttttgcctgggagaaccacttggcgcttaggctcgtcaggccctctgcccttctttcctttgctagacatgtccttcacgaaaaagacttgcgttacatcattggcaaggacaaaaggttcgtccgagtatccaatcttgttaaggtcaacagttgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgattgacccagacggtcccctcgccaggaaggcaagttgttggttgatcgactcgttacccatgagatgttgtcgtagccacgtggggaaagtatcaatctgatgccgtgtaatccatgcatcggacttaccgatgttcctggcgcgaactagagccaagtgctcctcgatgcaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggttttcgataaattctacgcaaaattcgatgacctcctctgtttcataacccttggcgatgcttgcctctggacgagcatggttacgaacatacttcttcagaacgcccatgtacctctcgaaaggaaacatgttgtgtaggtacacaggcccgagaatacagatctctttcacaaggtgacaaagcagatgcgtcattatattgaaaaatgaaggtggaaatatcaactcaaaactgacgagacattgcaccacttcattctgaagggcttctaatctatccggatcgatgaccttctacgaaattgcgttcatgaatgcacatagctttgttattgttgcccggacattgtctggaaggataccccttattacagctgttagcagttgtgtcatcaacacgtgacagtcatgagcgtacgtccaagaattcccaatatggtaactcccaaaatatagagttctttttccacatcgccgcgtgaccatcttcgctctctataggctggcttccaagcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttcttttttccacaactgtttaagatcttcgaccagtggtcttaggtacacatcgatgtcgttaccaggttgcttggggccttgaataataatcggcatcattatgtacttcctcttcatgcatagccaggggggaggttgtagatacacatcgtaccaggccaagtgctatggccgctgttcatctctccaaaaggattcatgccatccgtactcaaaccaaccggtatgtttcgtgcgtcctttccaaattctttaaattttctgtcgatgtttcgccactgcaaaccatcggcggggtgtctcagcatcccgtcctgttgacacttttcagcgtgccatcgcaacattaaagcattccccttgttcatgaacaaaggccttagccgtggtattatagggaaattccccatcaccttagcaggaattctcttctttggtagctgcccgtcaacttctcctggatcgtctcgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaattttcttgatgagtttcaataaatcgccaaatgccttgtcactaaccccaatttttgccttccattgcaagaactccaaaatggtatccaactttttgtgcccctgctcccagcctggatacaacgaaattctgtgatcctccaacatcttgtccaatttatgggcctccttttcactttcgcagtcctccctggcgtcctgcaacatctgaccaagatcatccgcaacgtcgttaccatcagcagctatttcctcctcgcccgtttgattttcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaataatcctggatgtagaatactccttctgattcttacacttattgcatggacaacaaataaaacccctttgcctgttcgcttcggccactctcaaaaaatactgcatgccgtcaataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacaccaaataattcttaaaaactatttttaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaattaaattttggagacaaaaaaaagtgtgaaaaacataggtgcaaatgtagtatgacaaaaaaaacattggaggaataagttgcaaaccttttaggcacctccgatttgtatgtaatcaccaaaataaattcaatagaatttttggcatgacctcccctcttttttgaagaaattttgaagcttgctcgggcagctggaggaggaagaagacatatatataggggtgggacttttgtcccggttagtagcaccaaccggggctaaagatcaccaggatctttagccccggttggtaataccaactagggctaaagttacgatctttagtcccggaccgggactaaagatcccgggggggcctaacatgccctaacagcattcgaaccgggactaaagatgatctttagtcccggttggtgttaccaaccaggactaaagatcaaatatgcccgttacccttttgaaccgggactaaagatcatctttaaccctggtttttattgcatccgggactattgtggaaatcggccgaccgacgaaagatggtttctccaccagtgtccgcaccatgtaacacgtagcaaaatcaccactgcgcacaggttaattaatttcttggcaactagcttctcaattcgaaggcgaaatgagccatctatatatgagacgatgacggcatacaatgtatttaagtgtttattaggtttcggtgcatggaaagctatcaaattgaatcagttcttaatgtccatcaattgatttttttttcgataatggaatactccatcaattgagttattagttcatagaaaacatacaaaacgacgtacgtcgtcggcatnnnnnnnnnnnnnnnnnnnnnnnnnnnnnnnnnnnnnnnnnnnnnnnn

SEQ ID NO: 35628 - DNA, 3977 bp, Oryza sativa
cacgtagcaaaatcaccactgcgcacaggttaattaatttcttggcaactagcttctcaattcgaaggcgaaatgagccatctatatatgagacgatgacggcatacaatgtatttaagtgtttattaggtttcggtgcatggaaagctatcaaattgaatcagttcttaatgtccatcaattgatttttttttcgataatggaatactccatcaattgagttattagttcatagttttcatacaaaacgacgtacgtcgtcggcatgtaacctttatgagtgaaaatatggtattatgtacgtcatgaaacatatttccatgttgtttcttagtgcttcatgtgaatacaaacaatcaaatatatgcattaaaaattgtatcgatatcaccctaaagaacaaacaaaaaagaataatttgaagctgattttaattaaattctaaattttgattttataattaatttacagggccggattttcttggtcgcattcatcgcaaactcttttcatgatcgttgctaattaagatgataactaaaaaccaatctaaaatatatcgttcttaaaatccattctaaatttattaggctatagtcctaagttgtgctagctagtcagcaagttcatgcacttcactgccagttagctaattagctggatgcattgcaggcaggcaggcatgaattggcatgttgccgacaacggcaatgtatcgacggcattccacatcacacatttgatcagctcccgccactaattaaattaagctactaatagctgcatgcatgcacagtaaatgttcatgttgaacctaacacagtcaagtactgcacgtccatctgaaatggacatatcataaggtacaatttaatgatcatgcatgcatgcatgtaccctgtgtactggctcctcctgagtctgcggcaatatatgcatacatggaatgacagagaattgacctcgagaaaaatggggtgatatacagggaagcagaccacaagggatgttaattagtaagatgaatgtcgacacaatatgtacttgaaattagagcagtctcaagtgcaagatactagtaccaattactccactagagaaatggtcatctgtgtaagttacagtccaacaagaacatgacggttcagtcacccgttgcagtcaattgatcacgtactgatgatgactagtcgcatctctgactgttcatatctattgaaccatcgaaggttgtgtttagttcagcgcaaagtttggattttggttgaaattaaagatgatgtgactgaaaagttgtgtgtgtatgacaggttgatgtgatggaaaatgactgaagtttggatccaaactttggatctaaacacagccaaaatgtagtaaaaacaaatataataattaaataacttgcacgggaccagtgctcgtcatggttgtcgtcaatcgtcacccgcctcgtccaagtagccattgccacggagaggcgaaacggctacagtgcatccacgaccgacccctcaagtgccttctaccacgctatttcattccacctccaaaaaaaactgagccattgagcatccaactcaggtacagggaacaacaacttaaggtgtgtttggttgggtggataaatctggatgggagatggttctcatcgtcgtcgcactgcttcatgctgctactccacctccttgtgcctatcaccatacccgtctcagtcacaaaggattactcacaaagaggggaagccgttgagccacctagctagatccaggcgtcgtgaggtcatgggtagttagatcaggtgaccctgatcttggggaagatctgacacccctcgaggctactgcgatcgtatctagagggagcatgagctccacaggggggtggcggtgatggtgcttaggaggtggagggggaggcaccggtcgtcctttgtagagcgagaaagatgtgtcgccaaaagcctggaggggaggcactagattcacctacccagagttagggcaactggatctggtgtctctagcatcctgtgtcccctcatcatgttgtcgagaggctcacactattgcgagctacgtggaggacccgagcttcttgttgggccttatgtcgagccttgcatcatcggacggatgaaccacctggccctcgtgtcatcgcacctttgtgtggtctccactctctcgattgaggtggagaggataagggggtgaaagataggagctgagaagacgaccgagtcttctatcaagaggagccatgtaccctagagtctgggatacaaccaaattatggttatccactactacagaattgattttttctggatgatatcccctttagattgcatgtggaccataactgctcccgcctgcaaaaatcgctccatcatgatcagttcaaggcatgcggccacttaagagacctgcttaggaaaatagtcttattttcccaggtaggcctcttaaatgaccgcatactgaagtacaacttcgcaaacggacttcttaaaagtctgacctccctcctctcttttctcttagcatcttcaaaatttttcaagtctttatccttatctcctaccttctctctctcacctctcatttctccacaacctcctctttctctccccgctcatttcccccccccctctctcccacttcctccaaatgcagcccagcatcaagagcaccagctggcccgggtgcgagacagccatggggagcggcggagcaaactcgacgggtccccatgagcaggacgcaacaagggagccgcgaggcatggagcaaggctccagttaccaggtgaccactagccatgactcaggtaggcgacggtgacgacggcagcagtagggagctcgtggtgggagcgacgccagcgagcggatccgccgtcattgccctctggagcaacaccggcatgcagatttgacagcctccatcctcaggaatagcggcggtgggattaggaggcgggagcaagcaggcatgacgacggtggcaatggcggtgacgacgttagtggcagttctgacgacgatgacaagctagggtttcggtgtttttttgggatttttatttttttccaccaaaattattttttttcacgcggtcggtataggtgaccgcatgcgaaaatcctgtttttcatgtgattaggctgcccgcatggaacaatattaattttcacatacacctaggtgcaggcgggccgtctagctacatgtagaaaccggttttggctgtcttgaaaaatgatttttgtactagcgatctatataatgattttggaacatagacccatcatgtagatgatgcaaatcatcgatctataacggttcatgaagaatgccgacccatttgaaatgactaatcacctgtaatatggtttatacttacgaggccttaagatgtggtgcatgataataagggagatacattttttaaactgtacgtaatgaactaccctaaccatgtgtctagaacgaatatgtgcatcacactggtgattaattagtcatcttgatcaacttttagcaaagcacaaatttatataaagtacactcctgtgctaactaaatatagcatattatcgtgcatgttactgtcgctacatgtgcatatatgcatgtacagcactagctaggaagaaatttatgaatttcaacttaatgattggcagcaggtacgcttgggcacatgagaattaatcatgaattggtcctattaaattaatttcgttgtgtggtcgtttggaggtctatgtcacaaatctaatttggaagtaagtcgacacatggattcaagggactctcccaaagaaagcgagatttcctttggaatatatatcatatgacatgcatggattatcaaaattaattatgggtttattgaatttattgacaagagcctatattgtccctctagttcgaccttccactgtcctttctctctcaagcaagtaggatc

SEQ ID NO: 35629 - DNA, 2185 bp, Oryza sativa
cgggcataaatagaagcccgacacccataagagtcatcggtgacgggctccaaagaaggcccgattgagatggccttaatgcccgtcaccgatgactcttataggtgtcgggcttctatttatgcccgttagagattagtgtgcgcccgttagagatgacatttttttttggcccgattgagatatactttgcacactatatatactccagcagtccgttgtctgtagtttatcccgctcttcactattttggtgggaggtttaagggggcgaatttttgtattttttttgcaaccaaaaacaggaaagtcataaaagtaagtaaaagagtactaaacatttcctattaatttagtagtacttatgttatgagatgttaactaatattttgttcattgttcagtgatggatagaagttggatgtacacgactggcttgaggtgtcagtacaaagagtatagagatggcgtattaagttttatgaaagccgcagaggaggataggataagaagaaccgacaagtacatgtgttgtccatgtagcgattgcaggaaagagattttgtgggaagatgaaaaggaagtacacgctcacttgatacgccggggattcatggagagatacacatgttgggtgatgcatggagagcaagatctgggtactgatggtgcagctgcagacggaagtggtgcagacagtcatgaagaaggagatgaagaagagcatgacatgtttgtcccatctccattgggcggtgaaatggttgatgtggaccgtgatatgctgcaagacatgttacgtgacgttgatgacccagctatgaatgagagagattccatgaagttcagcaggttggtcagtgactcggagactcctctatacgcaggatgcaagccaaagcacaccaaattatcagcaacattagacctaatgaagttgaaggctagtagtggatggtcagacgagttttacagaacttttgggaatactgaaggacatgcttccttacttaggagaacacattgcccgagacgacatattgcatattgtaccacaagcaatacgcggacttagatgcttgtcctgtctgcaaggcttctcgatacaagcgaaagaagagcgcaggcgagggaaagaagttaaagcggggtggtccggcgaaggttgtgtggtatctaccaatcattgatcgtttcaagagaatatttgccaaccccaatgaagcaaagttagtacgttggcatgccacagagagaaggaatgacggtttgctaagacaccctgcggattcgattcaatggaggaatatcgatcgaaagcacaaagactttgctgccgaccccagaaacatgaggatatgtttgtgtacagatggcatgaatcctttcagagacatgagtagttctcacagcacttggccagttctcattgcgaactttaacctcccgccatggttgtgcttaaaagaaaatatattatgttgtgcttgttaatccaaggtccgagacaacccggcaatgacatcgatgtgttcttggagcctgttatcgatgaccttgagattctgtggaaagagagtgtggaaacttgggatgcatatggtcaggagaatttcacactacgagttctattattctgcaccattaatgattatcccgcgctgggtaatctttctggacaaaccgtgaaaggaaagaaggcatgctctgactgtatggaacatacacgcagtaggtggctgaagaaatcaagaaaaatggtttacatgggtcataggagatggctccccctacggcacgtctttagaagaaagaagaaaattttcaatggtaagaaagaacttgggtctgcccctgcagatttgtctagagatcaggtacacgatatggtgaaggacattactaatgagtttgggaagaaaagaaaacgtagcagggaggacaagaagaggatgtggaagaaaaaatccatattttggcggctaccttattgggaagatcttgaggtccgtcattgcattgatctgatgcacgtagagaagaatgtgtgcgatagcttgctggggctattgttaatatgcctggcaagacaaaggatgggttgaatgtgcgtctcgatctacaggagatgaacattcgcagtgaacttcagcctgttacagatgagaagacgggaagagtgtacc

SEQ ID NO: 35630 - DNA, 458 bp, Oryza sativa
cttgcttgtaatggttaggatgaagcctggcatatatctgaccggaaccaatgtgccatctctaggagctaacacgccggctccggctagggacgagtgcttggaggctctcgtcctaacgggatggggcgaggcgtgcgtcagaccgcctgtcgccacctaacccacgatttgactggtctgtgactgatcacagaccggataaacgagcgcgctgcactgcgttacatgcggcgtgacgcgctcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgacccccccccccccgagagggttaggccacgtgggtgatc

SEQ ID NO: 35631 - DNA, 684 bp, Oryza sativa
  unsure (1)..(684): unsure at all n locations
nnnnnnnnnnnnnnnnnnnnnnnnnnnnnnnnnnnnnnnnnnnnnnnnnnnnnnctttttatgtgcatcataataattcccaagaattattgaatcgtgttaaaaaggattttaacagcattgggccacaccattgtgaacacaaatcgccaaagcaaaaagtgcctaagtccctagggatcacaacaggccacgctgattatagtattgggctgaagtactgtacaggcccaggcccattagtactcccgataccctaataataccgaagtgaaactcgtctcttcgtcttccccgccgagactctcgccattttccccatttcctgctacagtgcaaaactgcgccggccaaactagggttcatcaatccgctccaatccctcctcaaaatcttcacgaaatttctccccgtatccaccgctcaaattccccatccctttccagccgtatctcgaactaaatcagaccatccagttcacattcatggcggaagaaagagaaagcttcaagagtcagtgggcgccctccgatgtgacggaagacaatctgaaggagatggtggcgcacggcgttctttcaagcaaaagagatcatcgggtggcaaccggcatttggtgaggcattttcaacacccgatacacacgaaaatcgtggtatttgctcatttcttctacggcggatt

SEQ ID NO: 35632 - DNA, 705 bp, Oryza sativa
agcgcacgctcatctgaatggttagaagacatgaaagatgaaatgaaatcaatgaaactaaccgatgtctgggatttagaagagattcctaaaggagccaaaacattaggctgtaaatgggtctacaaaaccaaatatgactccagagggaatattgaaaagtttaaagcgcgacttgtggcaaaaggcttcacgcaaagagaagggattgattacaatgagacattttctccagtctcttgtaaagattccttcaggataataatggcactggtggcacattatgatttggaattacattagatggatgtaaaaacggtatttctaaatggagatttggaggaaaaagtatacatggcacaactgaaaggttttgtcgtgaaaggaaacgataatatggggtgtcgtctaaagagatgcatttatggattaaagtaagcttcgagacagtggtacttgaagtttgatgggacaataaagaaatttgggtttcaagagaatattgaggacaattgtatttatacaaagtttaagaatgggaaattcattttcctaattctgtatgtagatgacattctactggctagtagtgatatcattctactagctagtagtgatgtcagtctactgcaggaaacaaagaaattcttgtcctcaaactttgacatgaaagacctcggtgaggcttcatatgttttgggcata

SEQ ID NO: 35633 - DNA, 1386 bp, Oryza sativa
atttataattatctccgcccgatttaaaattgctatcacatttgatttatcacatataataaccaaatgtttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagccacttcgtcttcgggatcatcgtcaaggtcgatctgaggtctgacataaagattcttgttgtattcttcttcatcgacaacgttgtccacccccacaattcttcgcttgccatccctaacgacgtgcatcttcttttttgcggggtcttttatgtagaaaatctgttcgacctgcttcgctagtacgaatggttcgtctgcgtatccaaccttggccaggtccactaatgtgaagccttccttgtcgaccatgacacctgtgcggatattcacccaactgcaacgaaacaaagggactttgaagttcagatagtgcagctcccatatctgctctatgcggccatagtatgtgctcgatccaacctgatcctgatatgcatctatacggactccactgttttgcactgtgcttttctcatcttgtgtgacggtgtaaaatgtgtatccattgatatcgtacccttgccatgtgtcaacatcccaagatggaccccttgccaacctttgtaatatctcacttgggccatcggtcgaccgtgctacacgatccttgaaccattcgttgaagcgagcaccatgttctctgttgatcaaaatatctgatggaccaatattgtcctgtcggaccttcgctaaatgctcctcaaagtatggggttacttcagccatatgttgcagcactgcaaaatgagcctgcgcgtaggaagcttgatcgggaacaattctttttctgtcagttgtgccgacacctgccaacctttcttcgtggcgagacgtaggaacttcgataggatcagtctcggccatgtaatcgatacaaaactcaatggcttcctcggtcgtgtaaccttcaatgatgctcccctctggttttgctctgttccgaacgtaggacttcagaattcccatgtacctctcgaatggccacatttctctcataaaagctggcccacatatttttgtttgctttcagtaggtgaacagtgagatgaaccatgatatcgaagaaa

SEQ ID NO: 35634 - DNA, 588 bp, Oryza sativa
atcggcatcggctcgaagataaatgatatgccatcggcaactagccgatcggctatcgtatatggatttaaccgggggtttcttgtctttctttcttgtgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaattaatcatgtgctaatgagttgtttcattttgcgtgctagggagattagctcccaaccccatggaaggaacataggcggttcattttacttttagaactgtagatctaatttaattatcatgaagttacgttggatgataaaatctatattattattattattattattattattattattattattattattattattattattattattattattattattattattatta

SEQ ID NO: 35635 - DNA, 483 bp, Oryza sativa
cagttccgcgagaggacagctcttgcagtcccggcatcccgccgagctccggcggaatgctcccggacaacctgttgcccgtcaggttcagcctcctgagccctttcagcccactcagagatggcgggatgcttccgacgaacacgttgcgggccaaatcaaggaactccaagctctggcagctctccagctcggtcggcacctcgccggagaagcggttccccgacaacgccatgaacgcgagcttcgtgagctggccgacgtcgggagggatcgggccgtccagctggttgtccgacaagtccatcagcagcgacagcgacgagagggtgaacagctcactcgggacatggtcggtgagctcgttgccggagaggttaagcagtgtcagctgatgcagattgccaaggctgggaggaatcgatccgttcagcgagttgccgctcaggtcgagcttgagcagctgcgtgaggtcgccaatgg

SEQ ID NO: 35636 - DNA, 465 bp, Oryza sativa
gttcataatatccgatattatggtacagataagtatataaggaagtggtctttttttttctccacattaaaccgatttatagcaaccgtcggatcgagggcaaaaataataataaaaaaactaattggaccagcaaatcttgcaggaaataaaatccccaactcgtgggggctccatgtcgtcgtcttcctcctcgtcccatcatcacctggtggcgccgccatggtcgggcacgggcagcttcgcctgctaccatggcgaggaggggaaccgccctcaccccgacgagagcgcaaagatcatctcgtcgatcaagaggttgtacagcgagacggctcggcggctgccgatcaacgagatcccggagctcgtcggctgcatcttcgagggcggccactgcctaggcctcgccgaccccgtcggcaacatcatccacaacgccatcgcccaccacgcctccggcag

SEQ ID NO: 35637 - DNA, 483 bp, Oryza sativa
cttggtacacaaacagtaggggctcatgccttaaccattctttgttgcgtagggagtacttgtgtttggtaactaatagccaaagcatcacaaatgacaaaccagaacttgacagaaaattggcctttttaaccagcacctgacaaccagccaattttctgttacagcacaaagtacactgttacagcacttgacaaaaaacggtgggcctgatcggaactgctggctgctgcagccgtcacgactgtggccgttttcagctgctgctgtagctgatttttagctctcgcagccgcagcggcggcagcagcaagcgctaccgatctctcttagtgtttgacatttccgacctctttaaaaataaatattttttatacaattttataaagctacttaaaatctgcaaaatttttacaatccaaaagaaccatttttttatgctactgctatttacattgaggtgttgctttgttggcaaatggc

SEQ ID NO: 35638 - DNA, 1121 bp, Oryza sativa
tctgaatatgcagagtacatccattttctgtcagtacagcacactagataaatcaagagatcagagctcctgaattccatggattttacattttcattttttttactccacaacagcttgctcgaagcctcgaatagtgatagaattcgatgccgatgacgtagtaataattatccatcgactaattcggctgtcaaagttctacaaataatcagtatactgtcctacttatttaccacaagcacgaaggcaagcgtctctgatgaggcgcatctcgtcggcggcgacgctcatggccatcctctcgtagggagctcgccgggagcagctgagcccgaccctaatggcggatgccaagcaatcgcgcaccgtgacgcgcgcctcgctctcctcctccgacgtcgtcgacgacgctgctccgtcgagctcctcggcctgcagcagcagggccacgtcgaggatctcctcgatgttgtccgggaacgcgccggcgacgaactccggcagcgtcaggccgtcgcggagctcgccgtccgtcggcgccttcccggagaagatctcgaggagggttatcccgaagctgtacacgtcgccggaggccgtgaccatccccgtcgtgccgtactccggcgcgacgtacccaatcgtgccgcgtatgccgatggtgctctcggtgttcgccgccgcggcgccatggctggccggatcaagaaggagcttggcgaggccgaagtcgccgatgcaggccgtcatgtcctcgccgaggagaacgttgctcggcttgagatcgcagtggatgatcggagggttgcagctgttgtggaggtagttgagcgcgtctgcgatgtcgacggcgacgtcgagcctctggatcacgcccaggccgccggcaccgccgcaccatttcccggtcttcgtatgctttgcacgatgcagccacctatcgaggctgtagttgggcatgaagtcgaacaccagagctctgaactcgttgccctccatgtcgatgctggagcagcaagtgacgatgttgatcaggttacggtgcttgacgctgtgcatcgcctcgcattccgccatgaacgtcttggaagctccgacttgccggaggtcgagcacct

SEQ ID NO: 35639 - DNA, 558 bp, Oryza sativa
tgaccacttgctacgcgagagaaagcagacgtcgcggccagaaaccaagtcaaacgaactgaaatttttgaaaatatttggattgttttgaccctgataacacccggctggagctgctcagctcggtctttgcttgctggcggcctaaattccatcaattcgtcccaggacaactggatcgacgggttgacttttcaatggaacacttgtatcaacctggtcgacaggatgtcgttactctactttttcatcaatcatctggtgacaattgactttttgtgtgagtgacagggtgcttgacctggtcgtagcccatagtaggccaactcagaatttttagtgggcttggttggacaagtgggccaaaagttgtagccctatataactaaaacggcccactagttagagccaaacccaatgcaggcaggaggcagccctcccctgaaccaaacatccgagatttttttttaataagttcactttaactcccttaactactcatcgaatctgattcgtattcttaaaccgaccagatatattgtgatgaactactgtacc

SEQ ID NO: 35640 - DNA, 680 bp, Oryza sativa
ctatagggcgaattcgagctcggtacccaattctctcttccactacaaaagagctggtttgccgcacagtttggaagtcagggacaatccgccgatacccatcatttttggacagactaaaactatcatagtaatgtttcatctcagtaaacctctgtacaaccttccttgctctatcagccaactcacttggaactggaactacgccaggtttaatgcggtagtgctcgtcatttaccttcagaataaaacatatattagctaagaaggagatttactaatttaacactaatttctacatgcattttcccatttttcaagacaaaatcatacagacaacttacggtttgtttacacaagttttagattggaacgatcaatgtttttgcagttatatatactaaacagtaaatttagttacttttctgagaggaaagtagtaaactaaataattagtttttcatgtacacacacagatatataaataatcattacatatggactgcattgatgaaataatgactatggttgtgtttagttctctccaaactttcaacttttccgtcacatcaaatgtttggacacatgcatggagcattaaatatggatgaaaaaaaaatcaattgcactgttgcatgtaaattgcgagacgaatcttttgagcgtaattacgctatgat

SEQ ID NO: 35641 - DNA, 395 bp, Oryza sativa
acctcgtcgccgtcgttcgccgcgcgcgtcacacccgccaagcgtatggacagcttcgcctccatggtttgggaatcgaacgtcaggtcggagatgtacccgagttgaggagagtcgatgcggattgcgtctgcagcgatcgtgattagggcaacacggccatcttccccgatggtggttcgaagcgtcaccgtgccatcttggccgccagcgaggccgtacggacggtacaagaagtctatgttgacctgcggccattgatgacctagcaagttcttgatgtccatgacgtcaccggcggtgagcagctcgcttccttgcagttaggccatgataggggagagctgaccggcggggaactgcgccgtcatgaggcgcgccagctcgtcgagcgc

SEQ ID NO: 35642 - DNA, 567 bp, Oryza sativa
actctggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataacccttcagtaccgcaggatacccagtatagtgaagccctaatttcacagtacctttcagatagcgcattactcgctcaagcgcacgccagtgatcatctcccggattagaggtaaatcggctcaacttgcttacagcaaaagagatatcaggcctagttgcactagccaggtacatcaacgagccaatgatttgggagtattctagttgattc

SEQ ID NO: 35643 - DNA, 660 bp, Oryza sativa
gttcatcacatcagcaaaagcctgccatacaaatgatcaaacagtagagttagtaaatatgcgcaatttgttaccaacaattgatgcttgaaggccaaacaaagttagtcctaatacagtatgaagactaaaatattgctttagaaattctgaagtttaccatacacagtatgataacccagaaaatagtaagaacaaaattccagaaggtgagaaaataaagatacaaacaacttaaaaaacacatactgcagaagaaaggtccaatcaaccagcaaagggagaattataagtaaccttgatacattggtgaatgcggaaacagttcctgcccacattattggcagggcaaagaggatcatcaatgtgtattggatcaatgctgcaaatcaagcatatggaaaaattacagaaggcaatagttgacagaaacagataaactgatacattgatatttaattttatcacctgtgacctctttctcggttcaaataaatgccactttcttggatagagatacgcatatggcgcggatcaaatacattcctgatatccagattactcactaattaaattccatcttagatgataattatattactactccaaaacgattgcaatttgcacaggataaatcgcatatgagccctatagtctttg

SEQ ID NO: 35644 - DNA, 636 bp, Oryza sativa
  unsure (1)..(636): unsure at all n locations
nnnnnnnnnnnnnnnnnnnnnnnnnnnnnnnnnnnnnnnnnnnnnnnnnnnnnnnnnaactaatacttgatgaagtacctctgtggttaccagatagagcacatcgctcaccgtgaagtgaagaacagttgttatggttggctctttgttacttggcatttcatcgaacacttgttgagcgtcagtgtaggtggttgctcctaggcttgaaacagcaccaacagaagcctgttaggtagagggggctagctagggagggcgataccttgttgaggatgtgatccacagcagcgctcaattcatcaaccttcgccttaaacctcgccatgaatgccttctgcttatgcagctcaacggactccaccattgatgcttccattgggtaaggtttccactatcttcctcgtctctctacagatcgaaccttaggctagaatcacggtgcgtaaaacaccaacccttcccttgggtctaccaatcaagcagcaagagaaccgatcagaacagctctgataccaaattgttatgacccgagctcgtgagagatcgaatcacacaaactagcagcagaatacactgataacttaagataatttgagaagaaaatgcgggatcgggtgaagaacagaaaggggg

SEQ ID NO: 35645 - DNA, 1254 bp, Oryza sativa
aatatctacagttatgaccaaatggagagggcgaaaaccttttatatttatgaacagagggaatacgtactatatatggtgttgtgtccatgtttttccaatcagatctaaatactacgacgatgattatagtagaggtgatatgatagtcactctaattttgttcacatcatttacacattattactcagtagatataagataatatacacagtacacaccaccagcacacttgctctaatagtccacaatctgagttatattatttgttttgttcttaatccatttgtctatatatttcttcactcattattgccttgcatctcctctctcctctgttgccttatcggcttgtcttgtgagcttacatggtatcctaaggccaggacgacttagaggcctacttgctctacaagaggacaggtcttaaaaaatgacggcaatttgtagctcttgagtcgtgtgctcgttagtgcgagcgttcatagtggccttcctttcaggcttaattattttgttgtcgctgtattatatgtaaactttgtttctttatcaaggaacgctttcttaaagtcttaaaagaaatgcttttctaaagtgcggtggtaaataaaatcatatatccatttcttctatactacctccattttttaatatatgacaccgttgaattttataaacatatcaccattcgtcttattcaaaatttcaatggaagtataaaaaaaactaagtcatgcttaaaaaaacatttgataataaatcaaatcaaaataaaataaataataattatatattttttttgaatcagacaaatcactactagaaaaagtatttttgcaggcggccaaaagtgattttttcaggcagaggagaggatcgcctgtagcccaacgactgtgaaaatcgatgattttcgcagtcggggcaatggcccgcctgcgaaaatgcattgaaaaagcaaaaaaaaatcgccacacgccctcgccgtcgtcgccctccccagccggatctaggagggaaggggaagggagctgcgccgggcggcatcgtcgccgccgccgtcccgcgccgtcgtcgccgccgccgtcccgcgccgtcgttgtcgccgccgtcggcgcccgccccgccggccttccccttccttcttccggcagatctgggagggaggggagaggggagctgccgcccgctgtcccctgccgggcttcccctttgcttcttcagccatatttgggagggaggggggagccg

SEQ ID NO: 35646 - DNA, 8833 bp, Oryza sativa
cggacagtgagcacagaaaacgaaacgatccattagcacgtaattaatttagtattagctatttttttttaaaaatagattaatttgatttttttaagcaacttttgtatagaaacttttgcagaaaactcaccgtttagcagtttaaaaagcgtgcgtgtgaaaaatgagggagagggtttgggaaaaggggatacccaatcccccgcatgcccccaactcacctaattatccaccttcttcctccagcgtgcggactgtggttcggctggcctttggattcttcgagcacttggagcagagaacctccggacaccagccacaatctgaggctcgcatcgatcctcggtaagattaagatacgaatttgtttgtttgttttttcggttttggacaccacttcagttctgtgctgcacttttgctcaagcatataatcatatatttcagtatttcatcaccagtttgttcctttctgtttgacctacaagtacgattactgtgagaagtcggggtttgtactgcttaagaaatgcttaaaaaatatgcttaggttgatttgtttgccgatatgatgtcggtactggtcatggatttgtaggtgcctctcgtcatatttttatctcatgttagaaccacatatttttgctgttctggtagtactattttagataacttttatggtggtttattctagcatttagaacctttatctttcattgtccaatcgatcttctctcgtaatactaccacgtcagctacaaagcagtactccctccgtatatctatatagatataagggattttggttggatgtgacatattctagtataacgaatctggacaaacttcatgtccagattcgttgtattatgatatatgtcacattcaaccacaatctcttatatttaggtaggaatggagggagtatcattttttcttatataggacaaagtagtatcacttttttttctaccgctaatcctatcttactataaagttgatgtctactaacttctaaagctcagcatgtaagtaagtgtgtgtcacatcttcacccactagcaattattttctagagtattctaaattacatgtaagtgtatcacatcatcactcaaaagtaattattatctagagtatcttaaatatcatgtaaacatgacatcgtttataattttgttctatttttagaactcaatatgcaaacaatgttaaatcattatcttcacatcatttttatattacctaaacatatacatattaccatttctataatgtataacatgcattcatgcatccatatatcccgcagcaaaacgcggggtatcgagtaaaactcattaagcaaagcgcgggatattattggttgtaggaaacaacaagtagagaccaccataaaagtggtcgttaatttaatttgtaggccaattctcatctcttgcattgatctgaaatgttatttttttgtgtgatttaaattataggagtgtaccagcatttcacagcagttgggtattggaatgaaaaactgtaaagtacacttaaaatgtttaactttagagatttgctccggtccaacaaaaaaaatacctcgaggtaccggtatctcacagtactaaatcgttttcgatggttggatctagttgggaaggatggacattgttagatccaacgatcgaaaacgatttggtatcgtgaggtaccagtacttcgaggtactttttgttggaccggagcagatctctaaaatttacgatatttgaggttgtcaaggtaaccggccaacatatatagagggtctaatttgaattttaattagaaaaatcatcttattgttggtaccaatactatgaaatttgacaattgctgcggagccaagatagaccgtgacctctacaattctttagcactggtattaggagatatcacaaattattaattactaaaaggtatattacctattatacgtttgttctcaaggacaataaacataaagcttaacattccaaaactcgttacatctatgattgataggatttgatttgttgaccttcctagaaggaaaatcgggtgggttttgagatggctggagtattcgcctccatggctatcgaatgggcgatcgacaagctctattccttgctgccagcatgtctggtatcaacacctgcatcgtcatcgtcttccgcagcgccagctgaaagcgaggaccttgaggttctgaagaggcttgagagaacaatgcacaggatccatgcgacactgcacgatgcagaggaacagtggaacatcagggaggaaacagccaagctgcggctcaaggaactgaagaaggtggcctacgacgcggaggacgtggtggatgagtacgggtacgagatgacacgccataaagtggaggcatttgagcaatctgcaagggctaatcgcagcggcaagcgcaggcgcgaagaggtaaaattttcatcactgcataatctatgccaacaaaaattctatcagatatttatatatgatgtttggaccatgtttatgcatgatatgtttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgcgcgcgctcgctcgcctcgcctggcagggcgtgcggcgcgcgtgcacgacgtacgacgtcgaatagtccgaaaaattggctcctcacccttgcgcagatgcagccttcttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactttgtactgcgccgtcgctcgtagactactccatcccgctcgccggcgtgcaccagcgatcgggagagcaggtctccggaacctcagcctttgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcgaaatgtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgctgatgcactgaggccggataaattcaccggtgtgcattttaagagatggcagatcagggtcactctgtggctgacagctatgaaatgcttctgggtgagtactggcaaacctgtaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcattcaaatacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttcgtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaatttgtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtttgactagagacggatttaagttggtttttgagtctaataaagtagtcgtgtctaaacatggatattttattggtaaaggttatgagtgcggaggcctgttccgcttttccctttctgatttctgcaataagtccgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaattgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaagacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggttaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtataaggctcggcttgttgctaagggctatactcagaaagaaggcgaagatttctttgacacttactcacctgttgctagattgaccacaattcgtgtgctactttcccttgcagcctcacatggtcttctcgttcatcaaatggacgttaagacagcttttcttaatggagagctggatgaggagatctatatggatcaacctgatgggtttgtagttgaaggtcaagaaggcaaagtgtgtaaattgttgaagtctttgtatggtctgaaacaagctcctaagcaatggcatgagaaatttgacaaaacattgacatctgcaggctttgcagtcaatgaggcagataaatgtatgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacatcttatgatcctagcttgttgcttcgcaagaacaagagaattgctaggaatcaactagaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattagggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccagagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactaacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaatgggtctccatcgaacgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcctggcctggcatggcagcgcgtgcacgacgtacgcgtcgaatggtccgaaaaattggctcgtcacccttgcgcagatgcagcctccttttgcagttttgttttgctgcaaattcggattcgtttttgttttggaaacgttccgaaaaatccggtgcgtgcaaccggcgtggagtccgaataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactctgtactgcgccgtcgctcgtagactactccatcccgctcgccggcgtgcaccagcgatcgggagagcaggtctccggaacctcagcctttgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcaaaaagtttcgaccaagaagccggtcttttcgtcacctcggtacgtgttcaatatgttg

SEQ ID NO: 35647 - DNA, 3762 bp, Oryza sativa
catttaagatttaacagaaatttctccagaagtaaggagattcagttttcctgattaaggtttttatgttttccaacatgaaggttgatggcacaatccagaacatttcggacatagtcccagtaccatctgagttagctactcgagcaaggaaaatcatggacatgtttaatgaaatcaaagattacgctagtaaattcagtttgtctgagaatgatggagtgcggcgatctattcctgatatgcaccaagtgcggcagactagctctatggtatttgagcagagcattattggcagaggaagtatcaaggacactgtaattgaaaagatgctgtcccaaaacaaaagcagtacacctgaaagccatgtttcagtcctgggcatagttggtatgccaggagtaggcaagacaactctagcgcagcttgtgtacaacaacacagaagtatgcaaatcttttgatgtccgtgtttgggtctgtgtatcagagaacttcgatgtaaaagaaattcaggataagaggtttttgctagtattggatgacgtatggaatgaacgaagagactactgggaaatgttccgtttgccaatgttgacaacaaagctttgcaaaattatagtaactactcgaagtcagaatgttgctagattggttcaaacaatggattcctgtgaattaagctgcttagattctaatgatagctggtcattgttcaaacaaactgcccttttggatgaagaacatgcaatataatccaagtctacaagaaattggcaaggatattgtttcaaggtgtaaagggttgccgttggcaatcaagactattggaagcatgctgcgctacgaaccagatgaaactaagtggaaggatatcttagagagtgatctatgggacttagagcaatcacagaatgaggtactgccagcactggagctgagctataagcagatgcccatgtacttgaaacgatgttttattgccctctccttgtttccaaaagattacatacttcatgaagaaaatgtggttcttctgtgggagccactggagttacttcaacatggtgatggagcaaataaggcaaaacttgcagtttcatatctccatgaattagctcagaggtctatgattgaaattagtactcatagtgcatacaagatgcatgacctcatccatgatcttgcatgctttcttgctggagatgagtttgttagaactgaaggtaattcacaagttgaaatctcaccaaatgctcggtatttgtcagtagtaccaacatcaccctgggaaattagtactatcaatatttcagattcttcagattcactcaaagctatcattgtgattggtcatggacttgacgaaattgtaatcccagatgacatattcctaaagttcaaacggctgcgcgtctttagcttgaatggagctgcgcctaccaatctattaccagactcagctggcaacctaaaactcttacgctttttgaggttgagatgcagcatagattgccagatcatgcaactacctaaatcggtattccagctttttaatttacataccctagaactgatgaagccagcttttgatctgtatacaccaattgtaagtggaatcggccgactaattaagctagaaactttgcctccacttgaaatactaagtggatatgacagtaacttaagtgagctgaggaatataagaaaagtaaggagcctgagtctaaaagggctggattatgtatgtagtgttgaagatgcaatggaagctgatatcccgagtaaaattcacctccaatcactcaacttggattttacgagctcacaccatcaacaactgcagcagcataagcctggtgcagtatctcataaggaactattggagagtttgcaaccatgtcacaccctcagagatctgagtatatatggttacagaggcctgaccttcccgtgttgggttggtaacacttccttttccaagttgacaaaagtagtgttatccaagtgtgaatgggaatgccttccagcacttggtgagttgccttcccttgagtctttggagatttccagaatgtataatcttcgattcattggacgagagttttgctgcctaaatcaaagtgttaaagttttccgctcattggtcaacttgagtttttcctggatgtatgaattgtcagaatggtctggagtgaaggacggtgatttcgcttgcttagagactctcttgttatgccaggacaataaactaagatttcttccattggtgcccttctcgtccttggttacatgtaggttatcgaattgtggtaatctggtaacagttccagtatcctatgccctttgtgacctatatataaatgattgtgcaagtcttattgaacttccttctctcccatcccttattaagctgaagatatcaaactgctcaagcctaggagctacaatccctatgttcccagcccttcagtatctaagtatcaaggactgtgcgagtctacttgaacttcccactctcccatcacttatggaactgaacatatcaaattgctcaggcctgggagctacaatccctatgttcccagcccttcagtatctaagtatcaaggattgtgcgagtctacttgaacttcccactctcccatcacttatggaactgaacatatcagattgttcaggcctgggagctacaatccctatgttcccatcccttcagtatctaagtatcaagaactgtgcgagtctacttgaacttcccactctcctatcacttatggaactgaacatatcaaattgctaaggcctgggagctattattcctatgtctccaaccctttgcgagctaagtatcaacaaatgtgcaagtctacttgaacttcctacgatggaatcactttggaaactcgagatatcacactgcccaagcctacgtgcagttggtcttttcccagaactcagtgtactgaaactgtctggtccatttaaaactgaggtggttgatagttggctgagcttcaactcgccactcgaacacttggagatttattcttctccattggtgagcatcccgcttaggccccagtatttgacatcacttgctaccctcagattattattctgttatgatctgcaatactgtgatggacttgtcagtctcacctcgctcagagaactaaatgtaaaggagtgtcccaagctcaatttacatcgttcgctcccatgcaatctgcaaaagtttgagctttatggtagatagttgtcttgttacatatccacaaggctgattggtctaggcacttatttggttcatcagaatgacctttgggacacatggactaagcaggtaactatcccttattatagtgctactgaaaattttgcctactttttaaattttagtaggccgtggttaactgtttttgcttgtaacattgcaaacacacttagggccttttcgaattgctacgaatggcctaccaattttctgttagtttgaataataattatggttggtttggattgaaaccagctagttgataatagtccatgttatatttggcatcaatctagaatattcataactataatttcttgggttccatgtcagtagcaaatcaaatatgaccaaatacagtcttatcctaccagagaactggcagggggcactaccaaaatatactatccaaatagccccttaattactgtaggatcgaaacacaagaactaagccaaccaaaccctggggggggggggggggaag

SEQ ID NO: 35648 - DNA, 2061 bp, Oryza sativa
  unsure (1)..(2061): unsure at all n locations
aatcttcaccaaccacgtgcattgaactctagcctaagtatcccgcatgatgtctgaccgtcccggacatcgtcttatccccaagccgactcccgatcgatcactgtaaatactcccccgaggcatcaagtcacctacacatgaatcaaacaaagaaaccatattccgagaccaagctatctccaatttgactcattagtagcaaccaacagtattacatacgtatagaatccatctagaagccataaatatgaaacaaacatgaatatccaaataaacaactcgaaaatgaaaccgacacagtgtcggccggtctgaccgcgcgatacacgccggtctgaccggcaactactgcccggtctgaccggacccaaatcagcagtaccaatagatcacctgttaaaatccaatcatctccaaaaccacttcgcaaataaattccaaatataaaaaccaataatctccaatgccaattgttcatcacagaataataatcaaaaacacctttgattttacaatcttccccttgatgaacacattggcaaacccataaaaaatgttttggtgtttagaaaaataaaaacaaaagtggtaaaaagcacactttgtacaaatgtacacatcgtgctcaaaaatccaaaagaaaacttctctcatttttgaaaagaaagaaattcccccttgaaccaaaaaacatgttctcttctcaaaaactcattgtttctcccccttttgacaatgatttcatcaatcataggaattatattcaataatgttcaagagtttagcatacatatagcaaatcaagtcatgtgttgcaataaaaagaatatgaacccatctataatatagcaagcatgcagtaaagtataatcatgaaccagagattttacaattaagttcaaatcaacaatcaaaattcatgatttcatacgatttataatgcaacatcttaacaagcacataggttgaaaaacaaacactaaacatatatacctattgcatttatcactctttctcaaattagctctagcacaaaacaaccaagagaattttttgttttattttccttgagactttttgctcatattttctctctcaattattccgagtacgtccttgtcgtcaagactgtttccaaggattcggcacccattatttttgctcacatcgaatacgtctttgtcgtcaagactgtttccaaggattcggtattcatttttttctctcagagatatttttattctctttgcacaatgagcaattacaaagctatttgaggaataacaactcaataaagcatatatatataannnnnnnnnnnnnnnnnnnnnnnnnnnnnnnnnnnnnnncatatttacttaattcaagtatagaatttaagtgtcatgcattatctcccttaaaagcaaaatctaagcctcataaaaagactagaatacatacaagttatgctagagacaaataaaacttcatagtattgctagcatgcacaagaaaataccatatgtatagaacaaagctctcttttctcaatttttcttattgtcaaattttgcttgataaaaccatgaggtacaaaactcccctcaaattatgccaaaaggatgaattatgcccaattctccacgaagaaaagcaaagcgattagaatccaaaggtttagtgaaaatatcagcaagttgcaactttgtatccaaaaacatcaattcaatgtcgcccttctcaacatgatccctcaaaaagtgaaaacgaatatcaatgtgctttgtgcgtgagtgttgaacaggattcttagcaatgttaatagcactagtattatcacaaaagagaggaactttctcaaaagtaagaccatagtctttcaaagttgaaataagccaaagaatctatgaacaacaactagtagcagcaatatattcagattcagcagttgattgagcaacactagattgtttcctagaagaccatgcaatcaatgatgtaccaagaaaatgacatgttccactagtacttttcctatcaattctacaaccagcaaaatcaacatcggaatatcca

SEQ ID NO: 35649 - DNA, 694 bp, Oryza sativa
gtatgcaacaatggccattatctgttcctctgaatctctgatgtaattaactacacgccttgacattgtgactgacatatgggacccatcacctacaggtctacttccttcgtcccaaaaataatatattctctcctattacaataaatttgaataacacctgttcagattcattgtactaaaatgtcacatccctttcaggttaagtaggtttttttaggacagagagaatatatatcaacaaccacgtttcggtgattttacataagaggccgatcccgttcatggttcctctgacggtgcaactcttgcaggacctggccctggcaatgtcgacggtgaggccgtcacgacggttcctgaacgatgccacgatgaacggggatgtcctgacggagggcaggtacggcacggtgaggcgagtgtacgtcgtggcagaggaggacgagtggaagccggcggagatccagcggctgatggtgtcgtggaaccctggcacggaggtgagggcgttgcagggagctgatcatatgcccatgttctcaaaggcgagggagctctcagaattactcatggagattgccacaaatatagttgagattttcagaagcatgttcttcagataaaacgttactggaacatatatatatttctgaaaaatggatatagataacaatgccttagactctacaaa

SEQ ID NO: 35650 - DNA, 6979 bp, Oryza sativa
acattggtttctggatagggaggccgacaaaaagtggaggagataaggacgcaatggtgttggacataggccacagctagggttgacaacccaaatatggggttggtgacaaccatgagaaataggaacgatgaagccagcaccaatatggaggagtgtgcggagatgagccatgtgggtggtgacatgcctgatgggcaggtggatcaatggggcaccgagcaagatggagtgatcccacaaggagactcttaggcagcggcacacggagagctcagggctgtgttggtgcttcacaaccattgcctcttcatcagagccgcatcactatatccagttggccaaagacacattgtgtttccatgaatgtggtgagccccagggaccataatagatgggccgtccagcaaaatggcctgtagatttgctccggaggagggcagccgtgatgtaggggcccattagtggtgatgaggtgcgcgtggtggagctaggtattggtgcgcaaaagaaaccgagacttgaaattgccatatttgttagaatagttggggtacgcgtaggagcattgggtaaggggtggcaaaataaaccgagactggaccccaaaaataccaaatgtgatcatcagttcctagcacggtcttaggtttgagaagatagatcccttgttcggtctttttgtttactacaccgggtgtctgaactaccaacattatacttatctcctctttattttgttccttatctagtcataccattctcttcgatctctcattcgccagcgccgtttgtagtctccgggtctttcatccagccgcaccctatctgctatatatatagaagacccctcttctccctcgttatcttccatctcccatctcctcccgcctcagattgccgttgcttgttcaccaaacagcactcccctagctctctgtatggctggcccatggccgccgcctgcctggcgcttactctaggttggtccgtccattcctatcacatgtgctccgggttccacgcatatcgtccagcgtggtcactttcactatggccgaagaaggagaatgaaagatatcaattttttttatcaagtttgattgtcattttcgaaggattgaattacccggatcaatatctcagtcatgactgaatgcccaccactagcgctgcgtgggggtttgggggcgtgccatatagtagtcatactaataagatagtaactataatcaaaatttgacatttatagcccgtacatatgggttattgtctaatgatccataaaagccaagctttcaaaggtacaagcccttacaaaagtttaaaagaaactggtggtggtgatggtgtgatcgactttatgacaagcaatgtcgaaggaaattaaaccaaagcaaatgatacatgtgtagacatgcatggagggcgcatccacaccaagcactacgcaatcacgcatggattgatcccttcaggtgttcttggaggaatccatggaacgaagctcccggatacgtttccgtatccccaggcggtacttcacgatagccatctggacatcctggaggatgtccacggtcaggtcatccacgttgttgcgacggcctgacataaggtcgcagacgatgagcttgatctccaattcacggttcttgcgtcgcagttcctctagcctcgctgttgcggcggcgatctgctgctcgaggatggtcttctcgtcgtccagcatcgttgcctgcacaaaacaagtaatgggatcgatcgacctctaactacctctatgtttggtgtatttgatggagtgatgttgtgagaagaaaaagcaactaaggcgctacttttatagccatatctgggtgacacaaagaaggaagttattaagtgcaaagatttgatatcatatccaaattaaatgcaaataaaagtataatgagtatatacttaaaatactacgtacacccgttgttttttaatttttatcaattttaactggcattgtattacattcacaagtattaagaggtcaactttttcgggctgtaaatatttgacagtgataacgatatttgagagggagcacaaatcgggtgtacggcgctgtttcacggcttatatgaaaatgtgcacttctagataaaaaaatgttgcaaatgattaaaatggtgaaacatagttgcataaagattaaacatttcactcatgcactagaaacatcaggattcaactgttgaaacatcaacagatgcacaagtatcggagtaaaaaaaatgaaagaccataagaatctctactaaaacattccgatcaatcacaaagaaacatataaaacatgtgagctgaaacatcgaaaaatcacaaaatgtaccaatgtagatctctccttggtcgcctgatcagagcttctattgatgaacatgtcagctatgatgtggagacccggtgctccataccttggatgaccataccttccttgtcgttggagtcaacggcaatgaccatctccttctctgtcgcttctttgacatggtggtgccgtcccctcctcctctctgctggtggcctcccagatgtcatggcttccttggcaaatcattgcgcctcacaagcttcttgcttattccgccatgacagctgtcctccccaccaacatcaccgccggcgaccacagaagtggcatgctgttgtcacagtgcctcgcttcagtatatgcagtgtgaggattgagagacactagaagagatgagaaggctcatgtgtgctagctggtgttactgggaactgatgttgaagataggtcctaatgattagtaaatgaatgcgatgtgatgctgccttgtgtgctagccggtaattggtgtaaattgtgatggaaataagagtaaatgaattacaggtagacaagaaaaacaacgctcactgcataagttatatcaggccttgtgtgacataaatagatcaaccatcccacaagtctttgatacctctccttgttcacctgatcaccggattcagcacatagcttatgattttgctcaattggtgtagaagccagccgagaatcgagcataccggtgtcataaagtaaatccaatgcatacttccgttgtgacaagactatccctctaggatatcttgcaatctagatgcctagaaagtattttagttggcctagatccttgacttcaaattccttacttaagttttccttcaatctagttatctccatagaatcatcacctgatgatcatgtcatcaacatacacagcaagcatagttatatggcatccattatggcgatagaataccgtgtgatctccattacactatatataccccataccactaattgcacgcttgaaatgatcaaaccatgcccttggcgattgtttaagaccatacaaagactttttgagtctcaacacctttgctctagtttgtaatgtagcaaaccctggtggaatttccatataaacttcttcctgaaggtctctacatagaaatgcattcttaacatccaactagtagaatggccaatcaaggttggccgcacaagtgatcaaggttctcaccgtgctcatctttgtaataggtgcaaatgtttcatcataatcaattccataagtttgactgtatcatttatccacaagtcttgccttatacctctcaatttttccatctaggttttgcttcacggtgtatacctacttgcaatcgaccactttcttcttgtctgggtagggtacatgatcccatgtcctgtttttctcaagagcttctaactcctctatcatagcttctcacaatcttggatcttggcttctaaccaatctttcgggattgccactgaattcaatgatgccacaaggccttgtaagtaggtgacaataaagagtacaagacatagttagctatgttgttattatcaccaccttcatcttcactttcaaagccatatctttgtggtggttttcccgccgcgcttcttgtcccctttcttatggcaataggtaattcagattctcctcccccttcttcagattcctcttctccttgccctaactcactatacacctgtatgggctttatatgatctaacatttgctcatcaacctcagcatcttgagatcatagccgctcgacttgttgtattactggaagtctacttctctgtgtgtaaacctgtagattctcttcttcacaaggctttctctactccttttcttgaacaggatcacccacacaacaaggaattgaaccaaccacaaccttcgtattcctttattgaataatcctcttcggagcccaacattgttggtatttcttaacctcacagataaaatccgcaagcgcaaaataccgatgtagcacttcacccaggagtattccaaggtatcaatttccacaaggaccatgtgtgtcgactcttcaccaggttcatccaaggatacgaagctaagataggctaagggtagagatgatttactagtgagagatagtgtctacagaaagctcaatttaatcctaacaaggtacatcgggagctggcttcgggcgctggccagcctgctgctcccagatatggctctacaacgtacacggacagggaggactttagtattttgagggctgtcaccacctctacacacacctcaaacctactgtgagatacgaagcaagaatgtgcagatgtgctgggggcttcttttgccggtggcaggtctcgtggatgtgcggatgtggagttggcaggacgacgacttgtgctagcatgaagcaagaatggggcttgacgtccgcggcggtgacttcctcgttctcggccgagtgttctccctcctttcggtttccccccttctttgggcgaacactgttctagttgtggggaacgctaaggggagggcggaggctccggcttgctgtaggagtttgcggcagattgatgatgtttcacgggtggacaagggcctgtctttgccgttggttacggtcaagttatgactgcttgtgagatgtcaaggactatttcgtggccatcaatgtgggggtgcttgtgtgggtgatgtgaagatgctggcgaaagccttgccatgcctttggccggttcgatgacgacggcgcccgcgggcgctgtttcccttcttggaggcgttgtcatggcgttctttcatatccccccccccccaaaatctccaggtgaaaaccttgttccgattttcgaatgagcggtgacggcgttacgcttcgtgtcctccttgtgggtgtcacttcggagaagttccaacgcatcgacgactgttgatggtctttttcagttcaaaagatttcataccttgtgttcggtgaggccttcaccttcttgggtctgcttcattcttgtggtgggtgacatgctcttcggttgtttctgctgatgaagtcgaagctgctcgctaatggggtgcagtgaagcttggcaacatgacatgttgcagtcttttccaaggagttatggtgctggccatgtgaaggaagaggctcctcggtggcttggctgatgtccattgttggatgtcggagctgcttttcgcattggcgactttcgtggcttcagtgtcgctgcagttgtgaagtcggcgctgctgggtcacttgtgtggctagctcagcaatgataacacctcttttgcgatgtgggagcttttgtgtcgcttttgtgtttagcttggcactgacgtcctgtgattgggctccgccgtcgttgttagttgtgtagcggtgggtttcagcctttattcctgtaattaaccgtgcaattgtatggttttcgggcccggttttccttataaactgggtcaattcttttcttctaagtataaaagtggaacaatgttccaccttaggtttcaaaaaactaattgtagcagtactgcttgcttctctgtcccaagcctgctcccttgcttcccacccgaacggcgccgtcgtcagcttgtccttcagctgttacaccatcaccaattcaccattcccctctgagctctgaattctgatacatgaagttactagtggagatttttttggtttggaagcctctcgatccattccattgctctctcagttatacacacacttagggcctgttcactttgctgccattttcaaccttaccaaattttggtaaagttgtcaaaaaagtggctacatttagtttgctaccaaatttttggtaactatataagaaatcatgtcaaaattttggcaagtttgccaaaattttagtaactataccaaaatttgtcaatgccaaaatttggtaaggttttttttggcatcaaggtgaacaggcccttagacatactcagcccaacatcttcaatccaatgcttcatcctaggaaacgtttccagttctcccaatctgtctcatacattaatgttgtactggtggttgttcagtcgaggccctgtttaattctcacgcaaaaacttttcaccctatcacatcgaatatttgacacatgcatagagtattaaatataaaaaaactaattgcatagattgcgtgtaaattatgagacgaatcttttaagcctaattgctccataatttaacaatgtggtgctacagtaaatatttgctaatgacggattaattatacttaataaattcgtctcgcagtttacaggtggaatctgtaatttattttgttattagtatacgtttagtatttcaaatatatatatccgtatatctgatgtgacacccaaaaccttttaccccctaactaaacacagcctaaatacgaagacacaacctaagtatgaagtggtatagtgacaataatccagattcctgtatgagttgacatttattttgtcctacgtacaatttctctaatttgcgagttttcttgctgcactctgcgtatatacaatcccatgtaagggtgtgtttataggcggtaaagtttgggcgtgtcatatcggatatacgaacaca

SEQ ID NO: 35651 - DNA, 2346 bp, Oryza sativa
ctatataagtaatcatgtcaaaattttggcaagtatgccacaattttagtatctataccaaaatttgtcaatgccaaaatttggtaaggttttttttggcatcaaggtgaacaggcccttagacatactcagcccaacatcttcaatccaatgcttcatcctaggaaacgtttccagttctcccaatctgtctcatacattaatgttgtactggtggttgttcagtcgaggccctgtttaattctcacgcaaaaacttttcaccctatcacatcgaatatttgacacatgcatagagtattaaatataaaaaaactaattgcatagattgcgtgtaaattatgagacgaatcttttaagcctaattgctccataatttaacaatgtggtgctacagtaaatatttgctaatgacggattaattatacttaataaattcgtctcgcagtttacaggtggaatctgtaatttattttgttattagtatacgtttagtatttcaaatatatatatccgtatatctgatgtgacacccaaaaccttttaccccctaactaaacacagcctaaatacgaagacacaacctaagtatgaagtggtatagtgacaataatccagattcctgtatgagttgacatttattttgtcctacgtacaatttctctaatttgcgagttttcttgctgcactctgcgtatatacaatcccatgtaagggtgtgtttataggcggtaaagttttggcgtgtcatatcggatatacgaacacacgtttaaaatattaaacgtagtctaataataaaataaattacagaatctgcctgtaaactgcaagatgaatttattaaactgcgagacgaatttattagtaaatgtttactgtagcaccatattatgaaatcatggagcaattagtcttaaaagatccgtctcgcaatttacacgcgatctgtgtaattagttttttctatatttaacacttcatgtatgtatccaaatattcgatgtgacaggatgaaaaagcttgctaggagatttaaacaggctcttagggcatttacaatgtgagccactcctagagtgtcctcactaactgagaacactcgtaggggaactcagctcgtaatggaggacacccttggatgggctcctaaaaatctaaagcaacttaataaagacattccaacccaaaatgggtatcccaacccacaaagccccatatttatttttactaccctacccctaatctctctctcccgccccctcttttttttcaccgccgcacgggcctatccctctcgccattgcactcgcctctccctctcgccgccaccgccgctcgcctctcccgtcgtcagcggccgcgaggacgacgaggagggccacctctcccgtcgccggcgtccaccgctgcccctctctctccctctctcccatcgccacccatcgctgtcctccccggcatcctctgtctcgcgccgtcgttggtcgggggcgccatatcctgcgccgtagtgggcggatctgggccccccgcggccagatcgaggaggatacggttgcaggcacaacgccggcggtggtgagcggcgcgcggatctagtcgtaactgtcacggatccattgtcgccgtcgcagatccatcgtcgtcgtcgcggatccatcgtcgccgccggaggtcacgtgccgcgccaccggatccatctctcctctctctctctctcgtcgcggggtcatcgccggatgccgtgtgccgtgccgccacccctcttcctccgcccgtcgccgagtcgtcgccgtcgcagggtcgtcgcctacttccaacgacgagggcgaggggtggaacggtaaaatgtggggtgggagcaatgtccacgggacactcacctagccacgccctctacaatgcgtctcctagctcggtgtctcaacaaaaggctggtgaggaacatgaccccagcgaggtgccgcttggcagaagagacgggtccggctgaaaagctacctggaggggaacggccacccattgctgatggcctaagactatctccaacaatactacccataactggagacccattgaacggtatgcgtcacgctgaaagaaaaggtcacgaacctatttctcgccttctccaacagggaacgcaaaagaaaaccagcacgcggactgtttctctctccacctcccgtgaaatcgttgtgccttgcgagccaggcgtttgggtcgatgagagagaacactcaaatttgggtcgcactctgcctggcacccaaaatgggtcctttgtatgggtaatctgttggaccgtgtttttgttccgctagagtggctgaagcatgcattt

SEQ ID NO: 35652 - DNA, 3085 bp, Oryza sativa
  unsure (1)..(3085): unsure at all n locations
gctacctggaggggaacggccacccattgctgatggcctaagactatctccaacaatactacccataactggagacccattgaacggtatgcgtcacgctgaaggaaaaggtcacgaacctatttctcgccttctccaacagggaacgcaaaagaaaaccagcacgcggactgtttctctctccacctcccgtgaaatcgttgtgccttgcgagccaggcgtttgggtcgatgagagagaacactcaaatttgggtcgcactctgcctggcacccaaaatgggtcctttgtatgggtaatctgttggaccgtgtttttgttccgctagagtggctgaagcatgcattttgagtttgggtgccactatgcctagcctgttggagatagtctaatgtcctacaagtgccgttgctttctcctacaatttgacccttccataaaataaaaaggaagaaaaaattatccagtttctactgcaacttcgcaattctgcaacacaaaatatctagctttttttttttttttttttgcgggggacaaaaatatctagctaagctgccgttcttccactaacccaagaaatggccggactgttcgcatcgtcggccgtgaaatgggccatcgacaacctctcctccctgctgccggcggcggcggcggcggggtcgaaccggggcctggacgcgctggaggagctccggatgctggagcggaccatgcggcggatccacgccacgctgcgcgacgcggagcagcgctggaacatccgcgaggagtccgccaagctgcggttggaggagctcaaggagctcgcctacgacgccgaggacgtggtggaggagtacgagtacgaggtgaaccggcgcaaggtggaggcgctcgagcggctcgccgccgttcatggcggcggcggcgccagcaagcgcaagcgcgaggaggtaaattaattaattaattaatcaactagtccggtcgctgcatctgctgacgaaatctattagactatcattagtggggtagtagcacgttgtctgtgctgtgattagtcatagtattttatactgattactagttttagctatactttgcaagtcccattcaggtcccaagtgtctgaaccctgaacaaaccccctgaagaggggataaaagcaaacagaaaactgtaacccctcttccatttttttttcccattagaaagctacaagacaagcactatattagtatattactgaattagctggttcagtactttgtcctagctgaatcaaaaccatcaaatggagttttctagcttggtattggtagtatatcgattcccaatgaagttagcttgaatcctaaacaaatgtgtctataggtagagacatgaaaagaatagtgaactgtcttcacggctgcacccagggttctgggattcgggccaaaaggtccgaatttcgtccattttggtgaggtccgagacacaatttcactcccatttcgtctgaatttggttaaaattgtcaaatttgatgttttgtccgaaatttctgaaattcgtccaattcggtggagcacgatttatatttgcaatcggatcccaaaaccctgtctgcaccatagatgactgaacctccctctttcaattctttttcaaaaaaaaggtacatgaagagcagttctccactgagtctggaatagttccagttccaagtgagttggctgacagaacaaggacagttattcagagattctgtgagatcaaagactactgcgatagttttagtttgtctgataatgatggggacagaaggattgtccctgatatcaatgctatgcggcagactagctcttttgtatttgcacccagaattcttggaagaaagaaagacatggagaatgttatcgcaaaattgctctctggggaaggcagccgtgttggaggttgcatgtctgttttggccattgttggtatgggaggattgggcaaaacaacactagcacagcttgtctacaatgatccaagggtacgccaatctttcgatctttgcgcatgggcttatgtttcagagtgttttgatgttcacaacctaacacgcaagatcatcagttctctaacccagagtaactgtgatcatatacaatctggtgatctacagggagcattggccaacgagataaaggacaagagggttttccttgtctttgatgatgtatggaatgagcgaagcgattactgggagttgttgatcacaccgatgtttgcttctaaatgttgtgacattatagtaaccactcggaatgagacagtggcaaggttggtgcaaacaacacaaatgtacaatatgaactgcttaagtcctgacgagagttggtcattgttcaagcaaacagcatttactgagcaagaaaatatcagtccagcaaaccttgtagagattgctcgaatggtatctgaaaaatgcaaggggttaccattggtaatcaagactgtagggagcatattgcgatttgaaaccaatgaaattaaatggagggatgtcctacaaagtgagttatgggacttggagcagactcagaacgaggttttgccagtgttggagttgagctacaagcacatgccgatagacctgaaacagtgcttcgttgccctttctctatatccaaaatattattatcttgatgaaaacatggtagtttggttatggaaactacttggtttacttcaaggcgatgaaattggaaagttatatttcaatgaattggttcagcgatcattgcttcaaagttctatccatggacagaaagaaggtcatgcatgatcttgtccatgatcttgcatgctttcttgcaggggaagagttctttagacttgaggaagataaacaaactgaagttccacggggcgctcgatacatgtcgataatgccaagatcactatgtaggaagagaattcaaatatcaaatgcctcgcaatctctcagagccatcatagtgataatgggtgatattgatatcgtaaatccggaagtgttgtttacgcactgtaagaagcttcggatcatttacgtnnnnnnnnnnnnnnnnnnnnnnnnnnnnnnnnn

SEQ ID NO: 35653 - DNA, 1166 bp, Oryza sativa
catgaaactactacggcatctcactctatcaggttatgaatgtgctacacatttatcacgtcctaattctatgtctgagctatttaatttgcaaaccctggacatacaagcgtatacgttacttaaaattggacgactgattaacttgcaaactttgcctgaaatacatctcatgaaatgtggttgcttcgttgacataagagagttgaggaatatgaacaaaataaggaagttgtgtattcgtggactgcgtaatgtacctagtatcatgcatgcagatgaagctcatttacaaagtaaaaggaaccttgaggtactagagttagattttgacgaattatttcttgataaagatttcgatgaattgagaagttgtgaacatacagagcatggtgacgctaatgaagcagctgtcactcaatcgcgaggccagttacttgagaaactacgaccacactaccaaagcctcaaggtactaagaatacaaaacttgaaccatggaaactaccccagctggttgggcagtgcttctttttccaagttaactgaactgaagttacaggcttgtcaatctcaacaccttccaacacttggtgagttaccttctctcaaatcccttgatataagccgaatggagtttgtggaacacattggccatgagttttgcagccttcagcaaagattcaaagggttccaagcattacaagacttgagctttgatggtatgactcgattgtcagagtggtctggagtggaggatggtgagtttccacacttggagaccctgttattctggaattgaattgaagtctcttccatttgttccattgtcatgcttgcgtaatctcagattatatggttgcaaaaatcttgttacttttcctgcctcagctaccatgaaggaactaagcatctcgagttgtgagaaactgaaggaactgccagctctaccatcactccgttcattagacctgtcccattgtccaagcttgtttgcacttggtcacttccccttgctcacttccttgggactgtattatatattcaatgaagatatactatgcaagttggtgaattcgtacatgacactggaagacttaacaatttggtctgataccatcaagtcattcgctcttgaacccctcggcctaccatcagttcgaaag

SEQ ID NO: 35654 - DNA, 1256 bp, Oryza sativa
  unsure (1)..(1256): unsure at all n locations
nnnnnnnnnnnnnnnnnnnnnnnnnnnnnnnnnnnnnagcgaccactatatattatttctggtatatccatgggactacttggtcgtagtgcgtgatctggcacactacacctagaagacattcacggaatttctagttttgttgaatttgtaagtattgttatacaccgtttaataactattggctcttgtgctcacaattgactcgaataaatattttgtttacatagagcacataggtattacgtagaccataacggactagtcaagaatgccaacagaactaagcttctcgtgaagacacaatggctggtaatgacaagttcgtgaagatacaacgtttgtgagatgcgcaactaacgacaaccccgattagtagtacatgtacaattcgataatttgatattgctaccggttaatataggacgacatattcccaaatggctaggcaattctatataatgcctagtgggaagaactattatcccgtgactcgaccgtacggtataatagatctccccatgtggtcgtgttaagtcaaccgcacaggataatggttcttctcgtgtggttgggccgcctgcacgtgaaaatatgatttttgcagaccttctcgggtgtgagggccggccttttgcgcggcaatatgcctttcggctcgcacgcaaaaactctttctgtagttgtgactgccactgccacccccagaacccttggagcttggggccattgtggggacggaggtggcagaggaggaggccggttgcttgctcaaaagtggtctattcaatgcaatattcataatatagatagatatgaaatattatatagcactcccactatttttttaatacatgacgctgttggcttttagcacgacagttgaccatccttcttattacaaaattttaactaaatatcatttattttgttgtgacatgttttatcattaaataaagggtgaatagccaatacggtccttgaagtttcgcctcggactcaatttaatcctctgtgtttcaaatcatccaaacaagtcctccaaatttattatttaggttaatatagtccttagacccaaaaaaaatgccacataagcatgtcgagtcatcctcgcatgtagcggtatgaataaaatgaccattctacccttatataccatatagaaaagaaagaaaagacacaaaaaaaaaagggcagcctaggcccaacattgttgcggagggtggccgacaaaggaatttacacggtcagtg

SEQ ID NO: 35655 - DNA, 12284 bp, Oryza sativa
agtgcgctagttcatcactataagccgcaatgcttctttctgaatttatttactgctaaaaggcctaaaacatttcttacttttttattacgtgtccatatctcattgagtttattattgtttaagacttgtaaagtatgcgtgttgcctgttcggatcgcgtgttagagcacatggcaggcgctcaaaattaggcagctaatcatccattgtccactagccacttgtgatgtttttgaaataattaatcaataataataatgtgcctagccctgtacatacatgtccagatgttttggctgtcatctcttctgctaactctcccttttgactttacttacttgctgagttcctcatcagttcccttcctctctttccaagcttgcttccatcgtcgacatctcctccttgatccgagtagctcgtgatggccggactacttgcctctctggccataaggaaagcactggagaagctctcctcctacctggcagcgagcctttcggcatcgtcgtcctcgccgacgtctgggagggcaaggcaggagaaggaccacgaggacctgaggatgctggagcggaccatgcgcaggatccacgctactctgcatgacgcggagcagcactggaacatcagggaggagtccaccaagctgcggctcaaggagctcaaggatctcgcctactacgcggaggatgtggtggatgcgtatgagatgaatcgccagaaggtggaggctctcaaggcatttgcaggcgccgccagccacaagcgcaagtaccagcaggtaaacttctgctagcttctgccattaatccgattccggagtggaaagataactaattaatcgacatatatattttcttggaataggaaagcgagggcttgttctgtgattctcatacggttgccattacagacgagttggctatcaaaacaaggaaacttattgagcgatttgacgagatcaagtattattcagacaactttactttgtcggagaatgatggagagatacggcttactcctgatattagtggtttgcagacaagctctgttgtctttgagaatagcattgtgggaagagtgaaagataagaacaacattgtagaaaagttgttgtccaaaagaggtgacaatctagctagtccggtttctgtcatggcaattgttggtatggaaggattaggcaagacaacgctggcccagctagtgtataaccacccagaagtgtgcaagtattttgatgtgcacgcatgggtttgcgtatctgagcagtttgatatcaacaacataacacagagcatcattgtcgcggttacaaaggagaagtgtgatctatcagaacttcctaatctccatgagagactggtagaagaaattaagcaaaagaaagttttgcttgtgttggatgatgtgtggaatgaaagaagagattgttgggatctgctgtgcatgcctatgaacaccacgaagctttgtatgattgtagtgaccacccgcagcgagaaagtcgcaaagcttgtgcagacaatgtcaaacttctataacctagaatgcttgagttttgatgagagctggttgttgttcaggcaagttgctctcactgttaaccaagaaaatgctccaccaaacctggtagagattggaaaggctatagttagaaagtgcaagggctttgcctttagcgatcaagaggataggcagcatgctgcgctatgaaacggatgagcagagctggttggaggtcctagaaaatgtgctctgggacatggaccaaccatggaacgaggtttcgccatccttggagttgagctacaggcatatgcctgtatacctgaaatgatgttttgttgtccttgcacattatccgaaggattgcatacttaatgaacttgaggtgcttcagttgttgaaattagttgatcccttcaaaaaatggcagacatgataatgaggaaaaaaatggcagacatgataatgaggatgagcttgaaagtatttatctcgatgaattggtggagcagtcattccttcaagaaatttatttttgatgttcttgatgacgacgagttgaaatttcctttttctcaaattaactgaaaatagagatgaatcattgtgacactcagtagcttcctacgcttggtgatcttccgtccctcgtgtccctctatttctatggcgagtggcttgtgcacgacactggccggtccaggagttttggagccttgttcctgcaggtgttgggattagcttcattgagacattttgatactctgacgcccaagttgttccgagtgattcggagttagtggtggtgaaatttccacactacaatactatttacatctgcaatgacgctgccaacactagtcttatcctctgaggtttcttccatatatctgtgctcttcgtgtccttgagaactatattactgataggatgccactgtgtatcactgtaatgtattcctgcatggcctaaaactgcatatactacagattggtaggcaccgaaacatagaggtccactgtttgaatcccctctcatcgctagagtgcttgacaatcttatccgatggcaccagatgcatccctattgagcaaagacccctgccttcattcaggaattacatccgtttaagcgttctgggattgaagtacctgcttcccccttgacatgaagatctacaccactccactgccagccagcagggatagctagtcactcctccactaccttcctccctttctgagcagctccacgagctttttgccttggtctactttttgtcccctcatgttcaaaagctaacaaaacacatcgctcaactattcaaccagctaatatttcttatacttcctccgtttcatattataagtgaatgtggacaatgctagaaagtcttataatataaaacagaggaaacggaggaagtagttttacaagtttgatcaaatactgcgaaatgcttagcgtcgagagtccgatcacagtcacagcaggaaaatcaagcatccatgccactcactcattacttctcgtctctctctctctctctctctccctctctaccttatcttaagcaatagtttaagtctctacctcctattttcatgtcatctctatcctcacaacacatggtaacacccccaaaaaatttgtgttcaaatccagaaactaaaatatggaaccaacaaaagatttttgaaaattgcatcacgctaagtcttcctggtttttattgcaatttgtgccggtgccaatatttaaattatttcaaattcaaatcctaaatccttaattacaattcctaaaatggaaaaacaattcttttagcaaagtctggttttcgtccctatgttttttagggaaaacactgtaggggaagcccccacagtttaaaatttatatattaaaacaaagttatttacaccagattaatccaatttacaagcgtatctctctcaaacaaattaagcctatggactaagagggagagttcattcttaaagaaagctctccaggaggcaatagaaggagcaacattattaaaaattaatccattcctcggcttccaaatactccaagcggcatagagcaccttctccacaaagtgtgaggacctgtaagaacttttggcagtatacaacatctcctcaaaattcagagacaaatcccaaaccagtccaaattgtgcccaacactgagaactaaatggacactggaaaaacagatgcaaagtggtttctcttgcatttgccgagcataaaacacaggttaaagcagcattatgaggtgcacaatgtcgtctatccagcatgtcataagtattcaaacgatcaatcaacaggagccagccaaataccttaattttcatggcacatttgcttttccaaatccagttaatagagttaggcacctggatatgcataaagttcatagcataaattttctgtgaagagaagataccatttccccaaacatcggtccaaaggtctctgtcatcattgagctgactcaaatgatcagaggatgacattagcaaatactcctgaaatgcttgctcagacagtggaagcacaaagagctgtgaaagatctttctgggaaacatatgaactgaaatcttccattcctagcaaaagagaaaatcctgggaaaagcagctgacctgaccttattattccacagatcctccaagaataaacaagatttaccatcccccacagtgcagtttgaaatacccctgaaaatatccacaaactacaaaacatccctcctccaaaaagaccctttaggagcatttcatccctatgttgggctcaatccctccccactccctttctttcgtttcctctcctaggccaggccaactctccctccctcctctcctttcctcctagatcaggcgagccaagccgcctgtttagagagaaattttcaaatgatctctccgcccaggaaaataaaaataaaataaatatgaatgtaccagtgtactaagtacacaaagtaaattaatgacaaaggaatcattcattttattataattctcaaagaattacaaaaatacaagttccttggcgaatcatgctccacgacctatcagcgaagcggatctaacttggtgattgtgttgtcctggttccggggttcggaaaatacccgattaattactccaatgagtttaacttgtgacaccttcgattaagctactctagtcttcatcatcaatctttgcttcgcattctctcgtgtatgatgtagatgcgatgaagtgggcgttggtgggcgccacagtagcattcatggacttgtcagtccgtatgccggtggtgttggtgatatcgtctttgtgtacattggtacattttgtgattatccaatgtttgagctcacatgttttatatgtttctttgtgattgatcggaatgtttcagtagagattcttatggtctttcattttttttactctgatacttgtgcatttgttgatgtttcaacagttgaatactgatgcttctagtgcatgagtgaaatgcttaatctttatgcaactatgtttcaccattttaatcctttgcaacattttttttatctagaggtgcagcattttcatataagccgtgaaacagttgaactcttaatacttgtgaatgtaatacaatgccagttaaaattgataagaattacaaaacagcgggagtacgtagtattttaagtatatactcattatacttttatttgcaattaatttggatatgatatcaaatctttgcgcttcataacttccttctttgtcatccaaatgtagctataaaagtagcgccttagttgctttttcttctctcaacatcaccccatcaagtacaccaaacatagaggtagttagaggtcgatcgatcccattacttgctttgtgcaggcaacgatgctggacgacgagaagaccatcctcgagcagcagattgccattggaacagcgaggctggaggaactgcgacgcaccaaccgtgagttggagatcaagctcatcgtctgcgacctcatgttaggccgtcgcaacaacttggatgacctgaccatggacatcctccaggttgtccggatggctattgtgaagtactgcctggaaatacggaaacgtatcaaggagcttcgttccatggatttctccaagcccacatgatcaatgcacgtgtaattgcgtagtgcttagtgtggatgcgccctccatgcatgtctgctcatgtatcatttgctttggtttaatttcctttgacattgcttgtcataaagtcgatcacaccatcaccaccactaatttcttttaaacttttgtgagggcttgtacctttcaaagcttggcttttatggatcattagacaataacctatatgtacaggctataaatgtcaaattttgattatacttactatgttattagtatgactactatacggcacgcccccaaagcctcacccagcgctagtggtgggcactcagtcatgaccgagactttgatccgggtaattcaatcattcaaaaatgacaatcaaacttggtacaaaaaacttgatatcttttattctccttcttcggccatagtgaagtgaccatgttggacgatatgcgtggaacctggagcacatgtgatagggatggacagacgggcctagagtaagcgccatgcaggcggcggccatgggccagccatacagagagctaggggagtgctctttggtggacaggcaacgacaatctgaggcgggaagagatgggagatgaagctgacgagggagaagagggatctatatggcagatagggtagggctggatgaaggaccgttggactacaaacggcgttggcgaatgagagatcgaaggcgatggtatgactatataaggaacaaaataaagaggaggagataaggataatgttgatatatcgggtagttcgggcatccggtgtagtaaacaaaaagactgaacaagggatctatcttctcaaacctaagaccgagctaggaactgatgatcacatttggtttttttggggtccagccttggtttcttttgccaccccttacccaatgctcctacgtgtaccccactattctaatcaatatggcaatgtcaagtctcggtttctttagcgcacccatacccagtgctaccacgagctcctctagtctcctacacaaatatggtaaattttcatatcactacccaatccgcttgtttatataaataaaccaagataaccaaccatatcctttcctccacaatacccactcttgtttcttcagatctagagatcgaataggtgcagcagcaccgacgatgggatattattctccgaagcaaatcaggaggtcatgccaccagccagccattccatcagcactaatgggcccgtacatcacggctgccctcctccggagcaaatctacaggccgtattgctagatgtcccatctgttacggtccctggggctcaccacgagaaagtcgcaaagcttgtgcagacaatgccaaacttctatagcgtagaatgcttgagttttcatgagagctggttgttgttcaatcaagttgctctcactgttaaccaagaaaatgctccaccaaacatggtagagattggaaaggccatagttaaaaagtgtaagggcttgcctttagcgatcaagaggataggcagcatgctgcgctatgaaacgaatgagcagagctggttggaggtcctagaaaatgtgctctgggacatggaccaaccatggaaggtagtttcgtcatccttggagttgaactacaggcatatgactgtatacctggaatgatgttttgctgaccttgcactttattcgaaggattgcgtacttaatgaacttgaggtgcttcagttgttgaaattagctgatcccttcaaaaaatggcagacaagataatgaggtcattcattcaagaaatttatttttgatgttcttgatgatgacgagttgaaattttctttttctcaaattaactgagataaagagttttgctcccatccagcagctctcccggtaccgaatctcagcccttcatcctgcccgatcgaatggtgggaaacacgcggtacctccaggtacatattttctcatgagatggtaccggctgtgctgagagtggtggaagggtatttttgtcttttcgtgtagataagttttctccagctgaactaaccctagttcgattccccttgtgtgtggtagcggcgccagcggcggcaggtgtgtgggcgaccgtgacggcgacttggtggcaggcgcaatggtgccggttccggtgacgaggtggtggtggggtggtggcagtggttggtgcgttggctgccgaagctgtgaggtggcggggaccgcagtggtcccggccgcggtgatgaggtggtggaggcggtggccgatgcgtcggcaaccttgactgcgagatggtggcggccgcggtatcgaggtggtgtcatacccatgcctaatgtgtagtatatccatgttgggtgatgacgagtgggcccatgaaatgggatggatcccacaagtcagtgttatggccatgttataaggcaatctaggtcctgtgcacgagtcagtgaatgaagtgaattgaatctgattccactccttctgttcttcttcctttgccccctttctgttcttcacccgatcccgcaatttcttctcaaattatcttaagttatcagtgtattctgctgctagtttgtgtgattcgatctctcacgagctcgggtcataacaatttggtatcagagctgttctgatcggttctcttgctgcttgattggtagacccaagggaagggttggtgttttacgcaccgtgattctagcctaaggttcgatctgtagagagacgaggaagatagtggaaaccttacccaatggaagcatcaatggtggagtccgttgagctgcataagcagaaggcattcatggcgaggtttaaggcgaaggttgatgaattgagcgctgctgtggatcacatcctcaacaaggtatcgccctccctagctagccccctctacctaacaggcttctgttggtgctgtttcaagcctaggagcaaccacctacactgacgctcaacaagtgttcgatgaaatgccaagtaacaaagagccaaccataacaactgttcttcacttcacggtgagcgatgtgctctatctggtaaccacagaggtacttcatcaagtattagttccttatgatgtggagcatgtgatgattgtgatcgaggcggttacctatgtggaggccgtagtctctttcaagtccatctaagatgtaacacgagctcaacatgcactccatggacgctacatctatgatgggtgttgcttgttagatgtcaagtatgtgcagctatgctccagtgaacagaaggtagcaattcccaccaagtgttcgacgtccacacttgccacctcagccatgcccttgacagaccttgtaggtacagacacgtcacttatcagttacacctcaagtccaataagtgtagctgacgctcagtctagcatcaagtccattgcagccacatcctccaggctgagcaagcgtaaccagcgtgttgttaagtgggtgtcacgaatacgcattgctcgccgtcctgtgcacttggcctggaggagaaaggatatcgtgctcactcatgtcggtggtgtgtcattatttgcagaggcagcagatcaagtgtttcaagaaatatcatgtatgcttgtggatagcaaagcacataaacttgatgaaatggatatgaaagttttttattccagtgaggagttcatcactataattcccataactcacattatagatggaattgcaggcaaggtgcaaaatccaactgcagaaatgaaagtgtgcaatgtgtttacaagaaggttactatgtgccagaaatgttttcagtccttgaaattatgagactaatggagattatttattgttggacaagatactatcctggcaaagaaatggttttagaccttggaacaatgagcagtaggagctacataaggagtgcatatatggaggtttccaagaggggcatgaacatccagttatgcattgttttcgttcttgtgcattgcctcagtgcaaacatatgtttcaacttgtagtttggacaagcaatgggctaatttcagaaggcatgctctggaattcaataattcttaggattaattgcatggaattccaacttctcgactacctgcaaataaaattaaatcgggaagcaaatgtgcaaatttgggattttttttttgagaaagggagggtatctcccccgttttcattaaagaaaacgctcatgattacaacagttccagaaacatcaagttcttacagataagacgagagaaaaaaaaaaggaaaacaaacagttattacaggactaaaacattggcatttcaagcatcaaaacacaggtttccatcgtcgtcttcaaactcctcgccatcagtttagcctgcctccgtttccgggaaatttaactatttgccactcttgtgacatggcaattaacgatttgccacaccctgtcaatgacatgtgggccctcatgtgtctatgacatgtgggcctagtggcaaatcgttaagcaacatccgtaagagtggcaaatagttaaaagcccctctgtttcccatcctattctttgtctgccgcccctccatccaaattttgagtgaaagatctcatttgctacctgccttagtagctgcgccccccactgcatttttcctctgtctccctccttgctctgcaaaatactccaagagtttaaatttgagcaaatggtgtaaattatttctataggatcaacaggcagaattccatcaaagcaggctctgtttcttgctttccaaatggtccacaagactgctgtaacccccaccatgatcaacttcccattccctttgccaaatttcaaaacccacgagctaaacatttcccccacattcctgccaggcttcacattgagagcgcattcaagaacactccaactgaagtgagccatgggacaatctaaaaacagatgttggatggattcactcttgtcacagaattgacatttaatcgagcccttcctccaaccccttttgaacagattatcttttgtaagaatactatttcttagaaccagccaggaaaaaactttcaccctgggtggtgctttgattttccacatttttttagggataattgatcccctgtaatatcaaagctctgtagaaagatttaacagagaaacctttgttagacagtctccaaatcagtctgtctttttcattagttagactaacaaattccagggctctaccaatattagcccattttctctatttaactgcatttaggtctctcctgaatttgattgagcctaaccctctccttttgatctctgccacagtcacattttttgtcaaggttatgttataaagatctggagcagactctttaataggtttacccccccccccacaccaactatcttcccaaaagagggtactctccccattttccaccttcttgtcacaaaatctcaagaacagctctttgatctccattaaaccagaccaaaagtgagaatccccattcttatgtttgatttgagtcagagttttctttttcaaatacttgtttcttagcatgtcttgccacaaaccttctgtgttctccatattccacagccatttccccaacagagctttattcattacatctaaatctaaaatccccagccctccctgatctttagggaggcagatcactggccattgcactagatgatatttcctaataccttgatcttcttgccacaggaatctccttctataaaatcaattttttctctaactccacaaggaagagagtatagagatatcatataaagtgggacactgctaatgctagagttaatcaaagcaaccctccctcctattgccaggagtttcccctaccaacaccccaacttcttttcaattttttcctctacaggtttcctgtaacatcctgaaaattcccaacaataaaaatcactaaaatttcaaactttttttaaaaaaaaaacttttgcatcatgctgattgttatgattcctattgcttgccaaaccgtaaatgatcaccaagaaggtaaagaaaagaactacatttaagcaatagatatgattcatgagaatatatttaatcctacaaataattatgtgcaagatattaaaatcaaataaattaaaagttattattaacctattttataaaatattaaaatatttgaataatataggtgggtgcgataatacgagtacacatgaaatgatgatcattcaaatgaactgagctctctgtatatataatagaaatacgggagtatttaattcgatatgtagatcgattttgcaccaagttcctaattgcatttagggattgaaattttatatattaaacccctccatataaaataaactaacatatagataaattgagctaatgtgctattatgttaataacaggtctcattagaaaattatagaatctttaataaaccttaaaaacaaattggtaaaataaatataaattaaaaataaaagattaggtatggatagtaataaataaaatattatcgcgaccatatttggatcaattaaatttaattgcgatagaataagaatttaccctaattaaaactcaaataaattatataaacaaaatat

SEQ ID NO: 35656 - DNA, 1895 bp, Oryza sativa
  unsure (1)..(1895): unsure at all n locations
attctcccccaccccatctcatccttcctctccctctcccctctccactgcgccgccgttctcgtgccgccgcgccgccgttcccgtgctgccgcgttgccgttcccgtgccgccgcgccgccgttcctgcgccgccgttcccgtgccgccgtgccgccgctcctgcgccgccgtgcgccaccgtcgccgccgccgtcgtcgccgctgccgccgccggtgagccgccctccttctccctcgcgtccatcgccgccgccgctcgggtgggagagagccgagagagggagatagagccgagagagggagatagagccgggagagaggagagaaagaaaggaagaggaaaagagaggccgacagagagagaaagagagaagaaaggaaaaagggagagaaagaaaaagaaaggaaaagggaaaagagaaaagaaaagaaaagaaagagagggagagaaaagagagaaaaagaaggaaaggagaaaatagaagggaaattgggggagaaattaggaggatttaggaaataaaaatggtcggggttaataatagattatttttggaaattcctcgagcgtaatagtatttcgatcgaaattccgagttaattataaatatatgtttcttgatcagattagattaaaattggtaacaatttagatataattaataaccatacaattagatgaattcttatagattattatagattatttttggtaatctctataagtcatcggttcatggtagaaattcggattcaattactaggaatcttagccgtgtattatatttaatcgtttagtcatagactaaattaaattgtataatatttctaagatttcgtccgatatttagctcgtaatagaaatttctaacctgttatatggatataatgctcgggatgagtaaattaaaaacttatgacaacaaaatatttatacccgcaaaatagtttaaatcgaaattgggtttgccgtagttcgcagatagtaaagttaataaaaaggaatcgactttcgcattcgacttttactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacctgtattgtatagcttacagtaaaaagcaactactcaaatatatgatccaataataagatattgttgcttacacatatactatacatcccattatagtggtacggtatagtattaatttgcgtgttgcataaattaaattaagagggagagtatgacaaacatgtatattagataaataccagttataaatcttgatctcatataattatagttatagttcaactgtaaattaggattattcattgtaaaattatgtgatgggataatctgtacccataatatgattaacctgaacaactctaacatacaaagcatggataattattaaccttttataatttattgtgacaagtaaaatatgttcataattaaagtaaagcttccatcaataaaataataatacaaatgatgcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcanacacgaatagtac

SEQ ID NO: 35657 - DNA, 10128 bp, Oryza sativa
  unsure (1)..(10128): unsure at all n locations
ataatctgtacccataatatgattaacctgaacaactctaacatacaaagcatggataattattaaccttttataatttattgtgacaagtaaaatatgttcataattaaagtaaagcttccatcaataaaataataatacaaatgatgcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggtagtcgtgaggcaacgtctgcaacttccaggaggtgaaggttgatcaagattatatcaagaataaggactatcctgagcaaggcaagtcatcactattccttgaacatgttgatcctaattgcgaaattgttttgtttacaaataaaattgcatgcaatcatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaattgttttcgactggggcggctggaggatttgggtggtgtccggaaaaggctagtgccgtccctggtcaattaaggaccgagccatgaagttaagcatgaaacgacccccgtacaaccgcatttctcgtatgggtatagacctagcagagtagatagctgagcggaggcagtatccatgcatagtggtttcttgatgtgtgaggcaggggctctacggtggggcagccattggtaggaccgcgaggcgggtgtctacaatggtgtcgccatcggtaggactgccatgtgagattctaaaacataattataacttaatgcatgtgtgagtcttcccttcccgggtgcgccagaactcctctcactgctagaaaccgtgtacgcctagagtgtatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgcttgcggttattgagcaccgggacatgtattacacttggctagactctaaattcttaacttgtgtgggatgggatattgcatgatgaattttatgctgatggagccacatcccgagagaagggaaggtggacatcctcagaaaaccatgacgattcaatggcgcgaagctatccttgggatcacaatggatggtggacagaaccgtcgttgtttaaaagtgaacactggtactaaaatttgatcagtctatgctaggttttaggcttgtgaaaagaattgtaaaattagctttatgcaaaagaacctgaagccattccttgaaataccctctgtcatatgcattgttgttgtggtggcttgctgagtacggttggtactcacccttgctatttatatatcttttaggagagtgttgaagagaagcccttgtcggtacgcttgcgtatcccacaagatgatcggagtgctgtcttgttctaggtctcgttccccagtcgactgcctgtggcatgttaaccgggcccttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgagggcctacatttccaatctttgttatggattcttacttgaactatgggaacacccaaatatttcattggcagtctcccaatttggcaagtgaacatttggctgtatgagtcctgtctctcagctgcctctcccaggcaaaaaacttcacttttatgaaagttcacttttatgaaagttcacttttaggccagtcaattgctcaaaaatacacagaatgaatttgaggttttttgcatattccagagaatcctggatcaggcatatggtatcatcggcatattgtaaaatagccaccccctctctcatgacatccattcccaaacccttgattagtccctgttgctctgctcttttgataagaatggttaaaacatcagcagcaatgttaaaaagcaagggtgagagtggatccccctgtctcaaccctttgtgtgttgtaaaatagtgccctatctgatcattcactcttatggccactttcccccctttaaccactttcaagatccaatcagaccatatgtcagggaatcccttggccttcatcattttatacacaaaagaccacttaatgttatcatataacttttaaaaatcaattttgaaaagaattcctgcctgctttttttgatgaattgagttcagaatttcatgcaaagttacaaccccttccattatatatctgttttttatgaaagctgtttgattcaaagcaatcaagacttcaatcacctcagccagcctttccatcaaaatttttgttatgattttgaaactcacatttaaaagacatattggtctgaatttctgtatcattcttgcttctttgcatttagggatcaaagttataataccataatttaatctctcaactccaatttttcttttcatgaaatctgtgattagttccatcaagtcatccttaataagataccaaaaatgtttctaaaattccacaggaaatccatcaggcccaggggccttattgttttccatcccaaaaactacatttttcagttcctccatttctattggtctgattaatctctctttttcagcttcactcaacatagctatgccttccagattcaaagtaaaatcattctctgggggggggaccaaaaagctgtttataaaaatttgttatatatttcattagatcactctgtcctttaatctccccctcttcctgatccagagaataaatcatgttttttcttttccttccattggctttagcatggtaatattttgtgttatcatccccttccaaaaggtttttttctttacatctctgcatccatttcaatctatcctctcttactactttcttcaactcttcctccaaatcccctctctcttttctttccagaatagtcattccatatgcttcacattttttatcaatgtcttctatttttcccataatttcctgttttttccttttgtacatcccttcccagttcatgttccaaccttttagtttctttctcattttttgtagcctccattgccatttatcaatactggatccatttatgtgcaaatttgggataacttcagaactatgtcaatttccggtttctccatctggcagatgttatggcagaaagtaccatggcctccgcctgctcgattttcagttcatccattttggatgattctcaaggtagtagtatgcgtgcagttgcaaatcagttttggcattgcttatatgctctatttcgctggcgtgcttcctctaggctcctgcaatcctgttgtaggctttcccaagaactaatgcataaatgtgcacttgtaagctggactacgcatttacaactaattgcaaaatcttcaaaggatatgtatatgcatatatatatacttgccgacgtgatgtgcttcgtgtggtgaacgcatatatatatatcagaacagtggtcaaaatcttccatgacactagccacttagtcgtgcgttgcacgactttgaattcccgtatgaaagccatctatatatgcatcgtaattatgtcaaaataacctagccgttctcagactaccgagtaggcatgaaattgccgataagtcatctttgttggttgattttatcgacttatgtcgataagggttaggagaggatctaaaccaccggtttccttatcctaacaagaaacaaactaagagacaaatttgttttcttgtgtgatcggtacagaaaacgaattctaaactaattgagataacccccgagccccaccagtgtcgtctatataaagaaagagaaggaaggaggcaaatgacgactgatctctctctaatttcgaaccctaattaattgcccgatcaatcaaggcactggaaggggttcgtgaggcatctctagaagaagaagaaaaggagaacagcaatggcttcaaacataggtcagtagatcaattatttttccgcataagtaagaggtgattgtttgtagactaaagcctaatatcctgtaataagaactccaacattgtggtatcagagctgatctttagtccactcaatccctcataatcacatcatccctgtgattagaagccatccctaaaaaaaggttcaagattgattcggcatgaacaattttgaattagattagattaatttctttaagtcttggttgcatattaagccatgttatactgattggtctcggtcatcagtagaagaagctgtttaattcaagttttctatttaattggttatccatcagtggagattaagagaaggggattgggataaacagattgaaactcccaatttccccgcaccctaagccgaagcaaattaagaaggggataaactagattgaaattcccctaaatttagcaaaaggaaattcccaatttccgcactcaaaattcctagaccgaaactagggtttcggctagtacaaagcaacaagaattaggggataaacaagattgaaactccccatgggtaagcaaagggaataaacaagattgaaatttcccgaaaccccaataagccgcatcaaatcagtctagaattcccaaatcgaagaacccaaattttgggaagaaccctaaatcccacatacccgtatcaaaactcaaatcaaatcaatctaagctagagttttggttcacttacaagaattgcgaaacctcctaagcctaccggagcactccgggaagcggcgtcgctgccttcacctcctcgcagccgcgttgggttctctgcgcgcgccgtcttggagtttacctccaccgtccctcaccggggacaggaagcgtcggcttggcggctgccttcgggttcccccccccccccccccgccgacgaggtctggccgtagcacacggcttggcgccgccctcgggcacgccccccagccagtcgaggtggagccgctgcggcgctcgccgccacatgcgcgcgccacctcgccggaccgccgtcgcaacatcgccgccgattcgctcgctcgctcgccggacgccgaatcgggggagagaaggggagaaatggggattagggttagggtttgacccgttcagcgatttcagcggcgaaggcgaaatcttggccgtctgtttgatcggacggccatcctcgctcccgcgtcgggccgtcgccgtcatgggccgcgccgatctgggccgagtccgcctaagcgccgcgcgcgcacataggtaggccggtcctttttgggccggcttatcgataagaatgcgctttttattttaatttattattaagcccgcgaatttaatttctcagaatttacttagcccattttatgggccagcttaggaagtgatgggccgcattattattttaagcccgccatttatgtcttatttatttccagaaatttatttatgagttttcttagccatataaattgctggaaaattatggtcaattatttgatcacttagaaaattatttctagttaaatggaaccaacgggaagtttggctagaaagaaattaatgatatgatattatatttgaccaacgttaatataatttcatgtcaatatttattaagattattatttccttaagccacttaatttatttctagttgaatggaaatataactagaaagtatttatgatttcatgtcaacatcattatgatggtcatttccttagtatattaattatttatagtcgaatggaaccaacgagaaattcgactagaaagcattaagatgtgaagttatattcaacccactttattatgattgcgtgtcaattataattttttattccttagttattttctaccaaacagtgatataattgaggaattgattttaagattattcataattatttatgaccaatggtgctttgactatgaaattctaagtttattttgcatatgatcgactaagccaatgtaaattttatgcaattggcaatgcttattatttaagatcagttgcaatactgagtaatttatttctagattaatggaccaacgggaagtttatctagaaaaaagatgatttcattaagattattatttccttaattatttctgcccaacggtgatgtaattaaggaaacatctaagtatcgtcaatcattaatttcattttctttgtcatcttggcctttacggtgatatgacttagaattttacttatgccattagtgcattaattcctctgtcactcgtgccttacggtgatatgatcaatgatctctaatctgttactaagcttaattcctttaccatttctgcccaacggtgatatggctaaggattttaatttcatgtcatttactaatggctttatgccctatatcatattacctacttttggtaatttgatttaggatattgattttcagtaattcattattctctgccatttcataatcctttctaccctatggtgtttgattatgaaaattaagatttatttgtatgtgattaattaagccaatggaaattaattgcattactaatgtttaattaataattaatttttcagcattaggacagcttaaggccattcagcttcttgatggatcaaattacattgaatggagaaataatgtgcttattaacttagccatgttggattatgacttagccataagagaggatcctcccgaggaacctcaaccggccgaagaactcaatataattggggaagaatatgataatctcatgtgggcctacaataagaagttagccaactgggagaagtccaacagaatgtgcttaatttatgtcaagggtgccatctctctagaagttattggagaaatcattgactctaatgacattaagacgtatctggcaaacattgaagaaagttttgaatttgcacctgagactcatgccaatacgcttgtaaatgagatgatcactagtcattacgatggcaaaagtggtataaggaagcacatccttgagatgactcatatggcaaatcaactcagatccatggatatgaaaatatctgatggatttttagagcacatcatcatgagatctcttggtcctaactatgatccattcaaaataaaatataacactcagaaagaggagtggaccatacaagaattgatcttacactccgtggaagaggaagagcgccagaaagctggaaagcagaaggttaaagaccggctaaacctcactaatgcctttgataaaggcaaaaattctatcaaggggaatcctctaataagaatagcaagccagagggtgagcagaagcaagaagggatcaaggcctccacttcagctgttcctttaagcacaagtccctactgccacttctgtgcgtcagatggacattggcagagcaattgctcacacttcacagtgtggttagtcaagaaaggtataaatgaaattaaataaatcccttgtgatgaattttcccttaatacttagtgagtttgactcaatgccgctgtgcatgtttctaactcattacaggaaactcgcactgtccaaacggtagcaaagaggggagtgaacactcagagtaactgatggagtgaagatgaaagtgaagggttgttggagacctcacacttagtttctccagcagttgcaataatgtctcatttgttcactctattaagagaaactttactagtttaattatttaaagtcatgtgagaaacgggtcatgtctgttatttttccaaatagaacatgatatattaagtgtgataataaagtgattggtcttgtccttgtgcacgacagtcatatttgttcttttggatgaccatgtgactattataataattgtttgtaatgacaaaagatgagacgtcattgaaattgtgacattgtcattgatgtcacatttctaggggaggttagaacgtctcataagttggagattttctttcccttggattaattttaagtaatttaagctttaagggaagcttcactaagttaagaatttagccaataaataacttttggctatgtttacccataaggctatgtttactcataagcaacctccgatttccttcaagaaatttaagattgaagatactaatgctaaaataaaatgaagttatgagatcggattatggtggtaaacactaaataaagcttgttcacccgatgaagacattaaaaataagcgttcatccaaatggttttcgaaccatgtaagaataaattgagattgatgaacaaaataagacattaaagtgttcatctaaatgttttttcgaaccatgtaataaagaatttagtaaaagtttctaaatgagtcaaaaataggccatttaagtgggttaataaaattaagcctgactctaatggaaattttcgaacaattcaagtgaggtggacagctgcatgaaaattaaaggtgggaaatttcattcaccggtactctatactaacgacattttattgtcaagcaatccatattgatgttagaaactaaggaatttttccatgaattattttggtctgaaggagtactgggcttatatcagtaagtcatacattgacataaattaaagaaataatttgagagaattcagttaaagttagtcaagctgagattaaattctaaagttagactcagctgacagaagcttgagattagttcaaatctggatgcatacagatttggcaatcattttgctgggaatcttggcagtattaattaaatccagactagacggccactggtattaagaaagttttgtattatctgcaaaacaattttaagtaacatgctcatatttctaaagtccaatgatctcagaagtttagagacatttggacacttattttgtgagatgtgtggatatttataaagattattaagttaactaagattaagctatgtccacacataggggagcaataaccatggaaaagctccaaaataatctcttactgcatagtcgacgatgcagttagattttaaagcatgttatgattaatcataagaatatttcccagaaataagagtggtaaatagcgctcataaaccactcaaaaggtgtaaaccacccaaaatatactgtgttataagttgtgcactaattgaacacagttttttattctagtagcgacatgttgtgtgttttctgcctaacacattggtatggttgtgaaagatatgtcccaggatcgaattattaagctaagcatgtgctaatggatccatactctaaaggctcataaattaagattaattaagattatgttctggccagtacatatgtaaattagagccttactaagatcctggatgagggggacttaatttttcaatcagcacccactaagttaagcttgagtttatttgagtactatagtgagctataggtcttgttgtctcagtgacgcataatgttgttgaagacacattgccttggggagctatnnnnnnnnnnnnnnnnnnnnnnnnnnnnnnnnnnnnnnnnnnnnnnnnnnnnnnn

SEQ ID NO: 35658 - DNA, 8222 bp, Oryza sativa
  unsure (1)..(8222): unsure at all n locations
tgttggttgattttatcgacttatgtcgataagggttaggagaggatctaaaccatcggtttccttatcctaacaagaaacaaactaagagacaaattcattttcttgtgtgatcggtacggaaaacgaattctaaactaattgagataacccccgggccccaccagtgtcgtttatataaagaaagagaaggaaggaggcagatgacgactgatctctctctaatttcaaaccctaattaattgcccgatcaatcaaggcactggaaggggttcgtgaggcatctctagaagaagaagaaaaggagaacagcaatggcttcaaacacaggtcagtagatcaattatttttccgcataagtaagaggtgattgtttgtagactaaagcctaagatcctgtaataagaactccaacaatctttccaatgatgagcgaattaaacttattaagatgagacagaatagatttaccttctggtatgcgaattgtgtaccggcattctttaaggcataatttgttggcaagacttttcttcatgcctactcggtagtctgagtatatgaaagccatgtatataatcatgaaatttcagttgattaagtcatctagacttggaccaagaagatcaatcaacatgatattattgtactccccctccaccccaaacttcagatgaggacttccagctgaaatttgtaaccaaaactcaatattaaaatgagtgaacaaatatatttgaatgaataaaaaatttctggtagagaggatatcagtctctttgttcaccttttggaaatcacatgcaggaattgagcatatattacggaattcttaagccatcagctaaattctaacctgctacggattaagatttatttatttgttgattgactggtaaagagtaaatcaaattctgcacggtatatgatggctgctaaatagtaaatcaaattctgcacagtatacgaagactatgccttgcagtatattaataatagcaattctacggtccttgaggaggtaccatgagataccaaaaatttagtgtaaaatttggtacctcatggtaccttatagtacctaggtacaaagagttaccaaatttacaatagaaaaagtggtacctcatggtacctcctcaaggaccgtaaaattgctcattttttctattatatatccataccaattgaaaagcatttgggtagtaactttctattatctcggtgatgactgaagggttatttattagatttctgtactgttaaactgtatccaaatctgaccagaacattatctttatcctgaaagaatacatacagtcatctttatcctcgatatggcgtttctgatctgctacttgccttcccccacatcgtactgcttaagtccatgacccccatatatatcttcaccattcacggtcgtgctcgtggagtcctcgttccgatcgtggccggcctcgcgctcccatctaattatctcacgatcagaagagaaagaagtgtctcgtttctatcaggattgagatcgtacgaatatagggaaattaccggacagacatggatagatagatacgatcgatggcctatcatgtacagtatatggattgaacggctggcacattgtagttagaggcagagcccgcaacattagtgtaaaatcaaatgtgtttttgattattattctatgataaacaattggcattgaagattgttggttttggtatttggaatttattcacgaagtggttttggagatgattggatttcacaggtgatctacagaatactgctgaattgcggtccggtcaaaccgggctagtgcggccggtcaaacctgaggtatatgcgtggtcagaccggcgcagcccgcggtctgaccggccgacgctatgtcggtttcggtttcggattgtttgtttggatatccgtgattgtttcatgattatggcttctagatggatactatacgtatgtaatactgttgtttgttactaatgagtcaagttggagatagcttggtcttggaatatgatttctttgtttatttcatgtgtaggtgacttgatgccttgggagagtatttgcggtgatggaccgggagttggcttggggataagacgacgtccgtggtggtcagagatcatgcgggatacttaggctagagttgatgcacatggttgatggagattccatatggcatacgatggaggtattgtgtgcgtatgggatgcggagtcgaatttggaaggagtccaaatttggtatgattggttatgtaaagtttgtttcttgtactagatggtttcctaaggtgtttaggacttctagtatgagtttggttcgtggctttaggctgcctacctcgggtataaatagagggagagcgtgaggcttcccggtatcgcttttgagagcaattgagttgagttttgagttagggtttcgagtttagtcgaaatttttgtaaggagtgttgttggtgcactttgtaaacacagagagaatcaataaagtcgtcatctattttaagagttcttcgatttgtgtttcaccgagtttcggcggtctaaccgacgactcatcggtggtcagaccggtgggagaaaggcggtccgaccggcagcggcaacaggcgcggcaagtgatctcggtggtcagaccagagatttaacctcggtcagactggcggctacacttcggtcagaccggcagattaatctcggtcagaccgatctccgtcgaatttgagggtaacttttatttccgctaaaagttttcggtttttgggtataccaaccattcacccccctggttggcttagctcttgtgtttgatcctacaattagatcattgtaggatatacggttctgattatatgatttatctagtttttgatacacaccgcaattggccataccggcctatgccagggaaggggaaaaaaacaaagtcaaaaaacaaggaagagaaaaaggaaaaagaaaaactcgaacgctactccaaacaacggagtgggcagagccacgctacactcccaacaagtccccaaaggaagcaacgcccgctaacgaccacaaccggccctccgacaggatggactcttggaccattgagaccgaagagagcgcggagtcaaacaccctggagttacgttccttccatagctaccacgagaccaggaggaccagggagtcaaagctggcacggaggtgattaggtaaaccagccttggaagatggccaccagtagggatggcaatggggacccgaacccgatacccggcgggtaaaacatctattaggagctgcaaatgggtcaattttcctccccatggggctcctaacggcaaaaaactccccccgtcgggtgagccggattcgggggcgttccctcccagaatttgtttcgtttttagattttttttttaatatttatagaaataatctatcggcgagaaaaattgcaaaaatagaccctgccgcccaccattggggcggcaagctgacgtggcagacggtgggtagaccgcgccgtctgctgccgtcggccaaaattccgattaggcccttgccgcccatacagagggcggcaagggtctaattgcaattttggctgccctccaggagcttgcggctgtactttttgcatctgggtcccttgccgccctaagatgtaaaaagtacagccaaaatatttttctatgtaatgttaataaaaaataaagaagtatttgttggtaaaacttgttaatattgttataaaaatgtattgaagttggttgttgcgcaatttcatatgttaagtgagatattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttcgattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcgagcaaagttagtcaatgttgtgagaaaataaggattaatgtaatcaaaatattcttaccatgaaatcgtcgtcaagaatatttggacaaacaaagaaccttcgacccaatgttgtaggatttacggaacgaagaacctgacaacgatcaccacacctgcatcttggacgggcttcccatggagggagtgccgtagttagcacccgccagtcgctctgttgttcacgacattgtcgttcataagccgcttttctctttaagtattgctcagtactttcggatgcgaaataccagcgaccttcttgtaaacaagtggttaggtcaagaacgggattttctgtatcgacccactcgatgtatgcgcaagccgtagtgcggatctgccgaatagagtagtgttacgaagaaaaaagcgattgcccatacggaatgaataagcatttgcagataataaaatacctcacggtcatagttagggcacctaaaaaagcaccttcctcgaatatcaagattcctcgaagccattagttggcatcgatcaccgcataggcagagtggacgctggcaccaaggtggtagtaggtatacacaaggatcgctgcgccagtttggatcctcaacaccccggcgtcaagccattgacgaaagccggtaggatttgtagtgaagaagtggggaagagagtactgaatgtgactgagttctgaaaaattgtgaggcctcactcgttaaggcgacttatatatgcgcaaaaaatcgagtgatatccttgacatgtgaacgtggtggggcatggtgggtacgcctgattggcgccgaaagttgcattcttgatcggcgtcgaaagttacgttggtcgtatgcagcaaatggcgggcaaatactcgtagagcacgcgaataaaggaggctgcatcggtgcgggagaaagtagtcgtgcatgcgccgaaaggtatcgtgcatgcgccgaaagatatcgtgcacatataacaacaacgtagtcattacacaagcatacagtactggaaagtgaagcaaataaacaaagagaagactgctctactggccctgccccgcgccgcgaccacgcttggtcctccgggcctgtgctcgcacgtggtcctgggagtaggtgaaacgatccggtggcacagcatgggtagcacgagtgtcaggtggaggagtggcctgcgcctggtcctgcgtctgcaccggcggtgcgcctcccagctgtgaggggccgatgacgtcctctgccgagcctgaagcgaagtcaaagtcagtgatgtcgaagagcacggtggaagacagcaagcggtccgacgaggtcccagcatggtccagtggtggaccctgactcgacgtgccggctgcctgtgacgaagccccagtgtactgctggaactacgctgagtgcgaggtcgacgcagctggctgagacgctgaccctgcagcgtgggagaagtaggcggcctgcgtcatagcgaactgggcgaaggtggggtgctgaatggtgcacgaaaccctgaatcaatcggcaagtgaaacggctcacatatatgtgcgaggcatgtacagaaaaatccttaaaaatacttacctccgtgcggagggggagtcggcctaggaacgtgcgcagctggacggggaccagtcggtacgggtggccgccgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgtctaaacgttggatcgtcgttgaaccgtcaacgacgacccggttgatgtcgtcgacctgcatggttaatttgttcatacatattcgtaacatttgacgatgagaaagacataaaaacataaaggaatggtgcgatgcagggtactcacacaacgagcgaagtcctggtcgcggtgcctggcgtagaggtctctagtgctcgcaatgtggggctgctgctccaagggagcgaaggtgaccctagtacgggtgcgtggctggtaccagcgtaggtaggcctggtacgcctcctcagtgtgtggctctccctcgtgctccacgacctcctcggttgcgagcaaccagtcctcaacaaaagtcgccaacttggcgggccagtcgccagctaactgctgacccttccgcgtgtacctgcgaattaatgtgtaatattagtgtgaatcgagagatgttacaagttattgtgaacaggtacattttaatgcaataacggaaagcgtagtgaccgatcttaccggtgaacagcagctgggacggtcgtcggaaacggtactggaaagggctgatggaagccgaactgccgcatcacgcggaaaggggcgtgaggctcaacgcagatgtcgaagaccatcggaaccgtagtcatccagtacgcctggtccctggtgtagagtgtgcacagacccaacggcgcacgagcctgggtagccgcggcactgtagggctcccacacgacgtcagtcagcaaaaggcggtcgaactccataacaaactcaggatacgaccgcctaacctggacgtgagcccatcggcgctgcaatacgagacgatcgatttgatgtataatgaactgagcaattaacttaacaaagctagaagatcgatgcaacgtacctgacgacggcaccacagagtacccatcgtagggtagtcgacctctggtcgctcctcgtacagtgactcctcgtacgcgtgctagtccacctccgggcggccgatcgcaatcctctcagctgcccagatagaaagaaagagagggcacccaccaaaggtcgcgctgggatacgtcttcgtgcaagcctcacaaagtccacggtacagagccgcgaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacagcggctgtaggagtactcgtcggcctccgcctgtagctgatcgacctgcaagcgttagttaaaatgttaggaaccttaacatgtggaataaatatgtagtacgcttgtcatttcggtacaaaagcactcacggtgaactgaagcagccacctcttcgtaggtccggtgttgcggtggtgtgccaacggctggagcggcaggtgcggtgcgcgctgtactagtgcgaaacgtgccgtcagatcgtcctgccagtccacagccgtggtcactagcccaacagcgtctcccgcgagcggtagccccaacaagtacgatacgtcctgtagggtaagggctacctcaccgcacggcaagtgaaaagtgtgcgtctctggcctccatcggtcgaccaaagctgctaggagggacctgtccacagtccatcgtctggccgggtccgcgtggccggcggcagcctccaccagccgacacatcggtaggaggccggcctcacgcagcctgcaataagaaattaatatgtcattacaaaaaatattacagcgcaactaatttatagtaatatactgttcatacctctcgacgaaggagtcgtgaaccgtgagtagctcaccgcacgtccgtgcccggaacgtcccaagctgagccccctgcaccgcagtaaggtgagaccagtgtcggagatctatcgccgggtccaacagctgaggtgtatcctgacgtgccatctctgaaaaatatagtgtttcgtgttagaacaattcaaaaagtagtaatgtaaaacaaaagatgactcacaagttaatgaaatagtaaaaaaatnnnnnnnnnnnnnnnnnnnnnnnnnnnnnnnnnnnnnnnnnnnnnnnnnnnnnnnnnnnnnn

SEQ ID NO: 35659 - DNA, 3493 bp, Oryza sativa
tgttagaacaattcaaaaagtagtaatgtaaaacaaaagatgactcacaagttaatgaaatagtaaaaaaatcatgagaataattacgtacaacaagagtacagcctatttaaataaagcaaacgttactaatggtacataacgatgacgtgcaatttaacatatatgtagagttcgataatataacataacataacataacattacgtgtcgaagtccgacatacatcagcatacctaaagacactaggtgccttagtctgacgttacatcacgagacctaaagacataacaagccgaagtctgaaattacacgacgaaacataaacacatcgataagttcgaaacaaattacaagcaaacccacatgccaacatagaacataagaactacaccatgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatattgttgcggaagcgacgagtcctcctccttccagccttgcctcggagcttcgatgggtcaggaatattgagtacttcatcgttagtctctatgaactccccagctatgccgaacccgtaaatctcgccgctccatgtatgatatattgcttgcttactgaagtactgcgacacatatactgcatctggtatgccacactccgctgcggcagcattgacatgggtgcatggcctgtggagcagcttcggctttgaacaagagcaatgacatgtgccgtcggctttgagaacacactcctgcttcactctcttgcggtagatacccctgcctgccttatcttgacatagtatctcgacccctatgttgttgggtaccatgcactagagctcgatgtttcattgcctttttacgcaactcctctagctttttatgcatgaaagttccaaacaaaatgctgttgttcggcatagagagaagaactgcctggaaccgatccctaaaatacctgcatgtcccatgtaaaataaactccactatgccaactagtggcagtccacggacaccgcgcatcacccagttgtaaacttctgccaaatttggtgtcattattccacatctagcaccaccggtgtcatatgccttggcccatttctcttttggttcatgcagaatccactgagaaaatttccgaatctccaatccagttcttctaaccaaagttggactatccgttgggagaggtccaagagcttgaggatggtcatcaacggcagtcgatggagccgctacacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcgtcccaaacaccagggtatcctcgttccatgctcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgtcagtatctggccccgatactttcctgtcaagaatgtcccatcaatgcagagaactggacgacagttcacgaatgccattttgcatgcatgtagagctaagaacgttctttgcagcacactcttgccaggatgttcaattgatgggaatttcttcacttcgtaagagctcccagggtttctttcctcgataacaccaagcaggcgtggcaaattgtcatacgaggcttcgtatgttccaaatctcatctctattattttctgtttggccctccaggccttggcatagctaatagtatacttgtatgtctcctcgatgtgtcggattattgaccttggttcgtatgtgagattatcgatgacatgcgcatacatctcagatgcgacaaatgcacatgtaatgttcctgtggtatttctgaacaccaggtagaaaacatgtatgcttgttaacgactgacactgtccaataatccttccatttccccttatacgtgtgcactctccagggacaaccatctttttccttaacacaccgaacttcatattgcgaccggttggactaggcaacccaaaactctctatgaagtgacactgcaaaatattttaccgcctccttcatatcttctgttctactataaatcgctccctgaataacctcattttctttgtactcccatctcacactatcctcttcattgacgatcagcccaaaaaaatcctgactagcccattctgctggattaatatccgtctcctcatctgacgaatcaccttcctctacacgctcattgtcagaatcctccctctccatttcatccacaatggctgcgacagtctccccctcgtcggccactccacctggttgaatgcccactggagctactacgcccccgtccactcctgcgttgacctcctccacagaagtctcatttactttagcgcttggtccctcgccatcatccatgttcatctgcacacctggatccttcgggtgcacaaacggaaccaaagctagaggccacccacgttgcattgcattttccacataccatctccacacttgagagttttgaactggtattagttcccaataaaaaccctcagttgcccgacttactataacattgattgttatgtcacttgtctgtggatcaactctcaagcccctcattaatcatccttttatagaaggtacactcctctcagtcggtctctcaattcccctttctgatacaataaaatctgacagatctaccccagttggcccgtaacggacgtttcctggtccatggtaaacttggaatattggtttgttcgacatatctgtcaacgaattaaatagatcatattactctttcatacaataaacatctacaacgtaatatcttcttgtgtaagccaatgcaacggtaaagtattgattccaaactagcagatctacgttgttaccgatatctacaatacgcacttctaaattagtacaactaaaaccataaaaatataatgcatttattcaaacaaattttttaaaaatacacactatttaactcaatagtcacatataggatctacgaatattacctgaaatcggcgtctgaatccggcagggcttcgccccttcgtctcttctcctcccctctcttctttttttttcaccggatttgagaggtgaggaatgagggctgggggctgggc

SEQ ID NO: 35660 - DNA, 2346 bp, Oryza sativa
ccccaccagagggcggcaagggttttcatgcaaaaaaacccaccctccgtcaccgcccgtcctcccccgtttgccacgtcagcttgccgcccaccattggggcggcaggatctatttttgcaatttttctcgccgatagattatttctgtaaatattaaaaaaaatctaaaaacgaaaaaaattcttccctcccatacacccacgggcccccgtgtattgcaaatatacacactaacacacatctttgtaggccacacaaaccagatgaaagcccaaatactaaagcccagttacttattcacacatatacaatacactagcaaaaaccctaggtcacactcgagaaaatggacatttggccacgttcacaacagggtttcgctattatgccattctcaaaacgtgattcgataaaatgccaatacgaagtacacgcttaccgccatattgccatttgtgccattttattcatttccgaaatgattttagctcatccgcccgatgataagacggaaatgcccttgctttgccaccgcatctcggctaccgccattggaccgagagaggaaaggtggcggcatggactactactgggagagtcagggcgcccccgtgtcggaggacgctggagcggaagcagtcggggagcgaccagagaaccgcggaggagtgtgagtcggtcgccagggtggcgcgaggacagcgtctcgccgacagcgagcgggcctcgcggttgcagccatggaagatggtgcctcctcctccccctttacccgcgcatcaccaccacttcctagtccacctcgacgcgcagtgccgtcaccaccgcctcccacttcaccgcatcactccctacttaactagtactactagtactccccccagcagcaagcaagcagcagataagcatcactccctcccactccaaccaccacatcaacatcagcagcacatcgatcgatcgccatgagcgtggtgatcctggacgggtcgacagtgcgtggcttcgtggcggacgacgacgccttcgcccgcagtgtcgacgcgcgcttcgaggcgctgaacaccaacggtgatggcgtgctgtcctgcgccaagctccgccgcgcgcttgagtccttcctactcctctacggcgccggcttcggctccgcccagctggccccggtccccgccgaggtctccgccctctacgactccatcttcgagcagttcgacgccgaccacagcagcgccgtagaccgagccgagtttcgcgaccggatgcgctgcatcctcggctcgtagctgctccaggtcgccgttgacgacgaggggggggcttccttttagtgaagattaagcttcctaatcgactccgtcgccgacgagcaaagatgagggggagcagacgacgagagagaggaaagcacacccagccggccagcaggggcgatttcgtctcatcaagccatattccagcgaaaatgaaatcgaaaatggtgaaaatggagaaaatggcaaagcggctatggtggcgcggttcatattggcattttgaagaaacacgttttcagaatggcattccagcgaaaccgtgttttgaaagtggccaaatgaccattttctcgtcacactcacacacgagcactcccgtccagatccaggcctcagccgcgccgcctctaggctgcatcgacgttgtcttcaggccggacggcgcacctcaccgagctccttccgttctccacgacgacggtcgccggctacatcaagccgtcaacgccgtcgcgcgcctcctctaggtcgcgccgctcacgcctccgactggactacatccgcatgcctgtatctgcttggcttcttgtgttcttctttgtcctgtttgttgcttctctttttcagtttttctcatgttgatggcttgatgcaactgatgcttgcgaacagaatcgtgtagcttgtgattgactgatctgtgtttgtggccgactggccgtgttcatactgttgtgatttggaaagattcataatattctctctcgatctgttgcttctagtttttttctacaccaggtgcgcagccccgtcggagccccgtggcccccgtgggtctcggggacgggagaaatctagccccgacgccggggacgggggcaggttgcgggtagggatggcaacggggccatccccggcggagagtgctcccccgtccccgtccccacacagtcaaaaatcacccgcaacctaaaaaaatcaaatacataaatcctaaaaaatacacacaaatcaaatacatcgcaaatcctaaaaaacacacacaaatccaatacatgacagattatacatctcaaatccatgcaatg

SEQ ID NO: 35661 - DNA, 13770 bp, Oryza sativa
  unsure (1)..(13770): unsure at all n locations
nnnnnnnnnnnnnnnnnnnnnnnnnnnnnnnnnnnnnnnnnnnnnnnnnnnnnnnnnnnnnnnctgtccgcgcgtggccgccgacaccgcccgcgcgtggtggctgcttccgccgtcgtcgctggctcgccgcccgcgcatggccgccgccgccgccgcccgcgcgtggccgccgccgctgtcgtccgtgcgtggcggctgggtggggtgggaagggaaatgaagataaggttagagaagggaatagatgaggaattagggttagactagatgggccttttgggcttataatatgctagttattaatagtctaatatgtatcctccggggtcccgcgggtcacccgcgggtggatgtcctcacccgcccccgcccccgcccccgcccccgctcatgaccggagccccggccccgactccccgcaggttgaaatccacacccccccccgtaggggcgggtcccttgcgggtccccggccccacgggggaatttgccatccctagccaccgaatgggaagtgagcaggggtagaagagggcagcaggagttagatctgtgaagaggatagggatcggatctatgaagtgtaggagaggataagggatagggattatatactacgtattaaattttagtcccggttggtgagctatggtgtttttaaccgggactgaagatcatttttagtcccggtttttatcgcgatcgggactattgtggattttggccgaccgaccatagatggtttctccaccagtgatggctacggagcggaaaggaagattgaagtgcgccagatgggaacacgtgtggaagccttcgtaccgttttaaactcgaacagctgagcatgcttggaacctcaacggccgtgccatctatgatggttgttgctggctggacatccagtgggtacggtgcagccgctgaacgacgacaacaccaacaataccctggcaccagcaacaacccttccctagatcgcccaaattcaacaaccatcccccagatcacgaaggaattgaaggaagaagtgttggaactgaaggccatgttgcagatgatggactcaatggcaaaggtggaagaaaggcgttcaaagcaggctgagagacgtagcgaagatgcggtgattggcacggtgctttctaggccagccgttgcacaatcaactccgcaccgcactccatcttccctgcgccccgggcaaagcaccgtcttcaaggggccttaccacatgcgacatcaagcaaaacgaagccttacgtccatcgatccaatggctgcctcaacaacgtcgctccagtccgcggcggcgacgacgcagaggacacaggcgagcctccacctcgtgcttggccatggcaacggcagcgccaccaccatgctcgatggagtcggaggcggcaacgccgactgatgcggcggggtgggtctcattgcagtatctggttcgttggaggcgacgcaatttccgggagacgcggttcggtttctttgggcagcagcgcgatttcagggagaagaaaagaggtcaccgcgagtgcgacgcagctccatcacctggcgctggaggtgcggcttctgcaggcggtgggaccggcactggcgcgattccctggcgacccgagagggtgcgcgtcgcgtggcggcgcctcctcgtcccggatggcagcatagatcgatcaggctgacttatgggtctgtgggctcatggtcatagaaggaaacaaggacctaccgctaataaattttgggtctactagtatgatgcccgtgcgttgcaacgggtcttaaataacatgaaaacataataaacttgtgcaatattgttctgtaaatatatttgtgattacaataatagttactctcaaaacattcaaatgatgtcaatcaactataacactatgaattgtacaatctaaattgcaaagcatatacaatggatttaatgattaataatagattgcctttggggagggaattatagaaagtatgcaattagaatatagtcagattgtatggcaaacaaaattttgcagttttatggtttggatctaaaacttgggcttgtgcaggcctgcgttttgagataaattaagctagtaatgtgtgatgtcatacataaaatgttctggactttaatagtcttaaacttgcacatgtattgattctgaaatctgaacatgggcatgcaattttttgtcaacctatctgcacagatagctcccatcctctttgaagtaagatctgacgatgatatactacagtgcatctatcattgcatattagttgtataacagaacacaggtgaacatacaactgcatggatcaacatcctcccgttcaccgagatgatctccaagctttatcaagtcccacaactgaagatgtccaaatctagcactgcagcttatactatacctgtgtatcacgtgataaactatgatatatcagattataacatcggacacaattgtttgagggaagcaaaacaaaatagcaaatccaggattcaagggaaaatcccgatacagtagagcgcaatgatgctatttcatctgggctaacaccagcatccatgacttttaacccatgaacagaggtagaccagctcaaatttacagcatatcccacagtctgattaaatattttggatacataaactcctgcttatatcccattactccaagctgattttagtgcatgtgtttaaaaccatgaaaataagaatcaagtcaaataataaccatgaatataattttcaaacaatcacaaaaggatcttgagtatagtacatctatgtaagtgttgttcttgatagccggccctttcaccgtgatagcaagaattgatggcaacatagattttattttataaagcaacaactaagagtttttttacctcaagcagtggaggcagccattcattaagtttcagaagaagcacaagtacacgcccttgtttacctaagtattggagaacaatatcaaattcatcacaaagaagaaaacaaagtgcttgtagcacccccttcactaataactatcgacatagcaatgtatggaaatgtacctcagtaataaggtagaaattttattcaaccagcttctcgttaaagttcctcacctccatacttgattaccgagaaatcagatgcctgtaaaaagcaataaatggtcagcatggtcaaaatctcttatcaaagcaaaacactataatgaacatatagtgggcagactattgttctcatgttgacctacgcctccacaccatgccgccttatatcaaaaaatgtattcatttgtacaacaattgtgcactacatttttgggaacatcaataagatattaatattaccctcattcaattcatatccacacaaaaaataaagaatctctgcatctctttaacaaaatgattagctgcttgctcatcttgttcttgtaaatagattatgaaataggaagagaactgaggatatacaaaatgatatgaacatattaatttagattgcagcattaaaacacactatatctagtgttgtggctgacaataaccacctaacatgtgccttatggaattggaaacaatgaaccaatgagatcaaatcagtggtggaacaaaattagttgatcctaaacagttataagaacaaaactatatataaattattacttctagaagcaaccaagtatgcatactgtcagctgaaaagagttcattactaaccttggatattattgaaagcactattcagaaaaggttaatcttttaagtgaggatggattatagttggactaaccatcttcctttgtcattttgatacaatatagtttaattgttgttgatctactgtgtcaaatatagtgcatgcgacatcatgtaaagaatacagccttaccctctgagttgtcattcaggtaatttctcatataattctattaggatgattttcaactttacgtgatgcatcaacatatattaattgttattttgaagataaaacatggcagcatatgcatttagcagaacttacctagcactatattatattggagaggtagatggcatgagggatgagtctagtcgccaaccaagtcgcctccagccgggatcgattcgcagtcgccggggagagagtggagaggcgatacggtgtgcgacggtggtggaggtggtcgaaggggagagagcggagcggagatgcggaggaaggcgcctactttgaagctgctcaatcaatttatccctagacaattcagaggaaccaaaataatcaattgtaaactgaaatgagattaaaaaaacagtgcacatggaaacactcagacatatccaaggagtggatgctgtagcagaaaaagacagattttataacgatggcatcaaatgtactgacaaacatccacatatgaaatgtattctccatcagctcaaattacctcaatactggatagaactatagatagagacgcaagaaagcatgcattttttttccgtaagagacagatgaactattcagatatatagggaggatttagcactattagacggtgaaaccaaacaatgtccatcagctttaagttaggttggacaccataccaggtggaggtgcaggggaggggggcagcgggtggctcccgtcgatccatcggtggcgcaggtggagcggcggcgcagccaatggaggaggttggttgtgtggctccctatgacggcgcaggtggagcagctggcagctcccgtcgatccggcggtggcataggttgagcggcagcgcagccgatggaggaggtcggagtgcgtaaaatttcaggtcaacgcattgtccctcatctgccaagcaaaagcataaaaacttgaatgtataatataagcagcaaaactgaaacaaagatagaaagcaatatggaccatgagtatgtctagataacagaggaacctactcagatttgctatttaaatttggttcagataaatgtctagtacaaataattaagaataattaagggaggcagagctgaggcaagcattagttaacaggttatttctacttgattgcaacgtcagtatcactacgaagaaatgctcaacatcgatagtgagctgtgcagcccagcatctcagaaatcagggtacattcaatttcatccaatggaaaatcgcatcagtagttcagtatttacagccgaaccttagatttggaaataacagcctcaatctcctacgggggaaatcagttactctatttgcttcaagtgactttagcatcagtctcacagaaatcaacaaggcacagatcgttcaagcgtaacaaaaccaaagctattgcaagaacatagattgaaactaaaagggagagaagatgtaatctagggtttgggtgacaaacacacacctcgagaacaaacgaatcaaaacttgtcttctcgttctcaatcctgctcctgtgaggaaaaaaaattgaacacccgattaaaaaaaagcaaggcaggaggcgcctcgcccactccaccctgctcgggcgacacgatggcgagacaacactatggcaagagcatccgcggcggcgcgtgaggggaggagaggaagagattagggtttggggagggggttggcagcggcgttggcggtggttgcgggtgggcagcggcagcggcagcgtcgccggctggggcgaggtgaggaggcaacgcaggaagcgatcgcgggtctggagaggaggccggcgggcgtggctggtgaggaggcgacgtgacggcggggtgaggaggcgacgcagggaggagggtgcaggagggggcgtggggaggagatcgatccgagaaaggagcgagcgtggggaggagatcggtcgttggatgtggcaatcggatggtcaagattacgcgtgtctatcagatgcatctgctgtgccaggaatcaagaccactactacagattttttaagtagtagagatgacagacgtgaacgtgggctacatactctcttcgtccccaaaaaaaaagaaaaagaaaaaacaaattgtctccaatgtttgatcgtccgtcttatttgaaaaaaatataagaaaataaaaaagacaagtcacgcataaagtattgattatgttttatcatctaacaacaatgaaaatactaattataaaaaaattcatataagacgaacagtcaaacattagatacggaaaccaaggtttatctttttttttttttgactgagcgagtatgttgcttactatgcctgtttgtttgggaaaaaaattactccttaaatgttccgtgatttctatattaacaaaatcgtgatttctacgtcatcaaaatgtaatttccgagcctttttcaaaccgtgatttctatgtcatcaaaatataatttccgagcccatttcaaataaaaaagtaagttctaatcagctaaggcatgttgataaaatttagtaaaattacttgcatattgccctagaaaaatcccatgtatattactccatccattaatactcgtagataacactgttgacttttgaacatacctttgagtattcgttatattaaaaaaaattatgtaaatacataatatataaatcatgcataaaatatttttgtgataaaacaactcctaacaaaataaataatagttatgaaaaatttaaataagataaataattaaatatatatttaaaagttaacgacatcttctattaaaaacgaacgtagtatcttatatcaaaagaacgaatgaaaaaaaaaacagccaaaagatacggctcggtgagattggctcgactccaaagatgctctctcgctgcagtgtggtgttggacacgcgtctctcatgcgcgtggtgttgcacgggaggtcttgtgcggcactgccgtagagaatttttttccgtttgtttggctggccaagaggagttaggctttttttccgtttgtttggctagccaagaggagttaggcctggtttagttcctaaatttttttcacaaaaatatcacatcgaatctttagacatatatatagagcattaaatatatattaaaaatagactaattgcatagttaggaggaaaattgcaagacgaatctttcgagcctaattagttcatgattagccataagtgctacagtaacctacatgtgctaataacggatcaattaggctcaaaagattcgtctcgcggtttccatgcgagttatgaaattagttttttcattcgtgtccggaaacctctttcgacatccggtcaaacatccgatgtgacacctaaaaattttcttttcaaaataaaaaggcccttaatctgattgttaagtacgtaggctaccggatcagctcttttttggttactaggccacggcgtggccttgttctttctctacaggcttctgggtggtggaaaagctagttaacgcgcgtgccggcggcgcgcatttcaggcccacaaggcccagcgccgctgcgctggcgcgcgcctcctccacgttttttttttgttttttttacctttttttccttttatttttccacttttttctgtttttttttgtctttagcatgttttgtgtttgaaagtttttaatttttgacttgaaaattttcaaatctgaacttcagagtttttaaatctcgagttgaaagttttcaaatctcgagttgaaaattttcaaatctgaacttgagagtttttaaatctcgatttgaaagtttttgaatctcgagttgaaagttttcgaatctcgagttgaatgtttttgaatctcaaattgaaagttttcaaaattttcaaatcttgacttgaaagtttttgaatctgagttgaaagttttcaaatatcaagttgaaagttttcaaatctgagttgaaaggttttaaaaattgactttaaaatataaaacttaaatcgaaagttttcaaatctaacttcaatctgttagtaaagaaatctccaaaatctttcctaattagtacaattagtgttgagtatattaactaatatagttatttaacactgcagggggaggagtgctcgctgctggcgcacacgcgccagctagcagccccctctgggtagggccctctgttttctgacaacaacttgtattggtgctctaccataatattagatctatttattattttagttcacaacaatatagcaagctgagatataaaaggcttgaattatgttaggaaattatctacagtttgtgttgcagctcgaggaatagctgctcaaaaggaggggtataatgtcatgggcattgggctagaaggcaaatgcccataggcagcctatatcaattaagttagagataagattttccttaattagaggccaggctataccatctatataaggattgtatctattatcattaagtaatgaatatcaattagtctaatctctccctcccaataatgttcttttctctagcctaaatctacacccttctccaggagccaatgccgcctggctatcctcccggtggtagatatcccgtcatgtcctcgagtcatgacagtaggacataatgttactatagattatgcttatttgtgttctttaaaaaacaacataaaggctagaatccatgcaaaggatccgatgctgtccagctatcctcccggcggtagttatcccgtcatagtctcgggtcatgacagtaggacacaatgttactataattatgcttatttgtgttctttaaaaaacaacgtaaaggctagaatccatgactggtttgttaatgtccattgtccgatcattgatactgagctttgactacccgtaaccctccactgcaaatagcaattggaacagaaatgcccatatatgcgggcattcagccggcttgcttgccaaccagctgaatagttctgattatttccagtaagacagttacttcagccttgaatgagacagctaatcagatatgtgttcttgtaaaatggaggacgttaagctgaaattatgcaacaaaaatgacaaaactgtaacaaagagatacgtaccatggttagaacgattcgaaagtatacagctcttccagctggcttcgaagcgaattaggtacatgaagtcgtggagaagactttatgcttagtttcttgagggaagtgaagctggcaagtgtatcacagtactgcaaattaggacatctcagctggagcgatctaagtgaaggcaagtaattcagtgactgaagacagattgagttcaaggtgtttgacgaaatcgatagttcttccagcgtcaaatgtgaattcgccatcctgtgaagtatctcacgtttgaatggatcgtctagatataagatggtgagcgagggaaagtgaccaaatgtaacaaagcttggacaattgaacagatgcaatgacttgagtgatgggagggatgtcagttccttcagtttctcacaaatcgatatgtttagttcctgcagagtagctgaggcaggaaaagtaacaagatttctgccgattggctatcgctcatctaattatgttttgtctttcttgctggttacatgatcaaaccagttgacacgctcttgacactcgagacaagccttgaacttgcactggagtgaagcaaatctcccatgctgccgtgttttccgtcaacactctcatgcaaagacctagctccacaaatgttctatgatagatacattgaattcatggtgagattaggagagaaagggaaagaaatgtagctaacctgatagctaacatattatacatattagcttcaatatgagcttatagctagcagttagctatcactactacagaaactctaaagggtgctggttggaaaacctcctttggtgccggttttcccaactggtacctaggaggcggcactgattacccaaggtcaaaggtgccggtttcaaaatcgacacctttgaggcgcccatgagccaaacaaaaatcggctcaatgcatcgacgtcaagccgatccaatctaatacccgaatccccaaaattcctcaaattcatgaacacaaacatagtcaataatcctagaaaatcaacacatcagcatcacattcatcaagaacacattcatcaagaacacacattcatcaagaatcaaacatattcatcaagaacacacattcatcaagaatgaatcggatcgagtaggaggctatcttcatcaccaccgccacttccggatggagaggaggagggcgctgccaccaccgctgcagctaccgaggaagcggccgtcgccacctcctgccgccgagccaccgtcgccaccttccctcccaccagatctagcggaggggagggcgccgctgttggaccgccgccgcctcccctcctgccgctgacccaccgccgccgcatccccttctgccgtcgggctgctgacaccacctcccctcccgccagatctggcggagggaagggcgccgcccgccaccgccgcctctcctcccgccgccaaccgctgctgccgtcgcctccctcccgccgccacaaccgccgcctccctcgggtgcgagagagagagagagaggctgagagagaaaggatagggtgagagagagaggtcacgggtgataggataaggttgccccctcacctcccactcggtgagtggataaggtcgtctctcggctcggctcgtttggtagggtgtcggtttttaaaaaaaccagcacctttaatatattataggtgtcggtttttaattgaccgacacctataatatattataggtgcctattttttaaaaaaaaccgacacaaaatataataggtgccagtttttatttagaacggacacctataattacttaaaggtgctggttttttacgatttcatcccgcggaggtgggaaaaggcctataggtgccggttttagcactaccggtatctatagtggcgacatctatttgatgttttgtagtaatatatattattaaacttactctaagacaatattccctctgtccctctctgatcatcacataattaaggtttttcaactaaacaaaggaaaacttaactctcctatatttcatttagtgcgataatatggttgtaaaaaaataaaaaatatatgcagactttaactcccacgaatgcacacgaaacgataacttaatttatatgcatagatgcaataatgctgtatgtcaaagaaagaaaggccaggattatgtgatgatcgatttggaaattctgattttttgttatgtgatgatcaatctgatgaagtagttggctatagacatatatatatattcaatttcaaccatgttacccgggcaccatggagtaccaaacaaatttaattaatatatatatatatatatatatatatatatatatatatatatatatatatatatatatatatatataagggcagagccctccatttccattaaagaaacgcatgagttcttacaaaaaaggagtcttggaaaaccagagaggaagaacccccaggtgctcacaaaagaaacagagacaaaatgaaatccagctagcacaggccttagagttttatgcaggccttagagttttatgctatctctccataactcatctcatttctctccaattcaccattgcgtcctcaactaccagctaatcaacagcctcaatagagcagccaaggctgactcctataagactagctaagttagcaagagaaatacttgaatcatgatgaagaggggatgagccctgacctttgttgaggaatgcattttgtgcttctttcctattcattgtcatctctagagtcttcttgtcctccctgtctctgaatctcttgcttgcccttctttcctcctcttgacttcccatctcctctttaggtagcaccactcccaagcttttggcaaaggcatcctcggaatcttgtgaatcaaaaagctcttcactgtctcctagctgcagcttcccttcctcatcaccttccacttccacaccatcctcacaattgctagcaaactgtccttcttgtgtctctcgagctactgacacgtcatgtggagcagacttggaggccttctcaaactccaacatgaggtgttcaggtatgttatcttcagcagctttatccccactgaactgacctcttgcttccttctcttgcagcaccagtgccaactccctgtcttgtataatctgcaaagccttgttcttatcctcctcagccaacaactcaacctgctctatactgggacattggatttgactgcattctcccctttgctgaaacattgctagctgcccagctgtctcttttgtctccaactctccatccctcgcttgcctttggtatcagacttctgatcttccttgtcttcaatgtttgcctttatgtcatgctgtttttcaagctgttgtcctttaaaccagcccatttccaccacattctccatagtaaaacatgcctcatacatcaaagcctcaggagtagataatatcagcctaaatggaaattgcttgatatccatcatccctattttcattctgacaatatccttagcagctagcaaaggcataaacacttccatgaccacccccaaattagaacccacctcatatagagcctagtaaaccttcatttcatcagggagtccttctactattacccagacaacatgcatttttcctatagctgcagattcactagtccattcagagacatttacctccaccttagtgcccttcacattaaagtgatcaaaattcgacatctcaaacaagagacaaccttaacttgtttggaaaggtgccacttggttgtttcttagccctccattcccaattccatttgaactgttgtctgaatccttctatccttcttccaactctgtttcagataaatcctctccatagataattttcaccattgccatggggtttacatgctctttaggtggtgcagatttgatattctgaatcaaaatgcaaccaaatcccggagccccatatccaactagcttagcaaccggcctgggttgtttgtcatacaaacagtcttcagttttgtatgaaggtttggaacaattagtacagaagatttttgtacagcaatccctagcaaggtgccctctctctttgcatctaagacaaacttctgactagagaacacaccaggatgagaaggattgggaatatgtggctgacctttttgctctgcaatcaccaacccctcccctttctgcccttgatcattctcctttggcttgaccgggcgatattgctgcatctgcttctccataccttgctgaggacttttggattcatcacccttttcccccttagctccatccccttgaaatcgccttggaggttggaattgttgaggttggtttgggggattttggaatcctcctccttcccatcttcttccacctccacctcctccatggccaccccactgattgttgcaaaaatctggcctgacttgatttcgctgcgccagccaccaccctgagccgcatatctgtgccttggatgaccttcgcaaaacggcgggagtcgtccgagactgtacccccgtcacctcccaccaccaccgcccaccccaatccgctatcccctacttcccgctctcccagtggccgtgggctactccttcctcgatcctcctccgcttcccagctcgccggcgacgacgaggatcgccagcgatgagagttcgcgtcgcccctcgagacacccctcgcatcgcccatctccccagataatttcattgatcattggctacatatatatag

SEQ ID NO: 35662 - DNA, 1208 bp, Oryza sativa
  unsure (1)..(1208): unsure at all n locations
nnnnnnnnnnnnnnnnnnnnnnnnnnnnnnnnnnnnnntgtcgttagttgcgcatctcacaaacgttgtatcttcacgaacttgtcattaccagccattgtgtcttcacgagaagcttagttctgttggcattctcgactagtccgatgtggtctacgtaatacctatgtgctctatgtaaacaaaatatttattcgagtcaattgtgagcacaagagccaatagttattaaacggtgtataacaatacttacaaattcaacaaaactagaaattccgtgaatgtcttctaggtgtagtgtgccagatcacgcactacgaccaagtagtcccatggatataccagaaataatatatagtggtcgctgcaaagaagatatgttaattataggtgatattgtagtaaaaaaatagtagtatggaagaaatatgtacggcaaagtggacattttagtcttggtgcatgtgcatcactttccccaagtacattgctacattgatcctctttttcttgtgcaattgtttgatgaaagctttttttccctctgttttatctttcaactccagacaatctttacgaagttcaaccatgtgttccgtccagcaaacccttgttgggtttacgtatcctaccggtctgctagcccttgcgcccatcaaggaattgcatcctaagtaatgcagcgggtaatttatcagaagtgagtttgcaaatgaattcatttatgtcataaaatgtaaatcacttataggcaaaacgcggcaactagattgatgtccattttaccgagcttgagaaatgtgtgaaggtcgttaaaatagataacgagcatcccattaggtccactaatggaagcgttatccgggaccttcatagtaatcatgtcgagtccctttttagatgccttcaagtaccaatcatgtatcaacctcatctcccatggtagattttccatgacatgccatcactggtggagaaaccctttgtagtcccggttcgtaacccccctttagtcccggtttccaaactgggagtaccaatccgggactaaagatcgctatctttagtcctgggtgaaataaccgggagtaaagatcgatctgagccatctttagtcccggttggtgttaccaaccgggactaaagatcgagctgacctttttttttttttcatctnnnnnnnnnnnnnnnnnnnnnnnnnnnnnnnn

SEQ ID NO: 35663 - DNA, 5402 bp, Oryza sativa
ttatgtcatagaatgtaatcacttataggcaaacgcggcaactagattgatgtccattttaccaagcttgagaaatgtgtgaaggtcgttaaaatagataacgagcatcccattaggtccactaatggaagcgttatccgggaccttcatagtaatcatgtcgagtccctttttagatgccttcaagtaccaatcatgtatcaacctcatctcccatggtagattttccatgacatgccatcactggtggagaaaccctttgtagtcccggttcgtaacccccctttagtcccggtttccaaactgggagtaccaatccgggactaaagatcgctatctttagtcctgggtgaaataaccgggagtaaagatcgatctgagccatctttagtcccggttggtgttaccaaccgggactaaagatcgagctgacctttttttttttttcatggccctgttgctgcatggtttatatatatatatatatatatatatatatatatatatatatatatatataaaccatgcatatatatgtttcaatacatatatatatgcatacatatatatatgtatatatatatattatattatattatatgtatatacatgcataatatatatgtatttatacatatatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtattagtcgctgctagctcagaagctaaggaccggtgaattgtgtttccgtcttagtagaattcacccttgggatcaaggatttcttcgttgatgaatcccatgagttgtttttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttttctccatttgccgcggaccaaatgacggtaccgataccaagccctacatggagtttaaagctatgattcgtagtagcaattaacataacaagattttcttaattaacaaaggaacttatgacggtacctgtctataagtttgaaaaccttgtcaaacgtagactcttttttatccattgagtcatatacgttgacggtgcaggcctcagggtcgaagagtaaaagcacccagtggaatctgcaatgtgcgtgggatgcattacatatgaaacacttagcaagttcgtacaggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgataaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcaactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgtgtgcaatcgtaccccgggtccttgttcttggcggcgtcaactttcgccttcttcgttgcccttgtgtgggcaggcggtggagctggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgatgccacctttatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctgggatcatgggaccgatgtgcggccatgcgttcatcaaccttccttgccacctcctcttgcatgttgagttcgtagctcgatacccggaactctaggtctgcaatcttcgcctcggtatttctcttgctcctcatccgactcctgtacgtgtggatgtcctccttgaaaccaatcttccaaggaatcacccttttccctcgtgttcgtcctggatgctctggagtctgcagggcgagtgtcagctcgtccctatctatgtctggtcggaacgtgccctgagaggaggcttccactgcatctgttagtcgtcgcgcagcctctcgtatctgatcgccgaagaccagtgagccatcagctgggttgagcgttccaccatgagcatagtaccagaacttcgattgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtatcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccacgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattctagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatctaatattaaaactcaaataatattacatgctaagactaaaatagtcatgtatatgctaagtgtttcgtgcgtatatgctaagtctaattaacactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatgtatatatatatatatatatgtatatatatatatatatatatatgtatatatatatatatatatatatatatatatattgcatttcacgttaacgttcgtc

SEQ ID NO: 35664 - DNA, 2323 bp, Oryza sativa
agctcgagacgacggcgagatacggcggcgtcggcgcggggatttgccctaggcagtggcggcgaaggagagaggccgagagagatcgatcggccgaaaacgtctaagtgttggtgaagaaaacgagggcgcaccgggaatatatatacccccgtttttttactcccggttgttcagaacaaccgggactaaagatatctttagtcccgattgttgagaacaaccgggagtaaagaaaagatctttactcccggttgattatagcactgcatatgatttttgcttacatatgtgtttataaaatacaggttaatgcattaacattatttaaagtacaaagattaatgacaattacttcgaaaaattatttttgtctgtaataaattaagtggataaatcgtaataagcaaatatatgacttataattaataaaaattccaatatatatatatatatacttagcatatatatgaatgatattattatattggtaaaaactctaattaagatatgtatgtacatactgcatgatttaaaattaataaaaattataatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatagttttaaaaattctccagtcaattataattagcatatgaatgatagtaaattaaatgttaaaaactctaattaacatatgaaattgctacttgcgtgatttaaaacttttaaaaatcctctagtcaattataattagcatatgaatcctagtgaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttaggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtactcctcgatgtaaggagctaccaatgaagagtgttgcagaacagtgaaatgggctttacggaataaattgttgtctaccgtcattattgttttccttccaagagttccctttccccgtagtctcccttcatggcgtgattcaggtaccccgattgggcgaaggtcttcgataaattctacgcaaaattcgatgaccccctctgttccataacccttggcgatgcttgcctctggacgagcacggttacgaacatacttcttcagaacgcctatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggc

SEQ ID NO: 35665 - DNA, 408 bp, Oryza sativa
gaggcgcgcgtcgccaccttgcgccgctcgcccgccgcgccgccgtcgccatcgtcgccgtcggcctcgcgccccgtgccgccgcctcgagccccgtgccgctgcctcgcgcctcgcgccgccgctgccacgctgtcgccatcgccgcgggtcgccatcgtctcgcgccaatgtcgcccgtcgccgccgcatcgccgtcccatcgcgccgcgcaccgtctcgtcgccgctcgtcagtcgccatcgcaccttgcgccccgcgccgctgccgcccgcccatccaatcgcggcgcgcccgtcgtgtcgccgctgccgcccggtcctgtcgcctcgcgccccgcgcgccgtctcgcgccccgcgacccgcgcgccgctcgcccatcgcatcgccacctcgcgtcccgcgccg

SEQ ID NO: 35666 - DNA, 1385 bp, Oryza sativa
  unsure (1)..(1385): unsure at all n locations
nnnnnnnnnnnnnnnnnnnnnnnnnnnnnnnnnnnnnnnnnnnnnnnnnnnnnnnnnnctgtgcagcacagaactgaagtggtgtccaaaaccgaaaaaacaaacaaacaaattcgtatcttaatcttaccgaggatcgatgcgagcctcagattgtggctggtgtccggaggttctctgctccaagtgctcgaagaatccaaaggccagccgaaccacagtccgcacgctggaggaagaaggtggataattaggtgagttgggggcatgcgggggattgggtatccccttttcccaaaccctctccctcatttttcacacgcacgctttttaaactgctaaacggtgagttttctgcaaaagtttctatacaaaagttgcttaaaaaaatcaaattaatctatttttaaaaaaaaatagctaatactaaattaattacgtgctaatggatcgtttcgttttctgtgctcactgtccggatggggataaggatgtgcgaacacagcctaaaagtaaaacagaccgaggagaaaaacagggggccttaaaacctagctactgttgggctattggcggtgtggcgtataactctgtatctctagtgagttccaacccacctctctcatttttcgcacgcacatttttcaagtagctaaacagtatttttacacaaattttctatataaagttgtttttaaaaaaatcatattaatccattaaaatagtaaatacttaattaatcataagaaaatatgtcgttccattttacgtgccgaacaactccgtacaccaatctgaagcatagaacattggagacaagtcggagtaataagagaagtatataagaggatatgtggataaaaggagagaggaaataggtgattggatgagaatttaatttgaaagcaccatccattgggttcatagtttctatacataatgtatatatgacacgacaagtatgaaaactacttgatacgttttttaatatgtaacatcattcactttttgagatacgtttgaccattcactattagaaaatgcatttttcccgacgtggggtctgattttcacaggcggatatatcccttgaagccaaatgaccgcctataaaaatataaatcggggtgaagtgcgttgtccgtctgcgaaaatagattttcgcaggcggaccacttaagcgacgcctgcgaaaatgattttcgcaggcagaccacccaaaccgcgcctgcgaaaatcatacctaccccaaaaaattttaagtcttatcttctcctccaccccctccccaccactcatttccctcacttaactctctctccccctcaacactttcccctcccctcccctcccctcccctccctccctataccggcggcgatggc

SEQ ID NO: 35667 - DNA, 4919 bp, Oryza sativa
gctacaaattgccgtcattttttaagacctgtcctcttgtagagcaagtaggcctctaagtcgtcctggccttaggataccatgtaagctcacaagacaagccgataaggcaacagaggagagaggagatgcaaggcaataatgagtgaagaaatatatagacaaatggattaagaacaaaacaaataatataactcagattgtggactattagagcaagtgtgctggtggtgtgtactgtgtatattatcttatatctactgagtaataatgtgtaaatgatgtgaacaaaattagagtgactatcatatcacctctactataatcatcgtcgtagtatttagatctgattggaaaaacatggacacaacaccatatatagtacgtattccctctgttcataaatataaaaggttttcgccctctccatttggtcataactgtagatattttagagcactaatgttccatcaatcacctcttactcaaatctttccctattacctcaagttgccaaccattcctcctgtatatctctattctccaaggaccctcctatttcataaggatcatatcttttatatccattgttaatctccctcaagagatcataaatataactcgaatagttattatttttatatttttatatttttatattagtgaatatagatctatatgtgctttatatatgtgtccaaattgatatgaatactagtgaatctaaacaagtgaagagaccaaaacatcattttataatttgaaatgggggcagtttttttccctaggtgcttgggaacgctcaggcttagagcaggtacaatagcaggctataagtcagctataaacatattttgaagagataaaggaagaaagagaagagcagcgggctacagatttgtagccaactgcagcacggactcgaagacgtaatgtgtatatgacaggtgagaccagatattaatagtataataagcaactattgtatgaattagctattacatttgctatagatgatttggagctagtagtgggttatactattaaacttaaacttgctcttattgagctccacctcacaaaaatgcacataacagtgtatagtaggtatggtaattaattttagcatctccttagggaccgcaaaaattctttttttttacatgtatcacattgtccctgcaagtcggttgttgcagagctagaacggaaacaaaatacggtttgccgattgatcatatgtgagaagctaataactacctcaacgaaagaagcatagcataaatggttgggttctgttgtggtataactagtccatccagattaaaattcttaggtgtttttgtcctagacaacgctcgtggacaacgacatgttttttttgacttcattaatattaaattatgtcgctctagtttttagttacaagtgactcacagcataatttactttcctagggaatgataaaatgaaaccattgtcagtttattaacaggcagggtgtcaggctcggtgttttctcgagaattgaacgcgggccgctagtagcaagacggctactctttgtcatcttgggacagagagtatgctcctacttgtaagtcttggatggtgcaatgaaaggtgcgctctcactcaaaatctttgataagtagtactaccttcatcacaaaatattataagatactactattaaatttgatacatattttcaaatggagtgagtgtttatttggcactgtggtgggagctccaaaatccccagcatggatccctaccaaattcctgaaaactactttggaaatgtttttttgctagtgtatggtacggctagctgatattaaaacatttcagatactcctataatttttcttttggagggacccatttagtggctacacgctgcgtcatccgagcactgactataaaaattcaaaatattgcagactagaacatgcaagtagtagctgctatcgtgctagtatttcagtattgatctcagtagcggatccactgttagggctggttggtgcgtcagccccaccgctaatccctactcctaatctatctatctattatatactaaaagtccattaacctttctacaaacgatcctaaactgccatgtggcctcctacaaactctcataaactgtcacatggcgttctaataaattagaaaaaaaagggtggacccactaattttgccaattaaatcttcatctaaaagaaaaaaatctggtatccccaccaccgtaagcacgcacgtacacgtactcccctccacaccctcccaactctcccctattctcctattttttaagctaacttctcctattttatagctaacacttaatatataaaaatgataataatcaattatctaaatctacataattctcaagttacatatttttttctcattttttcaactgttgtgctatttatcaattaaataccaaattcaagatctatattacccatattttgttatttaaaaattaaaaattagatcatgtgacctctatctaattattgagtttttataagattttgtcagttaaaaacatagaggaggtgaggagtgagaaggacaaatagatacgtacgtacatgcacgtctcacgtatgtctcacgcctttttattttttaagataattctaactatataaaataatgggtctctcatctttaagttaaaatcgatggttagacctttttttttagaatttttatgattttatctgatttattatactgtcacatgatggtttattagtgtttgtagaatcacacgtggaatgtatgtgcttggcgctctaataaattagagaaatcctagaaaatcagagaaaaaaaacattcaaccttcaattttcacttaaattggtggacccgttattttaaaccgttggattagatctattaaaactcccacgctgctaatctccatcccgaaaaagaataacgtacgtacgtatagttcggacgatcatctcactttctggaaaaaaaacttaattacctacatcatatactatggagaaaaacgataaatcaaaaaatatatcaatagtaaaatcaaagaagcactaattaatcaagaaaaaaatcatcaaagccggcagtctggcacttatgtgttgtcaatagcctttaaactacgattttgttaaaaataatactacacagaaataagtagggggcaaaaattataactatttttatcacctcctcctcctttttgtccctctccgtccttcaatgcagggtatagtatttactatgctatcgtaaatattgcaagggtatacgtatggttgagttaaggtggcatcagtgaaaagattactgtaggcaatgtatataaagggacatactaactaatagaatcatttgtgggtgtgccaatagtgaattaagtgttaaatgatgctataggctggtctttgggggcatggctatgtcgatgtgggactgatgttccagggcattacataaggaagccttggcaattatagtcgactttatccgttagagaggcattcatgtctatttttaacggtgttattgtattattcgattcaaatggtatgtttagactatttatacatagatgtggaaataagtgatgaacaccaagttaaacagtgtagatgatttttagtgtattaataatgtataatttattttagtggtattaaactattaatgtcgtcttattaaaaaatgcacatagcttttgatgcaagaacaatagacgagtttatatatgaccacgacaaagggatttttatttaaatatgagagatattcttatttttatcatatttagtagtatattaaaatctaccatctattttacggtaaatatattgcttttttttattgttagataatttacatttccttaattacagtatatatagtgatgtatgatttattttaccattctttttcttaaacaacaaatattctctggcttatatcccacccttatagtgtttaaaatacagccctacgatacatagtcgcgcgaatgcgcgggctaccttccttgttagtcattaacaagtctaattagtattcaggaaatttctcggaaggcaaggatttaggctgcctcactgcttctcctgcccaaacttatagaacagaacttactccgagtatacttaacaatatattgacagatatttgtgaatattttaatatagtcacaaatcaaaattcatcatatgcgcgtttggttttcattgaaaaatactttagttgatatatttttatttattttaatcatattatatttttacactaccactcccgatcaacttgcatcctggattcgtcactgattgatcttatcgtgaacacccaacacaaaagcggcagcagccggccggcgacggcaagtttgtccacccatgagctcaccggagacgacgacggatcagagcggcagcaacaagcagcagcggcggcggcggcgccaccacttcatcctggtgcacggcgtctgccacggcgcgtggtgctggtacagggtgaccaccgcgctctcctccgccggccaccgcgtcaccgcgctcgacatggccgcctgcggcgcgcgcccgggccgcgccgacgaggtgccgtccttcgagcggtacaccgcgccgctgctcgacgcggtagccgatcaggacggtgaggagaaggcggtcgtcgtcgcgcacagcttcggcgggcagagcctcgcgctggccatggagaggcacccggagaagatcgccgtcgccgtgttcgtcaccgccaccatgcccgccgccggcaagtccatgtcgttcgcatttaagcaggtacatacctacagcaaaatcacccaaaaccttttgtgaagcagtgtctgaacttactctgaattgtacgaactgggg

SEQ ID NO: 35668 - DNA, 4922 bp, Oryza sativa
cccccccccccccccgaaattttttatttttgttttatttgtttgatatttttttcacgcttagggacacacaaaaaccaaccatagaaaaattgaactcaaatggacgtaatatgtgacctgtaaaatttttcctctcctctcatctctctccgaactagtgcaaaggagagatgtgcaacttttttatttttattttattttttgatattttttcacacttaggaactcacaggaatcaaccatgtaaaaaataaactcaaacggacgaaatatgtggcatgtggaattttccaaagttctaccgaaaaacttctctgctcgaaaacacaatcttgcaagcagaatttggaggttttaatatcgccgaactcggcaaagctggggagaatcggatgtaacattttctgtagatgtccgtgcatatattatttgcctgattccgagtccgtatgagaaagttacgcctattttaatagatgacatattttgtccgtttcggtagagttttggaaaattctacaagtaacatattttgtccgtttgagtttattttttatacggttggttcctatgttctcctaagtgtgaaaaaaatatcaaaaaaatgaaataaaaataaaaaaaattgcatctctatgtacagtttaacttatatatgtcatttcatgtggttatattttgaattagattaagtaatttcatatagtggtagagtgcattatgtttaacatgctgatcaaagggttttactaaaggaattatggtctaattttagtgaaggtgaaaagtagactaaatggtatgctagctattttcagacttagttaagtggtagttcgagtttaaattttttttgtggttggttgtatcgtgatcctaagtgtgaaaaaacatccgaaaaaataaaataaaaatgacaccgttgcaactccatacagagaaacaggaatggaggcggcggcgccagcatggctggcgccctcctcctgccacgtcggttcgcgtgcgccacggtggcaggaggacggcgccagcctctctggcaccgtcccgttggatgacggtgccagccactctggcgctcaaaaaaggaccatttctgggataagttttttcaggggtctatttgcgaaataagttttttaaaaggaccaaaatgtgaaaaatccaggtacttggcacggcgagtgtatcagctcagcccacccgaggtatgcaacaatggccattatctgttcctctgaatctctgatgtaattaactacacgccttgacattgtgactgacatatgggacccatcacctacaggtctacttccttcgtcccaaaaataatatattctctcctattacaataaatttgaataacacctgttcagattcattgtactaaaatgtcacatccctttcaggttaagtaggtttttttaggacagagagaatatatatcaacaaccacgtttcggtgattttacataagagcccgatcccgttcatggttcctctgacggtgcaactcttgcaggacctggccctggcaatgtcgacggtgaggccgtcacgacggttcctgaacgatgccacgatgaacggggatgtcctgacggagggcaggtacggcacggtgaggcgagtgtacgtcgtggcagaggaggacgagtggaagccggcggagatccagcggctgatggtgtcgtggaaccctggcacggaggtgagggcgttgcagggagctgatcatatgcccatgttctcaaaggcgagggagctctcagaattactcatggagattgccaacaaatatagttgagattttcagaagcatgttcttcagataaaacgttactggaacatatatatatttctgaaaaatggatatagataacaatgccttagactctacaaaagaaatgcaaaatcatagtgataaataattggctaacgttgttaacagtttggggttggacgttcggtgttttgaaagattgatcaagatgtttggatatgaacagtaaaccagaaccagtaatcgcaaattcagttcaaaatttcggaccccaccggcaaatcaatatattgaccgaaatattcatgttttctcaaatttttgttggagttggtcaaagtttattcaaattcagtaaaaaactatcaaaatttcagaaaatttctttccaaaaagtgctgaaaaatcctgaaatcaccgaagtttccaccgaaatcaccgaagtttctaccgaaatcaccaaagtttccaccgagatcgaaagtgtaaaccctgaccggaacattgaacagaaacaccggatcattcccagtttgaacagtaacagtgcatttcagataaaacgtcatggaaatgcatccatccatctatctatctatctatctatctatctatctatcttctattatatactaaaagtctattaaacttcctacaaacgttctcaagccactacatggacatccttcaaacactctcaatccgccacgggcgttttagtaaattaaaaaatatcaaaaatttctaaaaacataccaccattgattttcacttaaatccgtgggtctattatttatgtcattagatctattatagataacacaaaactaattaaatatatcaaaaggaaacaaactctcctcccacccctccagccatacgtgcgtacgtacattttcctccctcctcactctcccaacacttattttaactaatttttattggaaaaacaactaataatttaagatccatatctttactatctaaaaaactaaaatacattatttgaacagatcgcaacaaaacagcatccgatttttaatttatttgaacagtaatttaatttatttgtaattaattaattaaatcaacatatatatcactattttgctatataaaagttaaaatacattatttgaacataccggcaacaaccaaacaaccacgaaacattaatattagtgtcatcttaaatcattctacacaataaagatttatcgaccattctattaagtcaccacgtgtgatattttaaaactagaaaatacttcttagaaatttgagcatcgttagtttctacttaaatcgatggcctattatttttaagcactagaaacatatcatgtcttgaaaattaggggaaaaaagagaaatttgagaaaaaagtcacccgatcattagatttcacttaaatcatttaggaaaatagaaaaagaaagtcaccttcacctccctcgctcatctgcaccatctctctttggcccgaactctatgctcttcattaatcataagctatcaaagtgaaataatcaataattataagctacatgcgcgatgtctaatctaacttttattgtattataatgaaaagaaatgcaagcatatgcctatattttgctatataagaaatatgaaatttgggaacaatgacccgtgcactttgcaggtcatccaaatagtaacgaaatactataaataattatcaacacaaattacgacattatacatccaagtataaaacaatatttttttgacggacaacatccctgcccttttacatatcgtccaaataataaaataactatgaaataattcagcaacataggatgcaccatcatatattattttgtaaacataaaaactaaattaaatatacaatgcctaagaaaaatatatcaaatataaaaaatcggtgggacatataccattggccttttacatgtcatccgaattgccataaaagaattatgaaataattcaacaatacaagtggcgccaccatacgttgttttgcacacatgaatagctaaattaaaaaaaaagctttaactcaaatacaaatagtccaagtcactacataaaaaaatccagtggctttagtagtagaaaaaaaaatccaattacttcatgttttctgaaattaatgcggtcaaataatccgagtaacgaaagcgctctaaacaatctaatagatttttttaggataccatctaattgattttagatggtgtttaatgcactttggtatatctgtagatattcaagcaggtattcataataaatcacattaaaaaatgtgtgcacaattatatttagccctccatgtgtattcatgctaggctatatgaagcctcgcacgctctacataaaacattcacagataggatgtttcccacactatgcaatcatattggactctacgaattcatgcatttagtatagtctcatgttatattcaattaatagtgagaagctatatcggtcttacatcggtcttacatgcttatacaaaaggtagctcatttattttttaaaaacattgacataaaatgtgtaaagctccatcactatttaacatatcacagagtttgaacataaaataagaattgtataaaacaaaacagaaaatagaaaaaaatgccaatatgaactgcattaattgaactaagtggaaaaaatgttattatttattttgcttcattcttgtacttaaattgaaacaaccattgccataaccattgcatcattttttattaagtgcttagatattaatgatttttctctatcatacatcacggtattatgatttttctccacatattattgcaagtataagcaaaaatactaagattatagtatatagtttatttagaagttatatttataactattaatttaatttttaagggtcaagttgattagatttttctttttaaaagtagaatggatcacacatatcatagggaatcgagacctaggatgtatgtatatctcctctgtcttattcatacgtaagtaataattaaagtgcatcaatataaaccaaataaaaggagggctagctaaatggtacaaataaaacacatttgtcagcaatcatagtcttttatgatttgatagagaaaacatagct

SEQ ID NO: 35669 - DNA, 18639 bp, Oryza sativa
  unsure (1)..(18639): unsure at all n locations
nnnnnnnnnnnnnnnnnnnnnnnnnnnnnnnnnnnnnnttgcttcattcttgtacttaaattgaaacaaccattgccataaccattgcatcattttttattaagtgcttagatattaatgatttttctctatcatacatcacggtattatgatttttctccacatattattgcaagtataagcaaaaatactaagattatagtatatagtttatttagaagttatatttataactattaatttaatttttaagggtcaagttgattagatttttctttttaaaagtagaatggatcacacatatcatagggaatcgagacctaggatgtatgtatatctcctctgtcttattcatacgtaagtaataattaaagtgcatcaatataaaccaaataaaaggagggctagctaaatggtacaaataaaacacatttgtcagcaatcatagtcttttatgatttgatagagaaaacatagcttttaatttacatttaatttgttagatatgttttccgaacaaactaaatatgtcatattttaagtgatgaagaagattatagataattgcttaaaagaacattaaatattataaaaaaaagctcacaaacaggttaaaaatttatctaagcaacacattctacgatgtatgcgcgggctaccttcctagttatctactaaaagttcatcaaactttcaataaatgctgtcaagccgccacgcggcgctctaataaaatagaaaaaatcctagaaattctagaaaaaggcaaaacatccgaccgttgatttttcatttaaattggtgaacccattattttacaccattagatttatcacaagaagagaacaaccaaagccacctctttccatctgttatgaaatatttgggtgatctcatccatatatatggatagagtaacaaccaactcagggacacgacggttggtcgtgccccacacctcttctcgcctcacggcgattctagcaacggacgcgatggttcccaaaccatcgcgcctccagttgccgcctctctcccccctgtatattgtaactgttatcaataaagaatccgctcattcattccctctacattcttgtgttaaaatttctctctcgctcaatcaattctattcacaatacgttatcagcactttcgctctcgcgaaggagatcacgaagtgaaagaaggaagaaactacatcattttttatcttaaggaaaagtgaaagaatcaacaggaaaggtacgagatgtttacctttaattacttgatcgatgccgttcttggcggatcgacgccgttcttggtcttcctcgccatgaccgagaccgccgtctgcaccaccttctccatcgttcaaggagtggccaccacaccactgccaccatcaccatggcgggcgccggcctagggttagtggccaccgccacaaccctcggcgccacatcaccattgctgctactcctccaaccccctataaacgctcctaatctatcgactatcatgtcgtagcatcatgtaaacactctcgagtcgctacatatcactataataagaccatcgatttttatttaaattagtggacctattgattttgattgtacgggaaaacaaaatctccctccgtccattcccccgcaccgtacgtaatatccatccggaagcgtacatacgatccatccgcaatgtacctaccatccatcagacctccatttcttttttcttcttttcttaatccccacataaaattaacaacttttttacaggcctaaaaagaccatcagcctagatctagccagctcttcctctatcttctcctaataaatattctattaaatatcatataaatatttttaaaatatcttctacatatgtcctattttaaatgcatttttaaatttccgtgtccaatgcctgtctgtccgtcttatttaaaaaaattataataaaattaaaaagaattagtcatacataaagtactattcatgttttatcatttaataacaacaaatatactaatcataacaaattatgacggtcaaatgttacacataaacaatacaaaactacggtcctttttggacggtggtagtatatagcactcttcatcagagaaaatctaaaaagaatgaaacattcgaccatcgatttacattattttagcttataagatatatctttttcttaagaaaaacatcccaaacctccttccacgctcccatgcggcgttaaagcccattaaccatccttataaatgtttctaaaccactctatgacacttataaattagaaaaatcataaaaaattaagaacaaaacatccaatcactggtttcgacttaaattgatggacatattatttaggctgttattagatttttatttaaaaaaactgtcaaacctcctttcgtccctccccgcccctgcaatgttaaagattttaagtactttaaacatcctataaatatttctaagccactacgggtctctcttaagttaaaaaaaatcgtacaaaattacgagaaaaaaaacatctcactgtcggtttcgacttaaacatccaacatattattttaggtcattagatcaatcattttcttcaaagaaaaacatcctgccctccatgtccccgtgcggtgtgcattgttccatttatcttatttttatatttataatagttgaaattaaaataatctttatggggagaaaaaccccaaatgggacctccacatattagctagtctagcgagctgccccactatccattttcttctctttctcctcttactagtacttataggaacaatataaataaaatagttatacccttttaaatcacatattcaacttatgatctgtttgaactattattttttagtgaaatcaatattttattatctatattaaatatatttaaatgctaacatagaaatttgcattccggacccacttctattttgaggcctccactaaaaaaaacatatttatcataaaaaaatcaacatatctcatcttaatttttaataaagccagtagacccattacttatatctcgttagacctctaacaactttatatcaacttgattgatttctcacaacatgtatgtgggggctatttaatttagctatacaatttaattttggtgcttttatcaataacttgtataataatacctagcatatactcccgccgttccaaataatagggcggtcttgtcttaaggaaaatcgaacttcgtattttttttactaataattatactaacaatttctaggttaagtgttatgaatgttatatcattatatttgtactttaaaatactttcatgtgacattgattttataggtgttgataacataatatgaaataaattagtggtcaaagtatgttattgatgaccgtgtaaataatttataggtcttataatttgggacatagggagcatatggttagtataattattagataaaagttaccaagtttgatttttccttaaaaagagtgtgccttataatttaggacggaaggagcagaaaggacgaacgacatacaacatttacaaataccttccatgtcacatcatccagaaaatgcaactgtgctgcaagagctttgggcattccgtaatattcagttccttaagggaggtgaagccggaaagcccatgacagtactgcagattatcgctgctaaacttgattttcctgagcaaaggcaggccttgtggctcaagagatctgcatgtcatcaaattgcaggtgattgttaagcactccagtgaagaccgaggttattcagcagcctgcacggcttgttatatatctttgaatggacctccaagacgcaatgtggtgagtgatgggaaggaaggaagttggtccagattaacgcacctacaaatgtgtagttgacgtaggctgggcgatgctggaatcgcagtgatattgggacaatctgtcacttgaaaagaaaccaaggacagaaagggcgctacaggaagagacagtatgttatctgcacatctgatggaaagcctgtgcaagcgcggaaatgcaccatcatccaccccagaccactctgaccactcgggcatctgcacgaatttcagtttcttcagtgctgggaagcccttgaaaccatggccatggctgcagaactcctgtcggatgtgttgcagaaacatcatttcacggacatggagaaactggagggacggtagctcaccaagcgttggaagtcgctcagatttacagaacaagaactttattgttgtcaagttggagaaggaaggctcacccaaccaagagggatatttggaactctcatatctctgtatgatcagttttcttaggctgttatatggtcgcaagttgtcaagcagcagctcgtgagacactgtaattgcaggttcgctttaatttgtaccgtgttttcactgtaatctgggctgtcatccaaatcaatggctctactgaagtccaagtgtaaggactgaaggtgctttttattatgtagccaagcttcttttgcatcctccttgcgatctaaatctgccagtcctcttactgtcaactccttaattttgttcaagctcttcagttctcccatgttacaaatgttacgaccgatatatagttgaggcaaagtatgcaggttaattaggctgtgaattccgtgtagctcaagcctgtagtaagaaatatcgtaccggttatctagcaggcattcacaatgtaaatggcgtagtaattttgcactgcccatgaagccctccaatgccttgcttagaaagaactccttctcgtaaaagacaagagctctcaacttctcacaaccgaggagcaatgcttctggattttctatatacccagatgctctgttcaacactatgatggctctgagtgaatgtgaggcaactgacatttcacgcgatatacaatgaatggacaggtacctaacatttggtggaatttcaatgcatccatcatctgcttcgagcctaaagaactcatctgcaacaagaaagcatgcaagatcgtggataagatcatgcatgatgtgaagcccttgaatatcatgcacttgcagaaatgagcggtcaactatttcgttgaaatatagtcttgcggcactattatgtcgaattgtcgatcacattgaattatatcaagcgatttccacagtccaaacacctcgcttctatcaattaaatagcctttgggaaatagagaaagggcaacaaaacatctcttcaggtgtataggcaagtgtctgtagctcaattccaaggctggtagaatctccttttgtggtggctccaagtcccatatgtcactttctaagacatatctccatctcatttcatcagcttcatagcacaacatgcttcctaatgttttgattgctaacggcaagcccctacactttactccgtacaataatattcttgccaatcttatccaggtctgctggggtgtcatcttgttggtcaacagaaaatgcagcttgttggaacaataaccagctgtcatctgaacttaagcagtctaggtagtagaaaggcattgtctgcaccaactttgccactgcctcattgcgggtcgttaccatgatcctacatacacttgaagcaaataatggcatgcacaacaactcccatgtatctcttcgttcagtccatacatcatctaggacaagtaaaaaactcttcccctgtagtttttttcccagcacctcctgaagatcagccagttctgatagactggagctctcctttgtcagcgaagagatgatcttttgtgtaatgttcttggtatcaaagtactctgacacacaaacccatgcgcagagatcgaaagattggttcacccttgggtcattgtacacgagttgtgccagagttgttttgcccacaccccccataccaacaattggaaatacagacatacaacatgcatgcaacgctgctgctttctccggacttcatcagcctttcgataattatctccttctctcgctctcttccaataattctctcttccactacaaaagagctggtttgccgcacagtttggaagtcagggacaatccgccgatacccatcatttttggacagactaaaactatcatagtaatgtttcatctcagtaaacctctgtacaaccttccttgctctatcagccaactcacttggaactggaactacgccaggtttaatgcggtagtgctcgtcatttaccttcagaataaaacatatattagctaagaaggagatttactaatttaacactaatttctacatgcattttcccatttttcaagacaaaatcatacagacaacttacggtttgtttacacaagttttagattggaacgatcaatgtttttgcagttatatatactaaacagtaaatttagttacttttctgagaggaaagtagtaaactaaataattagtttttcatgtacacacacagatatataaataatcattacatatggactgcattgatgaaataatgactatggttgtgtttagttctctccaaacttccaacttttccgtcacatcaaatgtttggacacatgcatggagcattaaatatggatgaaaaaaaaatcaattgcactgtttgcatgtaaattgcgagacgaatcttttgagcgtaattacgctatgatttgacaatttggtgctacagtaaacatttgctaataatggattaatcagggttaatagattcgtcttgcaatttacatgtggaatctataatttgcttcgttattagtctctgtttaatacttcaaatgtatgttcgtatacatcaaattttttttaccaaaacaactaaacatggcctatgtaattatgtagtattgacttagttggccgaaataattaattattacatgcctacagaagaatcaaagacatgagaggggagagacgttgaagacgtaccatatggtcactactagaaaaaaggtatttgcaggcgggcaaaaatggtcttcccaggcagaccggcgttccgcccgtaggcaatcgccggtgcttacgcttgccgttgcaggtattaaggctcctctcgaacacctccgtactgacgcggttcgcctcgtactcgtactcatccaccacatcctccgcgtcgtaggccaattccttgagctccgtgagccgcactttcgccgactcctccctgatgatccagtgctcctccgcgtcgtgcagcgtggcgtggatcctgcgcatcgtcctctccagcatccggaggtcttccaggccctcgcttgtcgtcgacggcgccgttgctacttgcaggcttgctggcagcaaggacgagagcttgtcaagtgcccatttcacgctcatggatgcgaacaattcagccatctttctctctgatgtgtcaactagagtgcaagctgagagaaaagcagctaaggcaaggggaagggaatgggaatgggaatgggaatgggaatgggaatgggtgggtgctttgttaccgtcgtacaaaggttagttcatcaaaagcaagagcaaattattgttggtggtgtacgtattataaaaaaaagatcattatggtgtacgataataaaaagagataaaatatttgttatggtggaccctggccatatgaaaggattaataaattataggtgtgatcgaagtgagcgtcgctcaacatgttagattttttgtggtggaaccaactcacccgagtttaaattctaaatttgacatgtgtgttcgcatttacggttaattattctttcagtggtaagctacgtacaagatatgctatcccaggggtaggatgtgtgtgcgtgccttcacaaggatccgtgtgaacgtgttgttgacgcctgcgtttgtactgtgtttctaaaagaaaaaaattataggtgtggcggatgcacaaggctgaatatcacaaatgattttttaatcaacgttatagactatttatatggtaaagatcatcagacaaccaatttcccatttcaaatgtacagatttcaactaagttactgccttacaatagtactaggatgtatcatatttagtattagattgtttatgggacggagggagtacgtacagtactctctcttcgtcacaaaatattatagtacaagatactactattaaatttgatacatcttttcaaatggagtgtgtttatttggcactttggtgggtgctccaaaatgccagcatggatccccaccaaaatcctgaaaactagtactttggaaatgttttttgctagtatatggtacagctagcagcttttaaaccatttcagatactcctataatttttcttttggagggacccatttagtggctacacgctgcatcatccagttgagttgtgatccaacttcatttaccttttagagtttcacctcatatatatacctcttgtaagccaccgtgcagcgttgtaacctcaccccgatatagtggagatattttgctagctggcgttcgtggttttttctctcttgttttagaagggtttttcacgttaaatctcgtgtcttatatgattgatctatttgttctttatcgtttgttttcctatcgttttgtaacacatccgagcaatgacgataaaatttcaaaatattgcagactagaacatgcaagtagtagctgctatcgtgccagtatttcagtattgatctcagtagcggatggttggtgcgccagccccaccgctaatccctgctcctagttagtcattaacaagtctagtagtgaagaaatgcaaggatgcaggctgcctcactgcttctactgcccaatgattgatggggaggttaattagagtattgtttttttcccgtcctttttagttggtaactgaggctgagaacgagctgccatgccattccctcccttgcagccaattgctactgcaacagaagcaacacacatagctaatcaagctggtggtcaaaccacagccaaagaaatggccggactgttcgcatccatggcaatcgaaggtgcactcgacagcctctcctccctgctgcaactgcaagccaacaatccaacgcctcctccggcgacaacggcggcggtgccgccggcggagacgagccacggtagcgtgaagggggggctggaagacctccgggcgctggagaggaccatgcgaaggatccacgcgacgctgcgcgacgccgagcagcactggagaacaccagggagaagtccgccaacctgcggctggaggagatcaaggagctcgcctacgacgcggaggtggaggcgacggccgctcagggcggcgacggcgccagcagcagcagcagcagcagcaggaagcgcaagatccacaaggtaaattaattggtagtccgctgcacctaggagatagaaatttaaactaatgttactgtagttaactatttaatccgtaccattcaagtagatgggacctcgtgaaactcaataggagatgataaaatactctatgcttttcaaaattttagctgttctaagtttgtactcgctccttctatacacaagttacttctattacttttatcaccaagtttaagaagaaattgactcatcttgcatataacaaaacttaagaagcgcatgcacgcatgcaaccaatgagtattaagatatatatctcctcgggttctaatgaaacatttaatttactctctatttaagtcttgatatttactctctatataattcatatgctgttaactgtatgaatttttataacttgttgatcaaaaatagatatgtttgacttgtaacaaagctaaaatgagaattactttgaaacagaggaaataccacatttaatatataggtgggacctcgtgaaactcactagatgataatataccacacttaggctgtgttcagtagcaagaaattaattcgtcccgcacaaaaaacaaaaccatctattagcacgtgattaattaactagtttttaaatagatcaatatgattttattaaacaactttaatatatatttttttcaaaaatgcaccgtctaatagtttaaaaagcgtgcaggcggaaaaagagggaagtgggttcctaactactcttgccgaatgcagcctaaattagtgtagtagtaatttgtgtgcttctgtttaatctcacaaagctgctgcggattcggttcgttctaaaatataaaatatatgtatcttacatttatttatttcttttataatatattatcaataattacaaaattaacatcatattaaaataatttcaaatatgaatctaataatactacatgtatgacattaaacacatatactttactccaattactctctcatttccataatataaggcacaactacttttttcagatgctccataatataaatcgtgcatacatacatgtaattaattaatatatcttctctattaaattatgactttttaaaatactctacccttaagatctctaattctattgggtgcatgcattttatttattaggatgatacaaatttggaggtgataataattattttttggtcttagtattaagggtggttgtgccttatattttggaacggagggagtattagtcaaaattttcaaatgtgagtttgtaaaaaacacagggagttcttttatctatccccatcaaatcaataaaagcgtctgaaaccctcaagaaatccctgaagatggatagtcgtattagttgacttcctttttttttctgaaattatacatgatgagcaggtattagggcatttaagcttctttactagctagtctgactctcaagtctgaacccttaacaaatcccttagggaaataaaaataaaaaagtaaactgtcagcatgatactagtagatgactaagagtccccctcttcgatgttttttgtattatttgtgaaaaggtacatgacgaggattacttcattgaggctggcataattccagtgccaaaagagttgactgtcagagcaaggaaagttatacaaagatttggtgagatcgaaggctactatggtagtttcaccttgtctgagaatgatggggacagaaggattatccctgatatcaatagtctgaggcagactagctcttttgtatttgcgcctataattgttggaagagaccaagacaaggagaacgttatcaagaagatgatgaccttggaaggaagccgcattggaggttgcatgtcagttttggccattgttggcatgggaggattgggtaaaacaacgttagcgcaacttgtttacaatgatccaaaggtgcgtcaagctttcgatcttttcggatgggtttgtgtttcagagcatttcgatgtgaataacataacgcggaaaattctcagttcaatagcaaagagaaactgtgattatatacaatctagtgagctccagggtcaattggaaaacctgataaaggacaagagggttttccttgtcttggatgatgtttagaatgagcaaagtgattactggaagtcgttgtgtatgccgatttttgcctctacgcgttgtgacattatagtaactactcggagtgaggcagtggcaaggttagttcagacaataccattctacaatttagactacttaatcctgatgacagctggttgttattcaagcaaacagcgtttgttgagcatgataatgtcagtccagcaaacctagtagagattggccagaggattgcaaagaagtgccaggggttaccgttggcactcaagactctaggtagcgtattgcgctttgaaaccaatgtaatgaaatggagagatgttttgcagagtgaactatgggacttggagcggtcacagaacgaagttttgccagccctggagttgagctacaagcacatgcctatgcacctgaaactttgttttgtttccctttctctatatctgaaagatacttacttcgatgaaagtattgttgtttggttgtggaagtcacttcatttacttcagtgtgacggaactgataacagcaatgaaattggaggtttatattttactcaattagttcagcgatcattgattcaacaagtcgatacccacggacgcatggctatacatgatcttgtccatgatcttgcgtgctttctagctggggaagagttctttagactcgaggaagatggatatgttgaaattccaaagggtgctcggtgtatgtccataatgccacatccacaatgtaagaggagtactcaaatatcaaatgcctcgcaatctctcagagtaatcatattgatcaggagaattaatatcaaaaatccagaagcattgtttatgaactgtaaaaagtttcagatcattcaagtcatagatgacagttttgcaaatgtgttgcttgacttcatgggtgacatgaaactactacgtcatttcaggcttataagaagctgcaacgaggtaaagttagtaatatctgattcaatgtcccagcaattcaatttgcaaacactgaactgtgaagcatatagtctacatggaattgggcggctagctaacttgcaaaatttgcctaatatacacctctggaaatgtggttgctacttaagggagctgaggaatatgaacaaaataaggaggctgcacatatatggactttgtaatgtatctagtattcaagatgtaaatgaagctcatttacatagcaagaaggacctcgagatactagaattggactttgagagtggagggatttgtaaagttcacaaagaggaagctgatgttaatcaagcaattagcactgtatctggtggctcaatacttgagagcctaagaccacatcatcagagtcttaaagtactaaggatgaagaatttgaatgaggtaaattatcccagctggttgggcagtgcttccttttccaaattaacaaaattgcggttagagaattgtcaatctcagcaccttccaacgctaggtgagctaccttctctcaaatccattgatatccgccaaatggagtacgtggaaaacatcggtcgggtgttttgcagccttgatccaagcgtcaaagggttccgctccttagcacacctgagattccaagacatgaatcgattctcagagtggtccgaagtgcatgatggcgagttttcgtccctggaaacactgctgatctggagtgcctctgaattgagctctcttccatcggttccattctcaagcttgcgtagcttcgaactatgtgattgcaaaaatcttgttacttttcctgcatcagctacccttcagatactaagcatctcgtcttgcgagaaactgaaggaactgccggctctcccgtccctccgttcactgaaactgagtggctgtgaaagcttggttgcagttggtcacttcccgtcactcaccgtcttgcatatgagtactgaatttgaagaagaggtacttcacaagttgatgaatttacacttaaagctggaagaattgtcaatttcgtctgataccatgaagttaatcaatcttgagccacatagcctgcctttacttagagagctcgagttagtatgccctaacttgcagaattgtgatgcacttgccagcctcagttccctcgagatactatgcgtaaatcgttgttctccccaacttcgggtgcctaattcacttcaaagccagctggaaaaactctacagtccttgatctttgtaataacagtcctctttttaaatgtactattttagttggtacttctgcctttacatggccacatatcttaattctccttttgctatcgactctgtagaagcagaacatcaattcaaagactgcaatttttcggaaggggattggagggagaatgcaaaacagcttctggtgtcccactcccaccttaacactgggacacggttttctttttcttgatggaactgtgggactagaacaataaaggaaaagcgaataattacacaattactaaagaaaaggattgttactgcgataatcatcgcatagattgattgagagatcaatgttagtacaactagaaaggtggcctgcgcgcatgaaaggtaagatttttattgtttgttaaaaaaatttgtctcatagattaagggaaaactaaagtttggatactattattttgtaataattttttaataatttaagggttctatttttcttaaggtatcttaaaaatccattcacaaatttttagtacttacgacttttgaatcatgtttttttctcgagtaaataataaactattgcttgtagtatggctacaaatgaaaaatgcgagagcaagatactcaaaattcttgtgattaaatcgtctcatgaaggcgcatgatataataagaaagggagggaagcgtatacatggagaaaaagaagaaagggaaaaatgaaaaatgtggaggggaagcgtaggtacccacgtacgtaggtgtgtaccgaaggtggagaggtgggacatcgtagtatttagtttgttctaagatcaatttaatctaatggtttataatattggacccaccgatttaagtaaaaatcaagtaatagatactttgcttttttttcttagaatttctaatattttctctaatttattagagcaccacgtggcagcttgggggcattttaagaaattttaatggacttaccacatgtgattacaatattgaccatgtaatatatatgtatgggatatatgttaatattcattccagcttcgtccatgtttatatacatgtagagagaaattaaatatgttgctagcaagccattagaaatctaattaatagcaattaattttgacacttatttacaattgttcatagtagctcttatagattcatcttacgatcttgattatgcgttgatcaccaatttactgatcaccatgactcgcatgaaaaaaaatatgtactacttaaggtttaggacagctgattgatgaattatctgatttatgtgatagctatttgagattataaatgaatgaattaacttctgaaaagttaaaaagttgtttaaaaaaagcaccatttaggaacttgaaaagcgtggagcgtgcaaacaaaaatccaaaagatagaatcagggaaaaaatagggctttaaattcccttataacactcttgtcctagtaaaagttctattctattgatattcattaatattgtgctcacatttataacataatgatatctttcaattgtacgaacaaataatgcaaaatccaaatacgatataacacaatacattataattattatgcaatcaactcttggtttcagcttaaatagagttaagtgttggaaaaactaaacccacggtgcttaattcttctctcgctgcatcacacctttaattttcttttcatgttattaacaaaattaatcatctccatatatgatttgatgtgtggcaaagcagtagcgctgcagcggtcgtgatccttagatgccttagacacgacgctttgtcacacgtgcaaaggtcaaaggtgcaattgtgcattctgcagcaggcaaaaaaagagaacttcggacactttatttattaacaatagatccgttgattaaaataatgggtccaccggttcgagggtaaatgtaaattagttaatatagatttaaattgttgatttaatgggtacacaatataatagtgtagactttatttttaaaatagagtattatttgagaataatagtccaaagtaataaaaaataggtccgatgatttaaataatgggtccatctgttaattgcacatataaagtagttaatatggatcttaaattgtttatttgataggtacacaatataattgtgtaaattttattttaaaatagtgcattatttaaaaataatagtataaagtaatgagtacaccggtttaagtggaaatattcaaagggtaaacatataatggtgtaaattttatttttcaaagattgtatagctaatttagttccctatgtttataaagagttatatgatggtatattcttttgtttggaaaattatgattatttaaaaaatatatatcaattgtataaatggaaaaaagaagaaaaaaaggaaaataaatggagggagccgtacgtactacatacccatacccatgtacgtacctgacctacctatgcacgatagaaagaggagaggtgagacccatagtattttgtttgttttattatcaattttatctaacggtgtataatattggacccatcaatttaagtgaaaattaaggggtagatgttttattttttcttagaatttctaggattttctctgatttattagagcgccacgtgacaacttaagaacgtttaatgaacttttagtatataatagatataagtatgagcaactttacagtccttgagaacatagcatgagataaaaaatttagtgtggtacctcgtgttaccttctcgagtgctgtaaaatttctcatataactatactctatcggttgccttacatccacaaccaatttaaagaaataggattgggagagataagcacggtcactaggatgtgggaccgctagacgaagcattgacaggagctggacccacgtcgagagaaaggaaaccgacgacccattagtatatcacggccccgcagtcaaactggctatagagatgttgactggtactaatttgtactattataataactaagaaggtgacccacgcgatgcacgggcatccgtactatcatgacgtaccctctatttacttctgatagtcatatttcatcttggcacacaggccaaggataagtaattctacttatcatctatttaaacatgctactagtcattcctcgtaaacaaatgattcattaatatttatatttctcaatactcatgtagctaatcatatatggaagaattgagagtcacgcattaaatccgagaaagtcattaagatgataggttgttcgattgaaatatgtctatcaaaaataaatttttcagatttaaaaatatgactatcaaagatagatggagggagtatcattcattgacttaaaagatagatcaaggtcgggcatatctaaaaacaattcattgacttagattatagatcaagatcatatcatatgacttttgaattgaattttggaccgagtgagtaaatatcatgtataccatttgatcacataccatacaatattgctacaagtaaaaattgcgatagcaaggaactcaaagtacgttgtgatcgaatgtgtctcatgaagatgcatgattttgtggcaaccaaactaaggatatattagcggttggattgtttttcctttcgtagaagttcaaatttttcatattattttccaaagttttaaagaatttttgttaggacacaaatcacttgcagaactgcttggttgggtagtgcaaaatatcaacaattgtttgaagctattctttttttcttgtttgcatgtttgattgttttctttgaaacaatatttgtttgaaattagagtagaattatataaatttaataggtatgtattgtgtttatcggtagacatgatcaccttagccaggagttataagacgtgcgacagatacaaacagaagttggaagaaaaaatagaagcacaagtgaagaaaacaattatactctctggctgcacaaaatccccaagccttcccaaacatatttcccgagccctagcaacagacagttcaggtgccaagcagtgtcggatcggttgaaacatcaccatatccagtggatcttatcaccggtccgacgccgtgcagcctcgtcgtgccaataggaagggctgggaagagaaaggtgggaactggactagcaataccaggttgttagttccacaacattccaattccagacgattacgcaagagtgcaagtagccaaggtccatgcggagcatacctcattagagctagatatcccagcaccggaaggaatagaattgtttggagatgcggtgaaccaatttatattgtggcatcgtcgagatatcctctaggtcggtcagcaaccttcaacaccaactccatcgggacctaagactactactgctcctgcgctgctttctccaccagggccagattcaccaccaaagcggccatattccccacttccttcgtccccaccaaagcggccagattcctgacctcgttggtcccccccccccccccacaacatccaccacctccatctcatgctaaagtccccatagaaccacctttacaaaaaatggattccattcaccaatctcctccaacatgacagtcagctctagcgcaacctgttccacctcctcggaaagccactagtctcccaactcctactaaccttgaacctcgtcagcttatcccaaagatggtacgatccacgtgcgataaaaaagaaatggtcgtatacaaacaaaggttagtgtttcaggtccaattgacaagaagaaagatgaacctcaacagttgtcggattcacagaagttagtgaagagtcacaatcaatgcaatactcgacatttgatgaagtgccagaaaagtatgcgtatggaaagccattcttaccatgcactggtggagaaaccatctttcgtcggtcggccgatttccacaatagtcccggatgcaat

SEQ ID NO: 35670 - DNA, 1755 bp, Oryza sativa
ctaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcccccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttctgactcatgtagatggatcggcaatgtatgtacgctgaccggcggtccaaagagtttattgacggcgtgtactattttttgacagtggccgaagctaacaggcaaaggggttttatttgttgtccatgcaataagtgtaagaatcagggggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggatgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggatgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctgtctatgcatgaaaaggaagtacataatgatgccgattattattca

SEQ ID NO: 35671 - DNA, 422 bp, Oryza sativa
tccaacaaggggtacaaggcttgcactcactgtatggatgaaacagaaagtacgtatcttaagcactgtagaaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctgtaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaa

SEQ ID NO: 35672 - DNA, 430 bp, Oryza sativa
ccacgagtaagtcttcccttgttattgtgtagccagaatgccgcaaaactttcatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcggtcggctatggcgttggcctagtccgtaggcaagacttttcaagtctcggaagggttcttcaatctgcattcggttcgaatagatattaacaagttgtttgggtgttccaatttcaacaggtaagttagttgctagaatccatggctcctttgacgacgctgagtaaattttacgtgacgggtggtgacaatgagtccgtgtcgagcgctgatt

SEQ ID NO: 35673 - DNA, 822 bp, Oryza sativa
agtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaattgttttcgactggggcggctggaggatttgggtggtgtccggaaaaggctagtgccgtccctggtcaattaaggaccgagccatgaagttaagcatgaaacgacccccgtacaaccgcatttctcgtatgggtatagacctagcagagtagatagctgagcggaggcagtatccatgcatagtggtttcttgatgtgtgaggcaggggctctacggtggggcagccattggtaggaccgcgaggcgggtgtctacaatggtgtcgccatcggtaggactgccatgtgagaatctaaaacataattataacttaatgcatgtgtgagtcttcccttcccgggtgcgccagaactcctctcactgctagaaaccgtgtacgcctagagtgtatgaggatgaaaagttcatggagcgggtactgccaatgcgaggttatcgaaaagctttgccgtgacgcgtctcatgtgttgggacgaggctcatgtgttgggcagtcgcggagtgggggtaaagtgtacatccactgcagtgtgagtaaaccaaatctattcgaatagccgaacttgaggttattgagccccgggacatgtattacacttggctagactctaaattcttaacttgtgtggg

SEQ ID NO: 35674 - DNA, 753 bp, Oryza sativa
  unsure (1)..(753): unsure at all n locations
atgtaaaaagtacagccaaaatatttttctatgtaatgttaataaaaaataaagaagtatttgttggtaaaacttgttaatattgttataaaaatgtattgaagttggttgttgcgcaatttcatatgttaagtgagatattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttcgattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcgagcaaagttagtcaatgttgtgagaaaataaggattaatgtaatcaaaatattcttaccatgaaatcgtcgtcaagaatatttggacaaacaaagaannnnnnnnnnnnnnnnnnnnnnnnnnnnnnnnnnnnnnnnnnnnnnnn

SEQ ID NO: 35675 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnnaaaaggctagtgccgtccctggtcaattaaggaccgagccatgaagttaagcatgaaacgacccccgtacaaccgcatttctcgtatgggtatagacctagcagagtagatagctgagcggaggcagtatccatgcatagggggttcttgatgtgtgaggcaggggctcacggtggggcagccattggtaggaccgcgaggcgggtgtctacaatggtgtcgccatcggtaggactgccatgtgagaatctaaaacataattataacttaatgcatgtgtgagtcttgccttcccgggtgcgccagaactcctctcactgctagaaaccgcgtacgcctagagtgtatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgcttgcgggtattgagcaccgggacatgtattacacttggctagactctaaattcttaactngtgtgggatgggatattgcatgatgaaatttatgctgatggaggcacatcccgagagaagggaaggtggacattctcagaaaaccatgacgaatcaatggcgccgagctatcctt

SEQ ID NO: 35676 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnnnnncatcaacgagccaatgatttgggagtattctagttgattcctagcaattctcttgttcttgcgaagcaacaagctaggatcataagatgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacatacatttatctgcctcattgactgcaaagactgcagatgtcaatgttttgtcaaatttctcatgccattgcttaggagcttgtttcagaccatacaaagacttcaacaatttacacactttgccttcttgaacttcaactacaaacccatcaggctgatccatatagatctgctcatccagctcttcattaagaaaagctgtcttaacgttccatttgatgaacgagaagaccatgtgaggctgcaagggaaagtagcacacgaattgtggtcaatctagcacaggtgagtaagtgtcaaaaaaatcttcgccttctttctgagtataccccttagcaacaagccgagccttatccttt

SEQ ID NO: 35677 - DNA, 548 bp, Oryza sativa
  unsure (1)..(548): unsure at all n locations
nnnnnnnnnnnnnnnnnnnnnnnnnnnnnnnnnnnnnnnnnnnnnnnnnnnnnnnnnnnnnnatcacggaatccataattgtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggttaagtcttttggtgatgatttcactgtgtacctcgtggatgacactcctaagtcaatttcagaagcatatgcatctcctgatgcctactgatgcagacctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtataaggggtaccgagct

SEQ ID NO: 35678 - DNA, 632 bp, Oryza sativa
  unsure (1)..(632): unsure at all n locations
nnnnnnnnnnnnnnnnnnnnnnnnnnnnnnnnnnnnnnnnnnnnnnnnnnnnnnnagagccattgatttggatgacagcccagattacagtgaaaacacggtacaaattaaagcgaacctgcaattacagtgtctcacgagctgctgcttgacaacttgcgaccatataacagcctaagaaaactgatcatacagagatatgagagttccaaatatccctcttggttgggtgagccttccttctccaacttgacaacaataaagttcttgttctgtaaatctgagcgacttccaacgcttggtgagctaccgtccctccagtttctccatgtccgtgaaatgatgtttctgcaacacatccgacaggagttctgcagccatggccatggtttcaagggcttcccagcactgaagaaactgaaattcgtgcagatgcccgagtggtcagagtggtctggggtggatgatggtgcatttccgcgcttgcacaggctttccatcagatgtgcagataacatactgtctcttcctgtagcgccctttctgtccttggtttcttttcaagtgacagattgtcccaatatcactgcgattccagcatcgcccagcctacgtcaactacacatttgtag

SEQ ID NO: 35679 - DNA, 496 bp, Oryza sativa
aagaccatgcaatcaatgatgtaccaagaaaatgacatgttccactagaacttttcctatcaattctacaaccagcaaaatcaacatcggaatatccactcaagcatatagaagatgaagtagaataccaaattccaaactcaagtgtatgattcaaatacctcattattcgtttaactgcttgacgatgcgaagcacgagaaggaagcttgaaaacgtgcacacaaacacacaacaaattgtatgtctggcctagaagcagttagatacaacaaagatccaatcatatttctatactccttctgatcaacagcttcaccatcttcatcaggatccaacacagctgtagataccaattggtgttgaaattggctcgcaattctccatcttgaaccgtctcaaaagatcctatgtatacttcgtttgatgcacaaaagtaccttgaggtgtttgcttaatttacaatcccaaaaagtacgataactcacccatcatg

SEQ ID NO: 35680 - DNA, 427 bp, Oryza sativa
catgtataaatagagaaggagggtgaggcttcccggtatcgcttttgagagcaatagagttgatagtttagttagggtttcgcgtttagtctagatttttgtaaggagtgctattggtgcactttgtaaacacagagagaaacaataaagttatcatctacttttagagttattcgatttgtgtttcatcgggtttggcggtctaaccggtaactcaccggcagtcagaccgatggcaaggcgacggtcagaccgacgaggtagcagcggtcagaccggcggtgacaacaggcgacggcgataagttttggtggttagaccggaagatcaacaccggttagaccggttaatctattccggtcagattgcagatcattgattttgagggtaacttttaattccacaataagtttgggtttttgggtat

SEQ ID NO: 35681 - DNA, 2112 bp, Oryza sativa
  unsure (1)..(2112): unsure at all n locations
agagtgacaagagaaggacaggagatatatatgagagcactggcaatggtagtagaaattaatcatcatcatcatataaatggatctaaattcagtctacagtattatgcacaagaattatgcatggaccaggggaccatgttataattagccccagataatctagttcgtaatatcagtgacaacttgagagaaattttggatgtattagcagaaagcaattcaaggaccaattcattggatgctatggttgtgtggctgaagggtggagactgatcatatcccctctcgttaggtagtacagtccattaaatatattaattagtctcatttaacattaatctttttttagcgggttaattatttcttctggccattcattcagctagctaggctgaataaatatatataaatgtatctatcatgtaattatcatctccactactcacaaaatgtttgcacacatggaccacaagatgcgcaagctaattgaaacctccacgaagtttcaacttttcttcagatgacgcacttttctctcgcagatcgaagcagatgtcgattgattgattgatcactatttctagctccagcgcgtgtaaagtgcaataacatgagtacacatgagccctttttttttttctcaaatcaaaagctaattgatcgatcaaaatctccatggatctccacaagcaaagcattgaagctagcaagcattggtgactggtgagtctgatcatgaattcatgataagatactcaaccgtcgccactatcagtgataagaatagtgaattattcacaactgtgtgcatgtagacgtggatcaagattaaactactcctaacagcttcgctttcagttagttccagatgttaactaactagttaaaatatactccaccaaagcatatatatagtggttcatgatgaagcatgaagatgcagagaaggccttcagagacttgcgcactaaattccacgatgtgcagagtttcaaaatgcatggatagtataataatgaagcaaagtttgaggttgcattgcattgtggcactcccactacgcagagttgaaatccaattcctagactatgtgatgccatacactacactttctcatgaaattaagtaattaacaaagagattaagaaggaagcagcgctagctcagcaaacttcagtcccaaaaagaagctaaagccagttgtgtttttttccttgcactaaaaaaannnnnnnnnnnnnnnnnnnnnnnnnnnnnnnnnctgtaaaatctgaacactgctatcgaacatggtggacatctgcttatgcccagcccaattatagctgggcttaatgtggaataagatgatgggtgtgtctggttcgcgagtgttcgctcgtcgcgagtcgtcgcttctcggctgcaggtaatctgtcgcgtgatgtttagcaaaatcgttagcaaaatcttttccaaaaaacttttttctcttagggcccaacactaaccctagtgggctaggccgacctagctagcctgcctgcgtacctaacacgaggaatttaactagtatttgccactgctacatttggtaattatccgcgtgtactttttagattctaaactccagcaagatacaattttttttcttggcttccttttcaaactgttaaatgatatgttttacacgaaaacttaactattaaaaaatcaaataaatccatttttatgtttttaataatgaaatcttaattaattatgtataaataacttattcatttgcgtgcgcacttaatcttcatcattccatcacattcaaatgggaccttacaaaattgccactgaagatagatatttttttaactattttcagttttgcctatgtgaagagccaacatgtcttgttcgtgtggaaagcaatgtgggcaccacatgtcagcctctcaatattgcatccaacttcaacctcggacaatcaccacttgactcgtgcccttggctcccgagcactcctaggcacaccgaccacacccagaacccctagttgatcaaccagaacccgtggattcccatgtccttatcttctccacgcgtgatggttagctccgcatggtctaccgtcatcga

SEQ ID NO: 35682 - DNA, 18106 bp, Oryza sativa
  unsure (1)..(18106): unsure at all n locations
cttcacattgggttgacagatggctcgtgcctctgtaataaacctgaataatagtcctgtacggactgttgcggtgattaatttagaaccatcttatctcagcagcagtaaagcactaccacgtatgtataggcacctcttttaactgctctagatcatgatcacactcttttcatgtatacttcctccgtcccaaaataactcaattcgtaggtttccgcgtccaacgtttgatcatccgtcttatttaaaaaaaaataaaaaaattttaaaaggataagttacgcataaagtattattcatgttttatcatctaacaacaatgaaaatactaatcataaaaatatttcatataagacggacagtcaaacattgaacacaaaaacacaagaattgagttttttttgggacggagggagtaggcactggtcccacagtcccaatgcgcgggagcgcgtcgatcccgcttggccagtctgcgcaaccacgcgcgtgcaccggtggggtcccacccaactcacatgaatctgggtttatttgctttaactgtgtgtaaaatttaggagtgattggacataaagtataggagtggttgattagttttaactgtttgcaaaagtttaggagtgattggatttggttttaccgggaaggagagcgctcccgcgtttccaatatgtggcagcccgtcccgtacatctattccgcgggaccgagccggtgtcgctcggtcccgcaaaccaccgcggtgccgctgaactacccagcggaagtgcgccgatgccgcatgcgcaatatgcgggaccacgtcggtccctcacatccaacctgcgtgaccgatacgaccactggtcccgcgccttcgatctgcggttacgcgtcgctcccgcatcgccgcaccgtgggttaggtatattttcgcaattccgctccatgcatatatataaacacaaattatgaaaaataaaggtatattttttaaatttaattcctgcactctcggtgttccaccctcatttcttctccattaccctacttaggccgtgttcgtttcccacggttggaacccatgccctgcacacgggaaaaacggagtagtccattagcgcgtgattaattaagcatttcctttttttttttcataaatagatcaatatgattttttaaacaaccttcgtatagaaacttttttaaaaaaatgtttagcagtttaaaaagcgtgcgcgcgaaaaatgagatggagggttaggaacctgagaaacgaactcagccttatagcaaggataatagtagagcccacttcctactattagctcatcttaaagccaacatatataataaattagctatcagattggctacaattttttttcctctctatcataaacaacatgtatttgttttagagcttgtgttaagctagttcttgcatgagagccaatactcttgattttttttgttacctctctcctccacgtaaatttgtactacctccgtttcaggttataagacttttagcatgtgcctagattcattaacatttatatgaatatgggcaatgctagaaagtattataacctgaaatggagaaagtagtatacttatagcacactattatacttgctcttagggtggcgctctcctcgatgaagcgcctttggcatgttcttcaaggatgagtacctcggccttaggcttagttcggcaggatgggtttcccaacccatctcacttgtgttccacgtacacgcttttcaaactattaaacgatgcgttttttttaaaaaaatctatacgaaagttgttaaaaatcatattgatctatttttgaaaaaaaaggaaatacttaattaatcatacgttaatggaccgctccgttttctgtgtgctggagatatgttcctaggagtagcgaacacagcctaagggcctgtttggaggagtttctagccgctgcaacttctcacagtatcagaagctcccctaaacagtccagcttttggtccagattctgagaaactgtacttgtagaatccagaaaataagcaagccagaagctgggaaacccaacttttctagggcctgttcactttgatgctattttcaaccttaccaaattttggtaaagttgttaaaaaagtggctacatttagtttgctgccaaattttgctaactatataagaaatcatgccaaaattttggcaagttgccaaacttttagtaactatgccaaaattttggcaatgccaaaatttagtaaggtttttttttgcaacaaagtgaacaggcccctagattatcagaagatggttaccaaccagctgcttctcagaatcttaagttctccaaacaggccctaagcctcgccaagagcgccatcacgatatcccccattgtcccatcttctccaccgcgccacaaagctccgccccctacagtgtcatccccaagcagaggccgttgtggagaggagagagaaggaagagcagaaagcggagaggggaaggtggcagaggagaagtaggttcccatattaatgggcctgttttgttggtgaaatgaaaattttttggtgtcacatcggacgtttgaccggatgtcggaagaggtttttggacacgaatgaaaaaactaatttcataactcgcctggaaaccgcgagacgaatcttttgagcctaattaagccatcattagcacatgtgagttactgtagcacttatggctaatcatagactaattaggctcaaaagattcgtctcgggactaatcatagactaattactgtgcaattagtttttttatctatatttagtgcttcatacatgtgtccaaagatttgatgtgatgtttttacggaaagtttttgggcatcacgtcagtcaaaaaaaaaaaacaaaccattctcgaaaacaaccgagcgagatggttttggttttgtggtaaaagatgagattcagccaatattccgagggagtcatagtggacttgtatttctttcccgggttgctgattccgccaacattttggtctttactgggcccacgagctgctgctcctcttttcttttagtactccataggaacctcctctctcatctgagatgagataatccctttcctctcctctccgtgggggtgctgtgtccaccttcggccgccgccatggacaggaatggtgttagccactaaaaaaaactaaataaataaaagggcctccgctgggaacacacaaaggccaaggcggaggtggggaggtgcctgtagagcgattggattcgtatataaagaaaaggtaaaactgtgccctaaaccgtttccgattcttcctaccgatcccgtttccgattatttccaataccgatcttcgattgttaggtactcgtatatactatatatgttgagtcgattttgacgagaagggagccccttcccgagagattaggtctggtctgaggagaaaatacgctccgctccgatccgatatactgtcagcgaagtagttgtcgatggctgcgcttcgctatgcggcgcggaagatctgcggtcgcgcactacagcgaccgcgggttgtatatccggcggtcacatcgccggctttggaggcggagcggaggctgttgcccatgcttatccgtggcgagatgcctcacatctcatatacccgccacttcagttcctccgctactcctcaaccaccccttgccaacaataataaatcgatttctggagtaaagcatcaacctctctttaattaattacagttttccaatgcatagcacatgtacttaaattcatttcttttattatattgttttttatagtgagatactcaggtttccttaattaaatgcaccgatgtaattatttttgtatcaaaacttttctttgcatctttattcggctaatgtctataagttaaccccttttcctgtaggctccacttttttttttttatgtatgtaaatttagtgtagcggcaatgtaaatttttccattttgttttctgcatggcttcagtaaagcctacaaaggcacttctacaatagttacacaaccaaaattgctccaatagattgatgtccctcttagacaggtctccacagtccgttgggcaagaccagtccaataattcaatgtaaccacaagaccataacctgttatgctttatcgacaattttagcccattggtaggcctaaaaagaattcaaccaaagtcttttttttttaatttttcaaactcaatttgaagttgattttaagatattttcaacatagtttctttttcagcattggcttttaagttgctaagaacacattgtaaatgttttagacaaaaaattacttttttatcactaataaaagccgttgtggcttataataagtctttggtaaccgatgagacccttagaccatgtagttgaaaattcggttttcttttacctcacatttgtgtcaaatctccctcataatatagagcatgtattatcttgaaaaaagttgaaggccatagatttttaccagcaattggtccaattattatgggttcatatttggatgtactttcacgcaatattgttttccaaattctgcctaaagcttgatgtaaaagtgacattgacactgttcaaactttaaagcttcttcttatccaaccaaccagttttaccactgtacttgtttcctcatgcgttttgtgttactatttggtttccttttcataatgcaattcacggtgttctttgtattttcagcatcgtttgccttgcccaaatcctgccgcagatgccaaggttcataacaacatagatcctgcaagtcttgagacgctagtgcaggagaagaaagacgagctgttccgtctgctacttcagatggatcttcacaatggctcgtgtgaaaaaagtgccgaggagaacaaagccatactgaggctgcttcggcaattccgtgctgagacgcgagataatggtaccttgtaagtaggctctacgaactatttaccttttgcttgaacttatatttatcttatattaagttcatcttgtgggctgcaggtccggtgctgatacgaaaaacttggccaatcgatacgtcctacctgtgtccattattttgagtggtatcatcatcgtcgctcagggccattttatatctcacctctgaaatgggggccctgctcgttcgaagaataagttatctaacggtgtggatccccatggtgcggaggctaaatatcaccatgttatcttttcctcttttttttttttcatattttaagaaaacgataccgatgtgttctctagtgctaatggttagcgagttcgcttgctgtcataaccaattctcttgttcgtctatgttcgaattgtcaatgtcttctttctctgaaactagcgaagtgcatgtgcctttgcaacaaatctaaataaattgttaaacaaacatgctcatcgtttttttggagaaaaggcataagcccagctttttaacaaagcataagagttcgaacagaatgctgggattaccagctatacaggccaagcgcttacagtctagaaagacagaaaaaaggactaacgctgctggcacagcacagggaacagcaagcatacaagtccaaaaaggagaagcaatgtcagaaaggggattgatcagaacggcgacattaaggccctttgatttggaggaaaaacatagaaattttagaggatttcaattctataggaaaattttctatgaaactctttgaaataaagaattgaatcatatataatcctttgaaattactataaaatggacaatcctaaagggattttggaggaaatttagccagagtttcatcctcttgctaactttcctttgagtctatatctctcatccaattcctgtgtttttcctatgtttcaatcaaacggtcattcctgtgtttttcctgcgttttgcaatcctctgttttacacttacattcttatcaaaatcctacgtttttcctattcctacgttttctcaatcatgcgattaaagaggcctaacttgaaccttctgtcgcgcggatactggcaaacaacaatccctgtgctctctctatctcgccccttaactcaattggtgacaagcttttccactttcacaaacgataaagctttataaggcaaagatacaatatttttcacaagtcaattgaacacccagtcgtttctcacaagccaaatcgcctaagcccctgcagcaaaataataccacaaggttttgttttcaactcccctctggttctgaattaaattcagaagatcaaacatctttgactcccccaaaaacaatttctctgtaaggagactttgtggtaaattgtcctgactgagtcagcttccaaaccatactatctttttctgttgtcaactggattggagcaagcctctcttgcagctccatccattcaaccaattcattttgacccagagttcttctcagattgatctcccattccccctctatcaacatttgttttacaatactgttagggtcagaacagatgctataaatataaggaaattgagtttttaatggcatctcccctatccagacatcatcctagaatctgatagcttctcctagtttcattcaccttttaacacacacacacacacacacacacaaaacaaggactattacttccagatttcaacttatagatccactagtaatatgctcgtgctaaacgctacggtgatattttgtaataaaaatcaaataaccaaaaaaaatatatttttaatggttaattggatacatgccattacaacttttatggttttgatatataccattactattcaactatttaaaaccatgacattataatttcaccgctttcaatatgtgccactacttaccccttcagggtattttctcaaatattttgaccgaagtgcccttgtcttcttcctctctcccgttcatcttctccccacccttatcctcctagaagcagcaactcaggtcatagcagcaagcaatgtggtcaggccaccggcgacggcatggggcatggcagcgaacaatgaagttctggcggatctggagaccacgaccacctgaacaacgccgcacatatcctcccggccaactccgtcgtccaggacgcgaggatgggggcggtaggaggagcagccacctcctgtggcgaggatgggggcgggacgggcaggggtagggaccttgaggcgaggtagtgacgaatgggatgggatcgacagcattgggctggtgccatccatcgttgtcgccatccataagctcaacttcctctgtcgtccacaagctcaccggcgacaatagtccctgccttgctgacaacctcaacaggggggaaggctggatcttgaggaaactctcccgtgcggcgctcctcaccaagatttaacccgacaaatcaaagaactcaaccaggagaaaaaaaaaatcaaagagcaaccccataaaaaccaggagcaaaaatcatcacaaagatttgaccaaattaatcaaacaagaactagagcaggagcaaaaatcgtaaggaaagaattcaaagaaaaaacaaaaaaaataaacaggaaaaaaaatcgtggggaaattctttgctctctgagccgtgtcctcctcatggatgcaacgaggttagaatgttggatacttgatgccacctgctcggcgccctgccaccgccgctgcttttgcttagagctgcagctccatggagaacatgaacgtgggtgggagagtatgggatgaatggagaagataggggtaatatggtccaaaagatttagaaaaagcaatgaaaaggtaagtagtggtatattaagagggttaattggatccatgccattacaaatttgttggttttaaaaaatatcattactgttcacatatttgaagcaatgccattacaattttataactattggagatataccactacttatctattggatgtgtttatatttttttttaccaaattatcctatcttcttcctttccatctctttttccatgggaacacccaacacaacagtgatgaactcgttcaagttttcaaaaaaaaaagaaaaaaaaatcgtgcaaccatcgaaccttcggttctcgtcgagtaggtagctgaggacgatgcaggcgagcaacagcggcacaaataggtgcgaatcaatcaatccatcaccccgagctccctcttgctcatgccaagctaacacgagaaaggggacaaatccaagaaaatcacccgggattgctgttgctcgagaaagtggggggaatggattggaaatctggtattcgatgtgaacaaaatccaaactttttatccctctcgtgcccctctcccctacccttatagaccaaaaatgttcctgtaaattcatagggacaaaacagaagaaaaatccttgataacagtttcctaggcgtgtctgcctctattgctgcttcgagcacaagaaagttctcgcgtcatagctaggtggcggatgccttccgtgctgtcgcgctccaagagcttcaccctgctccatccatcgttccgccgccagtgagacagaggatagaggttgagaggggagggaaagagggatgaagaaagaagacgagggtaatttggtccaaagaaaattataaacacatctaatgggtaagtagtggtatatcttcaaaagttatgaaattgtaatggcatggctccaaatatataaatagtagtgatattttttaacaccaacaaatttatgatggtatggatccaattaacctatatttaaaatagctgtgaagttatagtggcatggttccgaatagatgaatagtaatgatatgtttcaaaactgtaaaaattataatgacatgactgtaattaaccctttttttaacaataggacgagatacgatggttatgaacaatgttgcacataattcttaataatctttttaactgaagaaacaagaggatttgtgaatacaagaaataagattaatgaaaaaacaagagcattgtcaacatataatcaacaaataaaattgttgacataatatttttcatcctctaacagaagaaacaagatgatttctcaacggaagataaaggatggaacaagaacatttctcagcatatgacaaataaattgaaggagcaggaagacccgctcaataaccctgctcgttttttaccatacaaagcatgcatccattcagacagaaataatttagtttagatgaataatagtttcactcacaagcaactaataactgacaaagacaccgcttaacttgatcttacataatacttaaaagcatttccattatcattgaacaatagttatatggaacttaaggcacccaaaccactggtcaaaatctgcaattaaaaatgcactctgtcgattaaatgggcataattcaccaaaccggtttgagcttccaggattattgtgcatttgtatgttgatagtccttcacagaactacagaacagaagagacccagcgagaatcaggctcgcgagtacaacatcataaatccactggaggtcttgatgctagagtccatcgcccatggcgtgctggtcgtggcgtggccgcacttctccgaccagttcctgaacgagcggctcgtcgtcgacgtgctcggcgtcggcgtgacgacgcccgtgctgctgctcggcgacgaggccatggcggtcacctgtcacccggggtgacgtcgcgcgggcggtgatggcgctgatggacggcggcgagcacgccggcgagaggaggaaggcgaaggagtacggggagaaagctcgcagagccatggagaaaggaggctcctcgtatgaaagcctgacgcagctgatacacagcttcaccttgcaaggagccaaaaaagctctataacagtagaacagtggaggtgcaaacaaaagcacatttgaatccaaaagttgcactgtttgctgaatatttttccattttgttggcatcagatttgcactgatttactccttcaattcacctttttcttattctgaagaagttaatggataatgtaattctagtagtgaacagactttcttcatgatgtggactgagaatcccagaaacgcggaggcggctgcggcggcggcgggcgcggctgggcgacgtggcggagctggagagcgtgctggaggtggtcaagacggagtcctcgagcgcacgcgtggagctggagctcgaccgcgcaaggaggtgggcgacgacgatgccgccaacgccgcctcgcgccccaccgtgcccgtggcgcgcgtggagcaggagctcgaccgcgcgtggagttggagctgctcccggtggtgtgcgagggcgacggcgttccccggccgtcggacgtaggccaccttttcatcacgctcggcgggcccccggcacgcccattgccgggcaccaactcgccgctccacatctgtgacatagagattgagagggagagggggagagagagagagagagagagattgggaggaagaggggaggagagagaggncnnannacntnacangnnggccccaccattttttaaaagaaaatgctaactagattgccacttgcataccacgtaggacaatactgctttggattggatcgaagggggttattcatctagtatagatagttcagggtataaaatgtctggttttgtggtttaagggtataattcatactatcgtaatagtctggggggttaattcgtactttttctttaatcaaatggttgaggtttatttctactaccaccataattaacagtagtagaaacgtggaggggtagtattatctaagaaaaaagtatgcacggggtataatcgtaatttatcgctcatgaaccctagcaaccacttttgtcgatggattttgccgccgcccaaaacgaaccgcttccaactcacttccgtcgcctgtccccctcccttcccgcctaagccgcctcccctaacctcggcgattccaccgcctatgttgctagtttcttagaacaagtataataggaggctgtatgtcggctaaatgcttaggtggaggagagaagataggagagagaggagtagcgggctgtaaacttacaactgacttggacgcaagaaccaagaatttctgtgagagagataagtggtcatatattaattgtaaatagctaactattatatgtgtgggctaagagaaggctgaaaaaaaccttaggccattcccaaccccaagacactagacatggtttccataaacttcacatcatcaaaaaactagtactagacactacccttccaatacaaacaccactattccatacttaaatttaatactacttatctcacatgatgtattggatgttgtgtagaaaccatgtctcatacaagacatggtttccttctctttcctcatttattcacttgccacatcatttttcatcctaggtgataatttatttaatgctatggatactatcctagtcattgtgttaggaatggccttatagccaacaagtcggttgtattattagccttgctcttaaatggaatcgatatgttcagctgtagagtgcagagctcatgtttcttaaatgaaaccatcttttctggtggttatactgatacagtaagcagtacacaaattttgacaagaggaacgaacaggatcgcagccatcttattacgtagtattgatagatctgtcaaccgctgtcagtttgagcatgtagcagccttgccgttattaacctgtgttctaaagaatgggcgtgtaaatatgagaactccacgtacagttaaaaatatgcatattccgggaggttccaccattttcaggtgcaggacaatcacagtcaaacacagtccacagggcatgttcagcactatctcattttgcaagccgaaacgtggaaatgaacaagcatctcgcttacaattacagatcataccatttaggacatgtttagttccctaaaaacttttcgtaaaaaacatcacaccgaatctttggacacatgtatagagcattaaatatagataaaaaactaattgcacagtttgcatgtaaatcacgagacaaatcttttgagcctaattagtccataattagctataaatgctatagtaacccacatgtgctaataacggtttaattaggctcaaaagattcatctcgcggtttccaggcgagttatgaaattagttttttcattcgtgtccgaaaaccccttccaacatctggttaaacgtctgatgtgacatccaaaaatttttatttcaccaactaaacaagcccttaccttgcataatactccatccatcccaaaaaacactcctttccttggttgagtttttttttttggacggagggagtaaatagatcacaaacagagtactaactgataataatctatacacgagcatctctgaatattctcaccagcttcacacataggactgttgttttccatcaaccactagcttcagacattcgccatataggactttttttttccagaaccactacgatctgtgaatcttggtgctcttggagaagcattcgccggcggctgctcccagtcccagcttcactgcctggagcgtccgcccccagatactgttagcaaagtaacatcatttatggcttgaggatacatcacaactgaagctcaatacttgagatgactgaaattgcatccttcacaaagtgtcccctgtctaaatctttatcatatatagtttcttaaataaggttaataaaagaatcaaggtataatatcccagtgtacatcacaattgatcatatataggtcttttcagagctatctaagcatagaaactgaatcagttcgtgcataagaagaaaacaaatgtctgctcattaccaaggatttatgctcacactacattgctattcgaacatgaacttgggttgaaaataagaatttgtgaaaaaaaaatggaacgttaattggtgaaaaatttaaccaaatattttcaatacacactgtgatcagactgccaaaactaatatactataaaactaccatcgctacatgctgcaaccaaagtttgggattaattgttctcaaatgaaacacagatttccttcacctaaaaatgcagagctaatcccaagcaactcactgttggccttgcaattatcttagcaggtaaacaatgttaaacgaatataaggcaaatcaataaaaaaccggacagcaaacctgaggatgtgatggcaagggttgttcttcgcagtactcgtcgtgcgcacgagacttgcacaggaatggaacgaatcggcctccgaggttggcgccgccgcaggtctcggccgcacgcggacggggatcgtgaaggcggcgccggaattcgtcagagcggcctccgaagtgggcgctgccgacgcaaatcgggcgcacgcggaaggcactgcgcgcgcatccaacgccagcggccggagtcgcgctctccacagcagtcgctcctgcacgtacgcacacacggcggagaagtgggttgacgccgattaatggaggaggcgaagaggaacggaaggagagggggcgccggagagtttcgccgtcggcggaagggaacgcgatatactcctacaagcgcaaccgttggccggagtcgcggatgaggaagcggcgactctgctttttggattcgggttttgataaggccgtgggccgaccggcaagggacggaaataagtctatattaggtccctcgggccttcagaagcatttacaattattgaatgtgtttatttctaagcaaacctaaaagaaaggattttctttctttttccaattaaataattattaaatgatgtttgtattattaaaattagcaattaagctctgaaaattctaataaaatttcaaagagcgtaactaatcattgagaatttaataaaattaaatttaacaatgtcattttatttctcacacttgctttacttgtaaatttatttaattatacacatacctacttaaaaataccaaatatttcagtgaatttgtattttaattaattgtatatttttttgatatatgcgcttcccggtgcaacgtacgggcacttttgctagcctatccttaaataaaaataaagggttcagattagttctaccggtagtattatactatgcaccgaagtgtcgcccatatcaggtaagcgtgtaagctttgtgtcatttgttcagtttgggtagaataatcaaatctcacaacggaatggtctaataaggctgtatttagatccataggtataaaattttggcgtgtcacattgaatatacggatacatatttaaagtattaaacgtagactaataacaaatcaaattatagaatccgcctgtaaactttgagacgaatttattaagcctaattaattcgtcattagcaaatgtttactgtagcaccacattgtcggatcatagaacaattaggcttaaaagattcatttcataatttacacgcaatctgtttagttagtttttttttatatttaataccctatttatgtgtcataacatttgatgtgataaggcgaaaaattttgccagggtctaaataggacctaagcttattttggaaagcatatgccctgctttgtgacttcttgtttcatattataatattctgctaatgcattcctttacgaattgcttaccagtaagagataattcatttcaaagggacttccgtaagatatcaacacattgaaataacctcatacattctttgacttgtttctccaattcgcagggtgcaagtgttacttttgatctgctgttccttctggtgattggctcctatgtaaggctctcatcttttggcccaatcaacatataccaatgtcaaaatttaattttttaaacttaattttaaatttatatttgatttttttatcatagttttcttttacaatattatgatttaagtcgttacaaacataaatgtaaaaattttaatcacaaattattttattttgctaatatgccaaattttctgcatatagccattcgatgaggcccttattctcttcaatttcgtagtaaccgctgcacgggtatgtatcatttcatgagtcttcgagtatggacaggaagctttgtttttcctgcagttgagaacttttttttttcctgaacagggtcctgaagatctcattaacatattctggcgacctccgtcaagcaaaatcaaggggcatagggtagattgtgctctgtgtatttatacctcgtttagttggagaaaattttcgtgtttaattgtcatatcgaatatacggatacatatttaaaatattaaacgtagtttaataacaaaaataaattacatattctgccagtaaactatgagacgagtttattaagcctaattaattcgtcattagcatatatttattgtagcatcacattgtcaaatcatggcgcaattagacttaaaagattcgtctcgcaatttacacgcaatatgtataattgatttttttcctatattaaatacttcatgtatgtatcaaatattcgatgtgtcagcgtgaagttttttttttggaattaaacatggcctcttatccagaaacgcgatgccagtagagctagacaccaggatggcaggcgagacgaccccgctctccgcagcagattgacttgcaatttcaaaattttcttgggctgtgtttagtttcacattaaaattaaaaaagtttggttgaaattggaacgacgtgacgaaaaaattgaaagtttatatgtgtagaaaagttttgatgtgatggaaaagttgaaagattgaaaaattattttggaactaaacacggccttgttctctagccaatgttagtgccttcagatactgctgtattttgactggaaaagttgggttttattttgggtgaatagctagattagtcctcaattttcactggaggcacaatttggttctctatattttattttgtccacatatatcccctaagtatttattttggcttaaaatcatcttggcccaacataatattctatatgactatttctagtcaatatttatattagaaaatgtcccttttgcccttaatttgtatacaagtatacactagaaaaagagaaaatcaagatgaataaacaacattgcatatgtaattcccattatttcaatatgtgcacataaaacttaaacaatagctatcatatacacttgcaagtacataatttatttttgctttacataaattactatgtattatctataaaaaaacccattgcatgtaattttttctcttatatatgtaaatgggggatataagtgtcatttatcaagagagttgttggttatgtttagccatatggcttctaagtgggtctaaggataagtttgaactaaaatgaaaacctgaagaactaatatggatagattaaaacatcaaggattaaactgagtctcggataaaacttggaggaccactttaactactcacactattttctcttttattttactgccttttaatttgctggtgctcgccattttggctactgtggaatcaaaggcataattatcctgttagtatatcactgcacgtctaatatgtgcaagatgtttgatttgtactagcaacttttccatgtattgttggcgttcctcagaacgtgggatggtaaatatggcgtttgtttcactgtttgctcaatatttgcagaacaggcatcgacaatcttaactggtaaagcgaaatgaaatgatgcaactgaacgctgaatcaacactatactatactgaacttaaaggaaaaaaaagaaaaaaaatacttctgtatgtagatgatgcttgagcaaaaggtataaaccatacaaatcgacgatcgttttattttaggaaggaataagttcacttcgactctcttaacttgtggccaaatctaattcatattcctaaaccacaataccgaatatgttgacgcctcaattgttaaaatcggtgcaatataactctctcggtagttttggaggatggtttcgctgacgtggtgcctatgtgatggtgttgacctggtcattgttctacgtggcattgatgtagcgattatatgacattagaactaaaatatatatgtgtgacacatttatcattcacactacaaaatattgtgggacacactaacatgtggggcccacatataatcctctctccttcctttcttcctcttccctcctctctcctcatttttctatcccctttctcttccccttcagacctactccctccgtcctaaaaaaaacacaacctaggatgggatgggacataatctattataacgtatctatgtccagatacgttgtactagaatatgaatatgtcccatcccatcctaggttgtgttttttgggatggagggagtacgtgggggagcggggaccagatcaatggcagcaaaaggaatagcggacgccggcggtttggaggcgacctttcactaggacacagcagaaccaagggtcgcggtcgtgcggctaggacgacagagccaaggaggacggtggtggctcagcctcatggaggctcacggcagcaagaggacgagggtagtagcagcggtggatggtggcgagctctcaccgggctgcagtcgaacaaggggcggcgatcagcgtctaggacggtggccactcagcctcacgaaggacgggcggatgagtttctccgcagcggccgcgaagtaaaggccaacgacttcgttgaggctgtcgtcaagagttgaggtgatagtggcagcgtctcgactgtcgcacatggcgacgtccatgaaccgcgagatgagatcatccttgtcgcaacggatgacctaaagaggtagtcacaaccgtagtcgtcgtcctcctccttatcggcttggtggtggtcgtaacccgccgccgccgccgtcgatccggtccctgctcatacctggttaaggtcgttagcttagcataaaatttccctattgaagcacaagagagggagaaggaagagagagggatgaggaagaagggaatgagagaagatgacaaatgggtcccacacatat

SEQ ID NO: 35683 - DNA, 1776 bp, Oryza sativa
tttaatgacacataagcgccacatcaacgccacgtgtaactaagacaaggtcaacaccgccacctaggcgccacataagcaaaatcactctctaagaccgtcgagggagtcaagttacacccttttaatagttgtggttcaaggttatgaatcagattttgtcactagttaagggagtcaaagtgaacttattccttttaggaaacgaggggaatttgctgggaaaagcggcccagtcgaagacagaagatacagacggcccagtctggcccgtgaagttggcacccatatatatacggacgggatatctcttttttcctcgttgctctcctccccctcgagcctaaaccctagccgccgccacgagcgcgcgccttcgagcaaccgcagcaaggccatggcgcgccatggccttgctgcccaaggagatgcttcgtttggccttggccaggcgttgcaccggggtcttcatggcgaggcgtaccatcctcttcaccgcagccgatggaggggcgtcgatgatgctgcagagggcgaggagctctcacgccattcgtcaggctcatgtcagccgcgacttcgtcaaaactactatatatataatacccatatggggcaccatggtgcccgggcaccatggtatcaaaacaactcaaactcaaattcatttgtatgaattcgattcatacaaatacctaacaacaaaacaactcaaactcaactttatttcacaattcattattatatacctaacgaattatatgtttggatgttatatacctagaaccaaaatctaacaaaaaaaaagttcaaactcagttcaaacttgttagtaaagaagttaatgttcatatctaaacatttaaaaaaatttcatactcattcaaattgggtatatactcaatttgaatcttggagcccatactccatgtagccccagttatatatatatatatatatatatatatatattggtaaggatcggcagcatgccagcatcaacatatacgaagatgcagaccaattgcacaggaaagctatgggccagttgtaatcatagctagaggcccaataagctccaagccaggcccaataatactgtgcgcggttggaatggatagagcggaggggagggtagtataggcacatcagcagcagtaagaggtctgctagggtacggtatcccgtccaaacaagatactttatattgatgatgtcagctccgcctcagctttatccactcatgagtccacgacttagcaccgccctacacgctcacgccacagccggtggaagagcacgcgtgaggcgctaggagaaggacacgacactaatagtggattaggtgacaaagttggtccctgcaatagcatgatgacccttgtatcaacaccacattgagaagaaaaaggatggtgatagtgaaaggaatggaagggagaagacgagacaaaacgctggtggtagatggctcaccacccagccaagaggcaacaacgtacgttctctcccgataccttgatacctcgtacttagtacctatgggttatcggttagcacctataggtatcagctggtacccgagacatcaaccatgataccataggtaccaggtctgaaacctgtaggtatcaaccatgataccacaggtaccagatctgaaacctgtaggtatcaaccatgataccattggcaccaggtctagtacctgtaggtatcaaccatgataccacaggtaccagccctgtgtaggtatcaaccatgataccacattac

SEQ ID NO: 35684 - DNA, 510 bp, Oryza sativa
ccccatatatgcctagctggcttgctctgagcagtaacatgccctgagccaacaacaaaatggtagttgcaccttcacgcactgttggaattttttgctgcattttttgctctgttgaccacacaagcactcttgcacgagcaaggtattaattattttttctttttgctaattctatgttgacggtttcaggcaaagccattactatcaagtggggaaattaaacaattggttgatccattcttgggaaatgattatgactgtgacgaaatggaaaggatgatgttggattaggcctccattctttagctgatgactgactcttgcagccttgctatgcacaaggacatcttctcattcccgaccggaaatgtcacaggtaagaacctgaacaaattacatgtgcaaaatacttaaaaaatgtcttgatgattgacctcaacttgctatgttctggcaacacagattttgaaactgcttgaaggagatgacgaaacgatccactgacca

SEQ ID NO: 35685 - DNA, 893 bp, Oryza sativa
aaagattgcacgtcaatatattagaggaatagagtttttgttacacactgcaattggccagaccggcttatgccaaggaaggggaaaaaacgcaaagtcaaaaaacaacgaagagaaaaaagaaaaagaaaaacttgaacgctactctaaacaacgggagggggcagagtcatgctacactcccaacaagtccctaaaggaagcaacgcccgctaacgaccacaaccggccctccgacaggatggactctaggaccactgagaccgaagagagcgcagagtcaaacaccccggagttatgttccttccatagctgccacaagaccaggaggaccagggagtcgaagctggcacggaggtgatcaggtaaaccagccttggaagatggccaccagtcctggagccagctgccacggggggcgagagggcattccagccaggaggcgacagcacccgtaaccagacctgacgagcgaaaacgtagtcgaggaggatgtggttcgctgtctcgagctcttgagcgcaaaaggggcaggtcgagtggctatcgatgctacgcttttggaggagatcagccatccaacagcgctgctggaatgcaaaccagaggaagaatttgcatttagcagggcctttcgcgttcaagagaagatcgacacaagcaaaggagtgctggccaaggaagaacgcctggtacgccgaatgcgccgagtagcgctggtcactcgtccaacgccagacaagacgatcctgttaacgaccaaatttgctaatccagggatcagagatgaggaagaaatcgagaaggaatcaagattgaaatcattccggaaacagagtaaggtcagctagaatctgaatcggctacgactgaaatcggcagagttcggtcag

SEQ ID NO: 35686 - DNA, 666 bp, Oryza sativa
accttgaattttagcaaaaaatcgccccccttgcccttccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctttgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatctcgactgacccgtcagaggtaatggtcactagtgaccaaatcgtttgcccgtcacaggtatcccgacagaggtgtgaggatctggcgtagtgtatggcgtctacgagtcgtcgtcgtcgtcggggtcggcacgcagcttcacgaggcttgggtggtgcatgaccgagtacgggctcgacgacgacgccactgacggagcaaacaagcaggtgcttctgaaggtctaccgctcgccgcgcg

SEQ ID NO: 35687 - DNA, 11971 bp, Oryza sativa
  unsure (1)..(11971): unsure at all n locations
nnnnnnnnnnnnnnnnnnnnnnnnnnnnnnnnnnnnnnnnnnnnnnnnnnnnnnnnnnnnnnnnnnaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatctcgactgacccgtcagaggtaatggtcactagtgaccaaatcgtttgcccgtcacaggtatcccgacagaggtgtgaggatctggcgtagtgtatggcgtctacgagtcgtcgtcgtcgtcggggtcggcacgcagcttcacgaggcttgggtggtgcatgaccgagtacggcctcgacgacgacgccactgacggagcagacaagcaggtgctctgcaaggtctaccgctcgccgcgcgcggtctgcgcggaggcgcgcacggcggcggcaaagtgctccggctccaagaggaaggcggacgacggcgtggatcacccggaggcgccgccgcccagcgcgcggccgcggcaagaggaggctgggagcgagcacgacgagcagtcatcggagctcctgccggagttggacctggacgcgctgctgtcggcgccgatggacgagaacctggagagcacgttcagcacggccgccacggaacaatacatgaggtatctgttgaacgacgagcctttgccgtgggctccgacgacggagcttgtcgacggcggcggcggcggcggaaacgagttcatccagacggcgaacggaccttgcatggatggcgaggtcttcacgcgcctggctgccggagaaacgctcgacgacattcttggctcgacgagttcttgattgatctctattgtcagcggctgttcctctagcactagtagtgtagttctttcgatcgaatccgatcgaagtaggtttagttagagagattcatggattaggtatttgtttgatccgtgaatagacactgagctgcatgaagatatgcattgctcgatcgatcgatctgtaatttgatgagaagagttgaattgattctttctgtaaagcgtgatgatgtagtgcccttttgtgaagtgaactaatgaaattcatcttcatcagaggttcggagtgttttttttttctttttgatcgaattgaagcagaggttatgcatatgcgttgcttgtttcctcgatcgatctgtaattaatgaagagagttgaatcgatacttttctgtaaagtctgatgtaattctctttttttgctgctgtaagaaattataatacgaatgtttttcttcgcttcagatgtcctacatgctcacatgcatgcacgctggctttctcggtgttcatcatgatgagcccaccttatattgggccgtgtcggcccacctagatccgtatcggccctattttcggtgatccgggttcatgatgggccaattccgtaacgtgtagtgggctcatctcacagaaagccctgtgacggtgtgtacctatctcgctcgtcgccgtcgttggggtcgcgagaccgcggcggcggcgggcggcgaggggccgccggcgccgaggcatccgcgaccgcgaggcgggggatggcgcgcggcgacgacggcgagcggctgcctgtcgctgttggcgtgcttccatggcagcagcagcagcaacaacaacctacggtttctgtttctcccccaaattccaaggcatatcctctcccttatatttgagttcgccatcgtaggaatttcttcagtagttcagttccaaccgaagtgcttgtcttttttttttaatctctaattgtctcatgtgcaattgcatggaagagtagggagagtcttgctatggaattggatggtattttccagcgctctagatggataggcaacatgaatttccctaggatttggtttactgtgacctccgtacggatatccttaaaaccaactgtccttttagttttagaccttttgtatgcttatgtagtgatgtggttccattgatcaacgccttcttttgcaagttagtatgttcataaatccacacagcatgtacacactagacagctttgatactgcattgaccagagttggatttggtagtcgttgtcacaattgggcattagattcaaacagatcttctacctgctcacacagagactaactcttgtctcatactgcaacagaagtcaaacataactttagttgtacatgatgatgtgtttcgttctggtggactacaatatgttcaaccaaaaagaaaggaaatttgtctccaccacaagtcttacatgtcgtcaagagagtggcgaagagtcttaaaagcatcccaagatcatctgcaaattcccccatggctagcttggttgacccggcaaggttgcagaaattgttttcttttccttcttttaatgaatgggagaacttctgctctggtcgatattggttatccacatttccattcctctcagaggatgtatactatataatattgggtaccttcttgtttcccatcttatgggttcaacaaaagaaactataatagctagcatgcagctggttttgctatcgatcatagcatccactgtcatgttggtggcatctggagcacctcctcccactgctgctagtcttgctccctgccccaaaacatgtggagaagtgaacatctggtatccttatggtatcgggcctggttgctttcggcagggctttgagcttacttgcgacaccaccagcaaacctttgaagctcttcttgggaaacactatgactcaggtgattagcctctatccttcaggaactgtccttgcctctatcatgtacactatccccatgattcatggagttgacacctacaacttgtcatgggactctcctgggaggaatctcaacgttgagacctacaattacttggcgttcctcggttgtgggatcggggtttacctgttccatccagatactggtaaccttgtgggtcattgcacgatcaagtgtgcctccatggaggaaatgcacatggcaaccgaaggagggatttgcaatggcatgggttgctgcactgtcacattcccggtgttatttcgaggttttagagtgaccattgttaagagtaacgagacaataccgcagcccttcaacaatatcaccatcaaggctttcttaaccttccgtccttacatttttagcatttgcggatctcctgtccaataagataaatgcaagcaccattggtgcttccatggcatacctctcgactgtcatcgcagatgaaccaaattgtccaacagctcggttggataataagacacaatttgcctgtggcagtaacaattgcatagatgtggcaaatggaggttattcttgtgcttgcccaggaaattctgatgatggcaatccctaccttcttgatgattgcaaacaaggtacctacgcaactctagctcctctctgaacagatgttcctttctttattgattgttaattcactacatattttttgtggtcatatatgtttcttaactggaacagagtttaaccctaccccgaaaaagaattgttctagatcatgtggtagcacaaatattcctttcccgtttgggcttgagccaggctgttttgctaagaggagatttcaactgagttgtgcatcaaatcgcactcttattggaagaccacctgcaaaatatgaagtgacaaatatatcattagatgaaggactcctttatgttaacaagctttcagaatttgaagatgccaacacaaagtatttatcagtatactatggtggttctggatattttggccaacaattaatttatggtttggaaaagtctgatttatctgaagagtatggtgtttggaagtggtctgtgaccaatttgacgtgtgaagatgcaaaaagcaaaagtgcatatgcatgtgttagcacaaacagcgagtgtcttgatgttacacatgggaagctatatattggttatcgttgcaagtgctctcttggatttgaaggaaatccttatgtccaaaatggatgtacaggtacacattcctaatgtatctagtgcattcgattttcttgtatgtggcaggagcatggagatatggaatatctgaagagagtgatatgttatccaatgattttcatagtgtggaagttgtagttaatgtgcatttaattgaaaacaaaagcatataggagccatcaagagtttgatatattaaagttcacatttttagttttctgtttgcagatattgatgaatgctctataccaaactattgtaatgggacatgttataactttaaaggaagctatagttgttgtcctcatggtatgtcttatgatcgagtaagaaggcagtgcacttccaataagaggcaaaatattgttttgggtatgtcaggtttttatttattgtttgctgtatgcatgcactccaattgttgaaaatgttatcaaacccctcaaagaataacttttcaattgctgcaattactcctgtaggacttgccattgggattagcagtggttttggagttctagctcttacattaattgcagctatattattcaaaaggtggaagagaagcactcggaagaaaattcgaagggcatacttccgaaaaaacaaaggccttctcttggagcagctgatctcatccagtaacaatgttactcctaacacaagaatattttctttggaagatttagagaaagcaaccaacaactttgacccaacacgtatccttggatatggaggccatggtactgtttacaaggggattttatccgatcaacgagtggttgccataaagaggtccaaaattgtggagcagagtgagattgaccaatttgttaatgaggttgccatcctttcccagattattcatcgtaatgtggtgaaactttttggttgttgccttgaatctgaggtgcctcttctagtgtatgaattcatttctaatggcacacttcatggtcttcttcatggtgatctgagcaccaattgtttgttgacatggnatgatcgaatgaggattgctctagaggctgcaggggcacttgcttatctccattcctctgctgcaatgccattcttccatagagatgtgaaatcaactaatatactcttggatggtaccttcactactaaggtttcagatttcggtgcttctaggtccatttccattgatcaaactcgcgtagttacaatagtacaggggacatttgggtacttagatccagaatatttctatacaagccaattaaccgagaagagtgatgtttatagtttcggtgtgatacttgttgaactcctaacaaggaagaagccaatttttctcaactgtcttggtgaacagaaaaatttgtgccactgttttcttcaaagcctaagagataaaacaacaatggatatactggattctcaagttgtagaggaagctagccatagagagattgatgaaatggcctcagttgcagagatgtgcttaaagactaaaggagcaaagagacctaaaatgaaagaagtggagataagactgcaactcctaagagctgcaagatcaagggcatacaaggaagacttacaaaggagcagcgaaataaagccgttattaactccgaagtacaaatgtacttccctgaacagcaccaagaatgttgaaatgggccttgttgctaatccagaatctcaggttgtctctaggtgctataccatggagagagagatgatgtactcttcacagtttcctcgctgattgtatttgtttcgacccttgtaatgatttatttatttttcgcttatttttgtagactgtacaaaatgaatggcacagaccaatcgatttctctgtatgcagcagctctatctatttttgtggagtggttagttgcaacagctctatcaacgttttctctgtatgcatttgtgtgtgttgacccagcaagaaaaaatctaagtaaaatttgaaaccacagcagcaacagcacgataggtcgatatgtccgagtggttaaggagacagactcgaaatctgttgggctttgcctgcgcaggttcgaatcctgctgtcgacgcttttttttttttgtgctttcttttgttgtacattttttattttcccttccagccgtgtctatttttccccttatttgttcattcacttttttttttcagctgcgtctctttcttgatcgtgcaatctatagacattttgttaagacccttaataacatttttataatctaatgttagtgcacatagttagttagtggtacagtgcctctcagcctacaacaaaatgctgccatttgttagtcattgctaaagtgcttatgagcaccgtttatattactcaatccatgcaggtagacgtcatctgaacccattaaacatatacttccttagttttttttaaatagatatcgccgttgacttctaaacacatatttgaccattcatctcattcaaatttcatgcttaaaataatttaagtgataaaacaactaacaaccaaataaattataatacgtgatttttttaataagacgaatagccaaacgtgtgacaacatgttacaacaagttaatggcatcatctattaaaaaaacagaggttatactgtacaataaatgtgcatttgtaaccagaaaaataattcactggtaggactaaaataaatacggagtatgtggccaagggtggaggtagagtatctcagggggggtgcccaggaacccagtcaagaaattttttagctataccttactcattttaaccatgtgtgcaccccctaaatacaaacttaggcacccatgtcagcttaaattcgatttaaagtagagtatattaaacaagtggtacccctctacatttcgttttagatccgcgcccatgtggctatatttaggccctgtttgggggagcttctctcagctacagcttttcccaaaagctgcttctgctagaagctgccccaaacagtccacagcttctgagaatctgtagttacagattctgaaaaatgaactaagaagccagaagctggagaaactgggtttcagagcttttccagattctcagaagctggctaccaaacagctgcttctcagaatctaaagctcctcaaatagacccttatatttacttgtgaaatagtaaactggaactattgtggaatccaatggcaatcaaatctaagtttcatgcctatgttcattgaagcaaaaaggaatttttcccaagtctttttcattgaggttgttgcgatagtattgtggaacatctggagaagaagaaatgattatattttcaacaacataacacccactttcaattcctagaaatctcttttccgtaaagattttaccctacttttgcatagggttagagctcaggacagaccaccctggaaatcatggctagataatctgtaatttgttcttttaagttctattttcttttcttttctccccttagaactttttgggattgtaaatatcttttattgacaatgcatttcaataggagcatctcctgctggtttttcgtaaaaaaaaaaaaaacgggggggggggggggggggggcgcataatttaggccgcccccgcctactcttttgttggcccatttcattccaaccaaatcccttccgtatggccaggggaggcgaccaacccttctccgcttcttcccccaccttcctctcctcctccgccgttcgcgtctcctctcctttctcccccacctccgtctcgcgaaaccctcctcccctccccccatggcggagtcgcccgagaacgccgccccggccgcggctccggccccagcgcccgcgcccaccccggccccgccgccgccgccgtcatctccgcccaccaagtcggggatcccgccgcggtacgacctggacgccaagtgggacgcctgcctcgacatctccatccgccgcgtcgcctactccaccctgggtggcaccttcgcgggcctcctcctcttccgtaaggagtttcccccctcccaaactcgcccttgccttcccattgcgtgcgatttcgtgagatctggttgcggcgcgctcgttgttccggcattggcctagggttggcgccgttgctctcgttttaccgttccgatcggcctactctgatgagggattggctaattagggttacatccaagtataatgcacgttatgtaggaactggttgctttatattccgagtaattttttttcatgcaatatcatgtgattaggtgtcgcatttagcgtggatgagttttttgtgtgccacaatgattctgggatttgacatgtgcagatgaaaattccttggtcttagtttactgtatgacattgagagcgaaataagtacaaacaagcagaatgtgaggatgcctgaatcacgtatcgatatccttgtttcattgtgggggctatgcctggattgcttgtaaggctttggtgaacatttattacaacattgtgtttctttcgtatgggcagcttccatgtgtggtagcttgtttacgagaagtttttgttaaatggtattggttttcagcacgtcacggtttagatcccttctaattcatgtttagccattgatagtattagttctcatactgcctagaatatgtttgaaatgtgatcagtggtgaactggtggtcctccttagggggatcaatcgtagtaacttttgtgtgccaagtgctgaggttttgtatgatttgtggtctggtactaatccttaatcttggagtgttgactgtgctttatgtgatcaacacttagcattttagcttgatgtctctccagttattttttcctaatggtgatgagcacacattatagcatgcatgtttaggatcttttcctaggtgaacctcaaatgctcaatctcaaatatgaagggcttcacatgatatctattctgaagtcattattagttattaagttttcctgtatcttttttttttaattttttcttgcattcagcacggatttgacatccagatactctttaaacaatggaacacgtttgctgagatctccttttacatcttgagtactttagctatgacaatttaccatcttgacaatacaactaacaatacgttctctttgaaccttcttgaattactattcatcatattttatcctgaatttgttagaaatggcatatgtccaaaaaaaatgcaaagggagtagttctgccttaaaataccagtgaatagacattcattaaagtactaataaatttagttcttttctccaacaagagttggatgaagattaagattttcgtggcacgctttttaaactgttaaacggtgtgtttcgtgcgaaaactttctatatgaaagttgctctaaaatatcatattaatctatttttcaagtttgtaataattaaagctcaatcaatcatatgttaataccacctcgttttgcgtaaaaaacttcatctccatcttcattttcaggagaaaagaacaccaccatattttgaccagtattattttatacaggtagcccaactactcgctgggcatcagttgcgctcggagctggtgtggggataggagctgcgtacactgaatgttcatacttattcaatggtgctcctccaaagtggtcacccaaagtttcgaccgttccttctgctcattctgaagtaagtgttttctcattttccctgaacttatatatatctgtttgttgactagtcaaactttaccatcagtaaatcaactgcatccttttactgttcttttttagcttttacttgacctcaccatatttttatcctggttgtatgtggtacagttatcaactcttggtgtttctggaaaagaaatgtacttaatattagaccagaataggttattggtgaaatttatttgccactttaactttataacacatagcaggcactacatgtttgctactgcttgttgcatatttatgaatgcatgggttgagcttcttactatcagcgattgtccaaaggctaggaattaggtacatgctgacagtgatcaaacaaaaaatagagcacacgtttcatgtggttggtagtaatttaccaacttccaaacacgtttaggccactccttgtgtttccatagcaagccccccttttctatatctgggattttttcttaattcagcatttgtcaaaatttgtatagatgatctcatggcagtcatgttttggtcagtttgggattagattgtttttgaaaacactctcaggtgtgtggaaggatagagttatcgtttgttgaagccactgattttcaacagtccatgggaaaaatgttgtgttggtgtccttttgggtgaagtgaaagtattgaaaaccctctgcagaagttataatggctgtcatgaatctagtacttacaggatgcgtgtagcaagttttgttcattgtgaaatgacattggtgattatcttttaacgtatctaattcaaaattatcattttgaatgttcattaatttccttatcttctatatttaatcagggggaagacaagtaaacgctgtttggttggatcggtccatcttgatggaggttttttggagtgttgttgaactagctatctcatcatcttgtctgatatcgccaattctggtctactctttaagtatcgcctcaaagttagcaagagcctgctgattttcctttacactatgcaaaactattccaattgtggtcggatgacccatgggccatggctgcgtacctcaaatgatggttttgtgactggcaaataatatgttcatcatgcgaacttgttgcagcgtgcacattagtatatactttgttactgtcccccttttgatgattggtttgtttccaatcctgagcaagtccaatttctgaacaaaatcgagtgtaaacttttccatgcaaaaatgattttaacgttcactttgcacgtttccccgtgagtacatttcgtgtggatctgaaatttggccggtggtctcatcgagaacgggcgttaagattatactccctccatcctccggtccttaatacaagggattttgatattttgcctgtactgtttgacaactcatcttattcaaaaactttgtgcaaatataaaaaatgaaaagttgtgtttaaagaactttggataataaagtaaatcacaaataaaataaataataattctaaatttttttaataagacgaatgatcaaatagtgtaagcaaaatgttaaaatcctttatattaagggacggagggagtacaagatgactgcaaccctttttcttttacgaaagtttcattaagctatttaggcgaataaaaacgtcttttatgaaactttcattaaactattttagacgagtctatataaacgggtgtgaactttcaaaattaggcaaaggctgtgtttagatccaaagtttggatccaaacttcagtcatttttcatcacatcaatctatcatacacacacaacttttcagtcatattatctccaatttcaataaaaatttaaactttgcgctgaactaaacacaaccaaatttaaagacgcccaaaacgggatgctgacagtgaagcaactgtctctgcgaaccgacgcgtccatggcaacgcgaaacacctgaccgttgttcggccatggcaaatccaaaaatggattaaccgtcgccaaccccacctcgtccgtttattcttcttcttgtttcggcttccgcctccgtcccgcgcgcgcgtgcccccgcccgcgccgccatctctctcct

SEQ ID NO: 35688 - DNA, 4601 bp, Oryza sativa
  unsure (1)..(4601): unsure at all n locations
aagggcgtacgagcacggccgatgctgggaggacatctgccactccatcgtggaggcgcaccacctcgtgtacatggtcggatggtccatctaccaccccgtcaagctcgtcagggagcccacccgggcgctccccggcgagacgccatcgacgctcggcgagcttctcaagaaaagggctcgcgagggcgtccgcatcgtcatcttgctctgggacgacaagacgtcgcatgacaagttccttctcaaaacgggagtatatctatctatcatcttttttatatcctttcttcttcttcttcttcagttgtactctctgatgaattgatatcgtcaaactcacaagaattcggaaatgatattgtgagaaataattcaggttgaatgcaggatggtgtcatgcatacacacgacgaggagaccaaaaagtttttcaggcattcaggtgttcactgtgtgctggttcctcgctatgccagcactaagcttagcattttcaagcagcaggtcagaaatctttgtctgatatagcgctataatttaactgcctcattagttattactagtacatgaacataagtatagtaattacttgttattgaatataatacctactagtacacactatccaattatgcctgcttttacaaatcacatacaagtaggttctcactagttcatgttctgttgcttatctgcatttgtcaggatgaatagtcctgatgttctttctgagtctgagaaagctacactaaatattcatgcagcaaactcatgccttaccatttgttcatttgcctgttaatagttcataaaaaacctttcgatgatgcttgctaatgtaatatttctcttctccaggtagtgggaactttatttacacatcatcagaaatgtgtgcttgttgatacacaagctactgggaacaaccgcaaaatcactgctttcattggtggtctagacttgtgcgacggcagatacgatacacctgaacataggcttttcaaagatcttgataccgctttcaacaaggacttccataatcctacatttcctgtaagttctccagttcataagctgttatcagatcatggagttccttcatagatgtttacacaaattcatgtgaattgctaaatatctccataaaatgtattggcagcacgttgtacaatctgacttttctataaaatatatcttctctatctgataagaatatgaacgccgaggatcctttctcctgatctacaggttaattcatatggaccaagacagccatggcatgatttacactgcaagattgagggccctgctgcctttgatatactgacaaactttgaacagcggtggagaaaagcaaccaaatggaaggtcaatcttaagaaagttgcaagttggcatcatgacacgctgataaaaataaaccggatgtcctggattgttaccccagctgcagatgaggctaatgcacatgtttgtgaagaaaaggacccagaaaattggcatgtgcaggtataagactttgttttagtcttacatgaactacagtaacatcttagatggtacttcctcatacttattttggtgctcggctaggtgttcaggtcaattgattcaggttctgtaaaggggttcccaaaaattgttcaggaggcagagtctcgggttagtgtcctttgccatgcaccacagcaccagctaaaagtgcatctttcaacaattgtttagttattttcccttttcttctgcagaatcttgtctgtgcaaagaatctaaagatcgacaaaagcatacacagtgcatatgtcaaagcaatcaggtctgcgcagcactttatatacattgagaaccagtatttcattgggtcatcgttcttatggtcctcacataaaagcgcaggtaaatctgtcttcagttctgctttaggtgaagcttatgaaatgccatttcactacaaatttctttgcttggcaaccaacagttaacatcttgtagttgtagacttgatcagcctaacaatcacatacatgtttatgctatgacttgcgaacagcaattggattgttcagatgcacgatggcaaacgacacattagaacctgaaaatggcataagagatagtaggattagtgtttcagtacctgtcaggctgtttgttactcacatttggtaatgactacaagggcattctgcattcatattacgattggaatgctctggtgagatcaggtgctgataacttaatacctgtggagctggccttgaagattgcaagcaagatcaaggcaaatgagcagttcgcggtgtacattgtcctaccaatgtggcctgaaggggatcccaaccgcggcaccgatgcagcaaatcctcttttggcaggtctgcaggcatttattcatgcaaataactactacctccgtttcaggttataagactttctaacattgcccacattcatatagatgttaatgaatctaggcacacattaacaaatgaatctagacacattcatttgtgcctagattcattaacatctatatgaatgtggacaatactagaaagtcttataatataaaacggaggaagtacaaattaattaagatactgatgttttgatctggtattcttttgaagagccaaacaatgtctatgatgtacaagatcatagcggacgctctgcagatgcagggattggttgaagctcaccctcaagattatctgaatttctactgcctcggcaagcgcgaggtcgccgccggtgacagcatgtcccaaacgagcttatgcaatgacaactccactctggtacagtacagcagcaggatactactccgtagtccgtagtaggtaaatgtattactactacgtgtggtgaaatactcggggctgatcattgttgcaaattaacaatcatgcatccagcgctcggcacagaagctccggagattcatgatctatgtgcactcgaaagggatggtggtggacgacgagtacgtcatcatcggatcggccaacaacaaccagaggtccatggaaggctgcagggacaccgagatcgccatgggcgcctaccagccacactacaagtggtctgctgatcacggccaaggccctcctcgtggacaggtacagttcatccaaagagcttcattacgatcgatgacgagagagagagagatgtgtgtttgcattgcagatgtagagaaacgaggattttcttgctaactccacaaggtgttgaactagccaacctaggttcaaaagcctcaccccttttaattatttgatattaggtagggttcactctatcggttttagcccatttgatcggagttcaccgaaatcccgaaatttcggaaattttggtccgaaattttgaacaaaatttagttgaatttgaacaaatattaccaaaattcacgaaaaaaattaaaaaaatttagccgaagtaatatcgtatcggaggggaccaaaatgaccgaaatttcggttcgaaatttccaactctgatattaggttattcactaatattcacttttttttgcattgcaggtgtacgggtacaggatgtcgctgtgggcggagcaccttggggcggtggaggagtgcttcgggcggccggagacgggggagtgcgtgaggcgggtgagggagatggcggaggagaactggagggcgtacgtgtcgccggagatggaggagacgaaggggcacctgatgtgttacccgttgaaggtggacaaggacggccgcgtccgctctctccccggccacgactgcttccccgacgtcggcggcaaggtcctcggcactcaaacctcgctccccaatgccctcaccacctagtacctgtaccatatcccgcgtgaatatgaatatgaatgaatgccactgttttgtattttcatgtgcactgcaaccaagcaattttttttttccgcaaaagcgcaaaaaaattatatatcaatatattagaagaagagagcagagtttaagatagacaacacaaacggtcgtcagaaagccgttgccaaggttgaggaaagaaagaacaaggggtagagcatttttataacattgcttcaaaatatagagacacgcatgctgcacatctaaaacgcactagagcagaattcacaacaaactataatttactttaaagataaaattggttatatagtccttagagtgtgataggacgatgaagccatgggtgcatgatcatacttatgaatagcagggtttaaatccaaattcttcgaatattatgattctatttttccaagtagagatttactagtattaatctttgtgagtgtatgagtgtgatgtgcgcacatgtcggcacaagcatgcttattgtaatatgtttccaaatacgaatcgaggacatgttggtagtttccattcctttgagcgtgcgttaaaggatacatttgcaggtatatataagtgtgatgtgtgagctcgtgccatccatattataattgaaaataaatacttatccctttgataattaggataaacttacaggaattaacaaatagnnnnnnnnnnnnnnnnnnnnnnnnnnnnnnnnnnnnnnnnnnnnnnnnnnnnnnn

SEQ ID NO: 35689 - DNA, 1814 bp, Oryza sativa
caacctccttgccctctactgccgctgcggagacatgcgccacgcccgcctcctgtttttcggaatgccgcgcagggacgccgtctcgtggaacacgctcatcgccggctactccggcctgggctcttgccgcctggccctcaacgcgttccgggacgctcgggccagcggggatggtgtggataggttcacgttcgccccggcgcttgcctcgtgcgcccgcgtgggggactgaagggacgggcgggtggtgcacgggctggccgtggtgagcgggcttgcacggaccgcgttcctgaccaattcggtcattgacatgtatgccaaatgtgggatgattgatgaggtgaggctgctgttcgatcgagccgaggaacggggctaggcttcttggaacctgctgttgtcagcgtacgtgaggatggggtggccagaggtggcagtgaatgtgcttgtttggatgcaccggtcgggggtgaagctggacagttttgctttgggtggcatcctcaaggcttgctctgagctaggtgattcagaggatgttcggaggatgctgcacagttgtgtggttaaggttggtttggacttggatgtgttcgtcgggagtgcaatggtggacatgtacgcgaagaatgggggattggaggaggcgatcaaggtatttgattgcatccctaatcaaaatgtggtagtttacaatgccatgatagcaggatttgctcggttgggtaatgacccgtgccctgagattagaatcgaagcagtcacgcttttttcaaacatgctcaagaagaggataaaaccgtcaaagtttacgtttaagagtgtgcttgaagtgtgcaatttgaccaatgcagtgcgatgtggtaggcagatacatgcccatgtcatactcagtgggcttcaaggtgacgagtttattgcaagtgtgctgattaacttgtactcaaaagcacggtgtgtaaatgacagtctgagatgcttcgatatgaccgttaaagaagatgtcttcatatggacatccatgattacagcatttgtgcagaacgagcactttgagaaggcactatacttgtttagggagcttctctacaccagaaaagggacagatcaattcaccatatcaagtgtgatgagtgcctgtgctgctctttctgtaccaacaacctgtaagcagatacactgtcatgcagtcaaaactggtcttgatcaatttactgtctctggcaattcccagattgctatgtacaggaatataggtgatcttaaggcttcaaaacagacatttgagcagatttcatgtctggacactttctcatggtccgctatgatcctgagctatgcggttcatggctatgaaagcaaggccctagagctctttgagaaaatgaagaatcttggtgtcatgatgaatgagagtgcttctcttgctgctcttattgcttgcagccatcaggggctgggagatgaaggtctcaggtatttcattttctgaaactgcaactttctctctttattatttttcctttattctttctcacgttcttgattgactttctcctgcctcttttactgagcaatttatacgtaatagcaagggagagatgctattctggtaatcttcagaagggcaatgatggcatatatggcagaaagcagtccttgaaaaagcatgccagctctacccagtcagtttagaccatgcattcttttttttttttttgaacgaactggcaagctgccaatttcattgaacagagaaagagtaaaactgtacatgcgccaccgcaaagggaaaaaaaaaacagatt

SEQ ID NO: 35690 - DNA, 4771 bp, Oryza sativa
aactcaaagcgtgcatggttgacctccttggccgtgttggcaagatagctgacgctgaaattttataatgagttttggatcagaaaatgacccgctactttggcatgcactattgcgtgcttgcagagtccatggggacaaagaaaagatgtacaaaaattggagagaaactgatggaacttgagccgttttctgctagttcatatgtcatgttgtataacttatacatggatgctggaaaaatctcattggctatgaggacgagaggcctaatgagagagcgaggcatcagtaacgaagctggaattagttggaccgactttggaggatccattcataatttcattgatggagataactcctgttcacataacacaattcacacaaccttggaggagttgttggtcagggtgaaacagaagactgagcatggtggaacaaacatttgggagttagaattccaaagcagaaagcttagtgagagctcaatcagcagacatggtgaattattggcagtggcttttgggttgacaactttgccatctgttgctcctgtaagagttatgaagaatcagaggatatcctgggaaagccacgaaactctgaagttgctatcagaaggtgaaaatagggaaataactgtcagggatccaactcattttcatcattttactcgaggctcatgctcttgtagaggctactggtaattgaagttgatgcctcatcttgagagtaggagacttacaagggtgagaacatttttaaggtgagctttctactggcagatcatggagttttggacgcaagcaaaccaagccagatgattcagttgtggtcaggataagactaaagtcaattcaactgaagttgcattgttacagcttgtggctgtgcttcatggttaatagcatcacggctcgagatttttactctgatgaaaccaagaaaggagataaagtgcttacttccctgttagttgcatcattttgactagcacacctcaaaggttcttatgcagtattttgtagtctcatgctaggttatacagaattttttcacacaatctagcagtagagtttcctcgttagggactaattgatcactactttagaagcattcacataattagttcaaattgcatcaattttgaactaattgtgataattagttcaagatatgtgataattatcacaattatgtgataattagttcaagatatcattcctctcagcacacaaattgcgatgataaagaaaataaacctagtgctatgccaagaagctcaagcctgtaaatagacacttgttgaacagatatggacaataatatagttaccgttctttgtagattaattgctttgtttgtaattttgcagggaagattaatacttaatcagggcaacatgaagtcatcatatatcatgcagtaaaaataggagaccacaatcgaatgctttattattgagaaaaatggatggtatcatgtttatctattttagctgaatctatttaaccataattaatcagtatgtgttagtagaagtctttatatcgttatgcatcaacatatcatgagattattaagtaatagctgagtacaccggcctaaccatacttaacatatcatgagactatcgggtaatggacaaactcatgtttaactatggtagagaaaaaaaagtaaattataatttgtactatatttttttaaaaaagttttcatattatgtcatcctttaccattctttacatttcaatttggagaaagaatgaacggtggtgactgtgcgtggagcggcgattagtgattgctggtgctatgaggagtttgttgtcgacacaatctctagccgagtttgttaatatttttctaatacatggaccaccactagaaatatgtgctacttaaaaaggggcttttaactatttgccacttttagatttggcaattaactatttgccacacctatctcaatgacatgtgggtccacatgtgtctatgacatgtgggtccagtggcaaatagttaattgccacatataaaagtggcatatagttcaatagtatatagttcaatagtatctcgcttaaaaaaagcgtagtggtgatcttaaatcctcgcctaggcagactcgcggagtgtgaactgttggatcgcgaaatccaacgcctcgatagcctttcttttcttttcctcgcgctctccccctcaaaccccccgatccccctatccgcctcacgccgccgcataccctctcggtcgctcccccgcctcaaccgccgccgcatcccctccaacgccgtcgctctacgccgcagcagcggcctgcgctccatcgacggcgtgactccgcgcgacggctggagaaggcgaggtcgggcccacgctccacgccgccgctgcccgcagccccgtcggcgccgtcgctccatcgccgtcccgacctcgaaggtgaaccggcttcgagtccctcgcgccgccaccgatcccaggactcctcgaccctaccagcgaacaaggtaagagtgctgctcgatcccgttcctgtacaggaggaggcatacgaggcagggtatggtagatgcataataatggctttagaaatctcctgtgctgactaaatccccattgttcattattaaccattgttcactgtacatgtatatctgtgatgcaaaactctaatccaaaatctgaagtccttagtggtttactgtacctgacaagcaaacatctcaaattgctactgttaatgtatgctactgaaaattctggagaaaaaatcgcaagtacttttactgatgctaatgtatgctactgttaagctgttatttgatgctactaaaatatgtaacatatggacatgaatgttcttgtatgtaaaatgtgtattacctgattaatatgactgcttccaaggctgacaccatcttaattagaatatttgattatgagaaaacccttacaatttattgtctattctgttcttgagagttaaaaaaatctttcaatacatttcagtagttttcctctattgttcttcaaagttacataaatctttcatatcttacctatttcagtacgtgcaccatgtttttgtcttcattttctgtagtacagtctactcatccactttgctggtagcttttgcatgtcatgatccccacagcatgatgtacggttttcagttatagacgtcggttgtgatatgaggaactaaattgcaaccaaacagtgattttccagagttgcggttaagttctgaacaagtcctcagttaaattggaaacattcctttgttttccttcatgtctaaaacctgaactgaacagagatgagaagactactgcatcccttccaaacataatttctcatgtttgttattcgatggttttttaattatggcagctaaaatcaagattatgtatcttgggtagtctgatacattaaaaaggatcgatgcaatatatttttaatgaatatctgcagagaaattggataaacctttctcactctgctttttgttttcaggctacactttgatcatctcttaattttcttcaattcaatctctcttaaggttgttcaagttcagtatcatgccatctacctctccagtataatatacttcttggtaagttctgctgactgcatatgctgccatgttttctcttcataataacaacagatatattttgtagttttgaaaaccacattctgaacattagtgcaagttcagtttttaattttatgtttcaagtttaagttcagaaatccacattcttgctatgtatcttacctatttcagtacacacaccatgtttttttcttcattttctgcagtacagtctattcatctactttgctggttgcttttgcatgccatgatccccacatcatgatgtacgattttcatttttagatgctggttttggtgtgaggaactaaatttaacattgatcagaacaatttgtatgcaaattatgcaacaaaaattagcatatatttgatacatgtctttaatgtaccgtattttatcatttaaattaagcttctatcattggatttaaaatgtagcatacagtcactcgagatgattttcatttttttaatatatcatgagtttttatgatggctggatgactgttacattgtatatttgatacatataatcattgtctgttcggagtgggatccacttaacgttatgtgtacttaaaaaaaattaggaacttattgttcatgtattcgtactattgtccagctatagaagaagatacatatatgtcatgcttgaactttcttttcaagtattttttattaagcaaattatctgcttatcacttagcttttatggcattagctcaaattttagtcacgtgggatcatgagtgattaaaacatgtgatcttaaattgatatatatttttcctgttgcaacgcacaagcacccaactagttgagataaaaggtggagtagttgtaacgccccgattttcgttcgggattaaaaatcatttaataatacactttctagaaatttaataaaagttaaatcaatttaatcaagtgaactattgagggaattaaaaatttccttttaaaaatcattggccgagaatattttgtaatattctttggccctaaatattctctaaaattttctcgtgaagtttcggagctcaagaagtaattttaaaagtcacaaagttcattaaactcatttaaataaaaagaaaaaccaaattaaaatcctctcctctcctttggg

SEQ ID NO: 35691 - DNA, 11065 bp, Oryza sativa
  unsure (1)..(11065): unsure at all n locations
nnnnnnnnnnnnnnnnnnnnnnnnnnnnnnnnnnnnnnnnntttatttgtccatttgcagtaccagttaaagcatggaatctaaaatattataccaactgaagtatggttgcagtttagcattaaatttagctagtcatatagtagtatatgttagctctcatttgatcgccatttttgtctctgaccctccaccaggtcaccagtaacatgccatttgatttcaccatattgtcatatactccttcctttagaaaatattataatcaagtattcccttttccttttttttcttttttgcttttgcttgtcagatagcatgttatctattactgtgctccctaaatctgtgatttttttctccagtgacattggcacttaaaaactgtttcttggagttcataacagtggtcatatagcaatgattgatgatgaggctgactttggcaacatcactgatgccacagaagggcaggcagctgcaaagttccgtccgaaggcacgggccaagccccgtaagacatctttgccatccagatccctggcacctcatcctactgtggaatcaacagatgaaaatgtggaaacattaaataaagatagcacctcacaagaacagtctgttgataaaaaagcagcatcattaggatgccatggtagtgagacagatggtaatgcttgtgcttctggcggtatacttgacacaccttctgaagatgtggtgacagtatccctggggcttgtgaataatcctgatgtggcattggattcttcaacagttttcgcttcttctgcacataaagtttcccaaaatgaagagaataatgatgatgtatctcatgtggctacacacaaagaaaacatggtggtttcagatacccaagcaccaccgacctgttgcagtgccaggacaattgatgatttggctgactttgaaggattgtgtgatgatactcatgttgaggaagaaagagttgcaaaattccagccgaagtttcgggtgaaaaccagcaaggccgcatcgaaatctcagaggactaaccaaaaggcaggagtctccactgtagatgtgctctcccaaaacaaagaagatggtaaagatcaggcaggatgcaatgacaagcagctgcactctcctactagacatcaagaaagtgtacagatctcatattctcaagcacacctgggaactcataacagtacaatcgatgacgttgctaactctgatagtattatggaagaaccagctcaagaggaaatggctgcaaaattccaacctagactgcgaccaaaggctggtggagcttcacctggggttgctgagactattgatgctgcttgtgtagctactccagagtttggggtttcctctgtagatgtggtttcccaagatacggaagaagatagccatagagaaggcctcagtgatgattcatgccaaaaatatatagatgaagaggctattacaacttcaggcactgggccaccacaggttagtggatatttcgttgttcagaaaaaaaaaatggtactgctatttcaaataaagactatggctccatgctctgacttttgattgtttttaggatttggatgatactgttgatttagactcgcatgctgaaatggtaaatccacatcctgatggtagtccgttgatcattgaagagctctcaggtgtgcttattttacgtatagatcttctcccttttttttttttcaaacttgtgatgtttcttgtagtccaaaaaaaaattcctgtgatatttttaagcatgttgaaagaagtccttaactaaatgagcctcaagttaagcttaattggaacctatgcttgttactatgtgaatattccatgctgaactcatgtttgagctggcttcaatcatatataataacttttactagtttttctgtacttcttttaagaagctaacatatttcttttacagcgggaactactgttaaatttcaaccttatgttcgaaggaaaaaaggcaaaggaaaatcagtatcttttgttccaccaaatgtttctcatgcgcatgctcctacagacaccaattttgagacaagcaactctagccatttctgtaaagatatagcaactggtgaaagtttaagcaacttgccccagcaagcatctgaaaaggtaattgcatgctgaaattcacacttctggttggagtgtgtactggcatgatatacttgattgagtctctttgcctaaacattgcaattctcttctcttaagctgtccgtttttatcagatctgtattagtggcgaacatcatccagatgatcaagaatgtaatgacccagagaatcaataccatgagggggagccatatgatcatgttattgaacaagagccagaaagggatgccagagaaacaggaacatcaatgaaattacgaaacaggagaaaattacaaaaagatgggatacctgagcataccgctgatgatatcatggatgaagactttggtgaacctccatctgacgaacaagataatgatagtggtgatgagtacaccgctagaggcaagcagaagggcaggagaaaatcaagggagaaaaatattaacaaagaaccttcgagaggtaccaagcgcacctcgggggattcccctatagaggaatcacagaagcagaagcttcagaaaaataaaagtaaagcatcttcagggggtcagaagaaaacatcaaaagattcatcggtggaacaacctgagaagaagcttacacaccgaattcgtcgaaagagaatggaaggtagctggctcaaatagtaaaacatcaatttcatacaacatgaggtcttaactcatttatttttgtccactttttttagaagtcaagactttactagaaacacctgatcacgagatagatcgcatgaagctaagtgtgacacatcttagactgttacaggaggcgaaagaacgtattaaggcgagttttgtcgtgccacatttattagttctgtttattgaacatttttgtgctgttgatatccaatttgctttttgcttctatagggcaaagaaattccatcaggaccatcgtcctctaatcataggtatggcacaaaattttagtttagtattattatgcataaatattttctctatgcaaaccagttatgtaggaagagtaggattcaaggatatatgtgtacatattgtagtaccctcccttattaaactagagatactttggcaaaactatcacaaaactacaattttaccattgatttttccacaacactacaatttaaggcatagtttgcaaaggctacagatttagcaataacttaatcgcaaagctacttaacaaatcccttaaggataacgatgatatgaaggaaccactagaatctcttgcttttatgtatgtgctaaatttggtgtttgcaatattgtggcttaaagatgtaggtttgcattcaacaccttgaatctgtagttttgtgatagttttggcttaaacacagcaaaataaccactcactggtactgttatgggttgtgcgaactttttttcctttctttcttttttttttttttggaaaaaggtccaaataaacttaaacactctgaactattgaatcatgtattgagcaccctctgacttttgggtttgattcaaataacctcctgaggggttttgcctatataataagttgactcaaggtgcaatgactcagtgattttaacatgttggcaagctgcttataccactaacagaataataagaaaaatataccaggagcaaggatgatgcttcatctttgctcaggtcattttttaagctatatatgtttattttatgtttccttgtttgtgtagtggtttcacgtgtgctataacatgacaaatactacagtcagcacgccatgcaggcaaaaccacttgggggttgtttggatcaaacgggaacgttcaggggtaatcgcttaaggtgttagacaggactctcaggttcagtggggtatttggacgttttccttttcttttggtcatgtaaacttttcttgtggagagtctttcctgtttcagacaagttatttccaatatcaaattgatgctgctattgttagcttcatcatctaaattgttggctattgttagcttcatcatctaaattgtttgctgcaatttgatggtctgctatacagcttcacttgctatctttcagtgatatgtacatacctgatgcaattcttattttagattgaccgcaatcttttttgtggcacttctaataattgtttcattcaattcaatttatttgactattgaacctcttaaagtttcaacagtctcatttgtcttctaacaaaaattctcagtgtcttttatttagacattgttttctttgtaaagcgcaagccattggagcactcttgtttaataatgtctcgaatatatgttcatggggaagttaatcgtccacacgaactacagcttttagctgaaaatgatttaggcgattcaacttatctgaccctatcatgatcttggtttgtcttaccacagcacctcccaatttggagatatggatgatgagtataacgaacaagacaactgggacaacgacaggactgagaatcatgtggtcgaaaatacaaccaaacttaattaccattcatacatgaacagacaaacacgagccaaatggtccaaatctgaaacggacaagttttacgaggtatttgataaatcaaccattttgattgctatttttcattttttattttataccaattttaaaaagatatttttattcctgcgtatttattggtgttacataaatttgtattttcatatttgttctgttcagggtcttcaacaatttggtagcgattttgcaatgatacagcatctcttccctgataagagccgtaatcaggtgcgacaaaaatttaaagctgaggagaaaaaacatccaatgcaagttcatgatgccataatgcatcgctcgagaggtgagattgttctatagaaaataccagcccatatttttgagttgtgatctagattaacttaatccttatgctttacatctgtgcacagataatttgtattttaaagaagtaatcaaaaagctcaacatcgaagatgtccagccagatatcaacaatacacatgaacaggagggtacatcaaatgaagaggaccctggaaataaggtttgttttgaaactagcgtataattttcttatatcaagttcattttattaatcttgtttcttgttttctgtgtattaagaatataccgggtggattaattaatgaggaggaagaaaatggtttagattggtcagataaagagctggacatgcacagatctgaggtcgaagagaaggagcacgtttctacaaatgatgatgatgatgatgatcttggtgatgtttttgattggtactaacgtgattaccatgcgaacattactgacgacctcatgattctatcaatatcatgggcctcttgaaaatttatattctggtgctatgacctttgggctctggaaggccatattctgcatcgaaaataattttgctgacaggattctccagatggcgatgaaagcagtacagttccaaaggctgaagaactgtatttttttttttttggtttgctgcttatttctagtttagttgaaacttagaaccataattctagtgcttagcaacacagggatctcaatatttgttgcttgaatcctagtttcgtagattacttgcagagtagtaatgtatatattgctccatcatcatttgatatatctgtcatttttttttctgtctgctctttcaatattctattctatcaatggcgctggctcggctgccccctcacgtcgtcgtcatattgatctgctcacgtcgccccgaccctacatcggcaaatccgagctcctcttcgatccccttctgctcgtctttcaccaccagcgccggtagctgctcgccaccctaacctcccgctgtgctatcccaacctcctccgtgcacggtgtttgtgattaggagtaaatgcctaattcttttttagaattttcatgatatttgctaattaatatgctcatcatcttcaacacgaaatgtttaactcgcacaatgacaacaaaaaggtgtcgtggtgtagttggttatcacgtcagtctaacacactgaaggtctccggttcgaacccgggcgacgccatcataattttactcattttttccacttcaatcttcaatgcatttactacatttttctgttcacttcattagttcaatctatttattttttccacttcaatgcatttactacatttttccatcataattttactcattttttccacttcaatgcatttactacatttttctgttcacttcattagttcaatctatttactatattgctttttatcttttctttttcacttcaatgtatttactacatttttctgttcacttcattagttcaatctatttactatattgctttttatcttttctttttcacttcaatgtatttactacatttttttcacttcaatagttcaatctatttactatgcaacaatgtaagcataaaactggccaataaaaaaaaactagatatgtagcaattctgatatcgtttgccctgaagatggcatcagtgtacatgatcttattcctggtagattcatgctactacataacagtattatatctacattcatgcactccaatatccatggtttattggcttaattcagcgtgatcagccagtgccatggcttcactcagcagctcttgccatagttgagctcttcaggttgggcagcatcttggatgttgagccagtggcaatcctggaacgcgcacctgcccgaggcttgcagcgtctcgccgacgtctcggggctccaggaagtatggcgtccacgacggcgtgccgtcctcgaacgagttgtgcgtgagccgccggatgttggacccgtcgatgtcgacggtgaagatctcgccgtatggctggtaatggtgagggttggagaccggctcggcggagacggcggcgtagtcggaggtgaagacgaggctcttggagtccgggctgaaccatgggtggttggtccggccgctgccgccgctgtgcaccacccgccgcagcccggtgccattggggtgcaccatgtagatggcgaagctgccgctccccggggcatggcggtcggaggcgaaggcgatccactcgccgtcgggtgaccagttgcacatcgtgtccgaccatggcccctccgtcagccgccggatgccgccggcctcgccgtcctcggcgtcgatgatgtacaggttcttgttcccggatctccccgaccggaacaccacccacttcccgtccggcgacggcgacgggaacgcgttgttctcgcctcccacggtcagcttcttcatcgagatggttgactcgtcgtcgtcgtcgccgagggagatggccaccacgtccacctccgtggtctcgctggcgaaatccggcccgatgctggtgtataccacgcctttcctcttccagtcccacgacgtcgagaaggcgttcccggagaagatcttgcggcgaccaccggagccgtcggagttcaccacgtacatccccggcagcccgacgaacgcgatcttcttgccgtcgtgcgagaaggaggggaacgagccgtcgatcctgaagagcgagaacgtgtccggtgaccctgggctcttgatgttctccagcagcagcggcgagtcgccgttccctctcccccggcaccggtggtacccgacgcgcgcgccgtccggcgagatgaatgggttgaagtggtgcacgcgcggtgccacgggcctggtcacctcgaagtaggcgttcttgccgtcgctgctcacgtcgatcacctcgatgtggcggtagtcggagcccgcccgccgtgtcgccaccgccacgagccccggcgcgccgggcgacgcggccggcgtgaaggcgtggaaccccggcggggtgattcgctccacggacgccgcttcgaccccgtcgccggtgacggagatctcggcgcggtagacgccgtaccaaccgtcgctgtcccggcggtggaagaagacggtggtctcgtcggcccagctcggccagccgccgtcacggatggcgagcgaccggcgcgacccgtcggcggtgcggaagacgtagatgtcagtgcgcaggtcctcgacctcgccgctccaaccggcggcgccgggcgacgcggcggccgtccctcgcccgagggcgacacggcggggctgaagtccgcaacgccaagcggcgtgaggcggcgcgtgcggccggtggacagctcggtggagtacacggcggcccagctgctgcgcggctccgcggcggggacggcggtggagacgtaaacgaggcgggagccgtcgggggtgagcgacggccggtccttgagcgcgattggctcccatgggaggagcggcgagatcgtcgccgccgccgaagacgacgacgacgacgccgactcgagcgcctcgcggcgggaggagggaaccggggagaggtagaggttgagggagccgttgcgctcggagacgaagaggatggaatcggaggcgggggcgaagttgccgttgtagttgacggagacgccatcggtgaggcggagctccgcggcggcggcggggttatggggggagggcgcgagggggaggaagaagatgtcgaactcgtagcggctgcggccgagggtggtgaagacgatggtgccgccgctggccgacgccgccggcgccgccggcgaggcgagcagcgcggcggcgaggagcgcggcgagcaaaggagtggccatggtcgtcggactgaagcgggctacaggttgttggatttggggatttttttgcctatttttcgcggcttccgttggtgatgggctgatggcacaaacaacttttttttttcttttttttttttgttgttgttgatggctttcaacatgataaaggtccacagaaaaatcgaaccatttctcacgaatcatatgtaaaaaaaattctgtgaatttttatcccattgtttgccgcgtgattttttgcactggttcctggacggttgggtgtcctgctcaggaagaaagacctggtaggtggtagcaacacacccacccaatctctactagacgcacactcgagtactcgacttgtctatgaccatctccgtcgtctgctgcttaaaaaaatatataatatatttataaatataagcacatatataaagtcttatgaataatataaaacttaagctgttaagctacgtttattttattatagcataatagtatgatacaacctttgtgataggacgcaagtcgttctactttttcggtaagaaagcgtaattttatcctgagaaagaacgcacttgttttctacagccatatgagtaggttgcaatatacactggtcgaatgaaggcaatacgccattttgtttggtaggttggggtgtgaaaacgtttgtcgtcatgggccacccccacgaaagatcatccagacgtttccatggccggaggggacatagtacattgaacacctactgctttttggttgagtaattttgagctggtttaatgtttttcttttctgaaatactcctaaaaaggagagagataaatgttactaacgtgtgttattgtggtcactggtggggaaagatgtcgaacttttgcttccggaagcggaatataatcggcacagtaaaacgtgatactgaactactcgaaacggcccaagtattcaatgggccgaatgcttaacatgagcagggaataagttcatttgaggtcccttaacttgtcaacgaatccgattttcgtccctcaaccggaaaaccagacacaacgagtccctcaactatcaaaaccagtgcagattaggtccctcggcggttttgagggcggttttggctgacgtggcgcctacgtggctaatttgactcggtctttatatgacgtggcgcttacgtggcaattcgagccggaaaaataataaaatcctcggggcccacgtggccccacatgtcagtatcacaaataaaataataaaaaaaatagtgggacccacgtgggccccatatgtcagtccaactcaccctcctcttcttcctcctctctccccatctcccctcttcatctatctctcctctcctctcctctctctcggggacggagaggcagcggcacgcggtggccggctgccggcgggagaggaggaagcggcgcagccaggcgcggcgtgcggaggcggtttggcgcgatggcgcggcaccggcaatgaaggggaagaaggcgaagggagctccatgggcggcggtgggtttggggaagggctggcggcggcggggatggtggtgagatcagcgcggggtggaacagggaggtcnggcgnccggggnccgggtttcaacagcagcggccgggcgcggcggctcggcagtgcgcggccaggaggtggcgtagggcaggaatcggggcggcgccgggcaaaggagggagggaaggggagcttcacggggcggcggtggattgggaaggccggcatggtggtgtggagaagaggaggccgacggctgtggggatggagaggatggccagcgaaggtggggatggagaggatggaccggcgtggtggggaagggcgccacgaggagaggctaccgcgggcgacgccggcgccgctgtgctcggctgagcgtcggccgactccgcgtggcggtgggaatggagaggtgcgccgaccttctccccaccgttccatggcgcgccatcgcctcacgggccgccgaaggcggaggagctcgggcgccgcccggtgacgctgcgtggggcggcggcggccgccgcgtccattggcgtcagcggcggaagggacgaggccctgcgcggctgcggcccgcgaggcgatggcgctgggcacgctcctccgcccgcgaggcgatgacctgaacgccgcggagggagggggccgtggcggtggcggtggcggtggccggaacagatcgacccgggcg

SEQ ID NO: 35692 - DNA, 3508 bp, Oryza sativa
atgaagagagggaggtgggaagagaggagaaagaagagggggtgagttggactgacatgtgggacccacgtgggtcccactatttttttattattttctatgtgagactgacatgtgggtcccatgggtcgaattgctacgtaagcgccacgtcggacaaagaccgagtcaaattagccacgtaggcgccacgtcagccaaaaccgctctcaaaaccgccgagggacctaatctgcaccggttttaatagttgagggacccgttgtgtctggttttccgatcgagggacgaaaatcgaattcggtgtaaagttaagggacctcagattaacttattccacatgagcagagatatgggctgagtttctgcccttctctactcaattgcaggtgggcagtgtttgaattttttttatttataattttttttattaaaagttttacaaaaataattttccattttgaaaattaacggaaatagtcgcctaccgccctctgggagggcgatgcctgaaaatcgactctaccagatcccgggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattatttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctataggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtgcaaaatcgccctagcggagggcggcaagggggccgcctgcaaaattccatgccccccctcgccgcccatttgcaggcggcccccc

SEQ ID NO: 35693 - DNA, 3889 bp, Oryza sativa
  unsure (1)..(3889): unsure at all n locations
ccacgtcattttcgccgccctctgggagggcgatttttaaaaatcgccctcccaaagggcggtaggcgactatttccgttaattttcaaaatggaaaattatttttgtaaaacttttaataaaaaaaattataaataaaaaaaattcggcagtgtttgctatgatgcggcccagtggagtaagcaagagatatcttagtgggctctccttcagtccttcccggcctttcatgggctcccgtcccgttagtgcgagatggaccgagttctaatcggtgggctttcctactgctcgtgggcctaaaacgacaagagggagagagcggtacgatgcggagtcgaccaatattttcagtgtattgtaggggggcgcctagctcgcgcatacgcgcttccccacctaaccacctatattagtattatattagtattagttaacactacttaacactaataacagtaattaggaaagattttagagatttttttgagatatttttactaacagattgaaaatttttcaagttagattaagaaactttcgatttaagatttaaattttaaagtcaaattttgaagatatttaactcagatttaaaaactttcaactcagattcgaaaactttcaagtacagattngaaagttttgaaaagtttcaactcgagatttgaaaactttcaactcgattcgaaaacttcaaagtccagatttgaaacttttgaaactttcaacttgagatttgaaaattttcatgtctaaatttgaaaattttaaagttaaaatttaaaaattactagtaaaccaaccactagtaaaaatatgaagctaatctaaactaattatatttttttcttttatccgtacgacagggaccatatacggcgaaaaaaaagaaacagcggcgtaaaaaaaagaaaaaaaagagagaagcgcaaaagcatgcgcgtgcatgggcctcgtgggccggcgtgcgcgccagcaacgcgcgcgcggattagcctttccgacgcatgaatctgaacttatgctactaccacgaatttagatatagctcatgttcagattcatcgtattaagatatatcttatattctactagatttatttttacggggatattctactttattgttatattataagacggagcgagtattttagattgcattatcgccgtgtgatgacaaatcagggcgttgctcatgtcgactataggaggaccaacacaaccgcacatcaaaaagatcgaccggctagctactgctccctcatgcatgttttttttcaacgcttggaacctacaaactgcctctcttgtggcattgacgtgctaccttatgatagaatattaatttcattgatcaatattggcaaggattaaaatgcattatagggtagcttcgtcttcccatgtactcctttttgtttaaaaatatactccgtaataattttggctagattcatatccaatatttgtatatgtatatgctcgctcgaaaaaggcaaaaagcacgcacacgcgaaaaggtatagacctgcacgtgatgtccagcgagaagcgatcgaattagcgcacgtatgtacgtacgtatacacatacgctggcctgtctttctcctgtctgtcttatactacctactccctccgtcccagaaaaaggcaaaccctgggtttacgtgtccaactttgactgtccgtcttatataaattttttttataattcgtatttttattattgttagatgataaaacatgatcaatattttatgcgtgacttgtctttttaatttttttcataatttttttaaataagacggacggtcaaatattaggcacggaaaccagagtttatcttttttttgacagagggagtacctaccagcctgcacaatcgaaccgtagatgcgtacatatatacgtgtattgtcctggatactatatatactagtgtgcgtatatgtaggcaggccagagaccagagcaggtgcacatcatataatagtacactcatctttagcttcatacagtatttgccaaaacgacaaaaccacacattccgacattatattccacctagtttagtagctcgatacactttattctgttatgttctatactattttgcaaacaatatgtgtttgttagcatatatagatggatacatgttaattattccacttaacaatgtgtgtgtgtgagagagagagagaggggtagcgtactagatgttgtaatcaagttagttggttaaccacttaacaactcaatagatcgccatacacatacccatcgtcacgatcgaattagttggtgtaaatcaatcgatcgatcgaccgagtgagatatatgcatgcatgatgttgaattgttgacgactaccgatcgatcgaccggccaaatgattaattattttctgtgcctatatatctgtctggttgtttttctttaattttactgcattatatgtgtcactctctgcagatcgagctctctagctacacgttacatcctgcaaccgctctccaactaacacactacacctgcatgctgatgctgggttaataattttggcttcttgtcgattactaaatcttaattagtgaccatcgatcacttctaaatcaagcagctatatatctagctacattggattaatattttcgaatgatccatctcacgaatgtacgcccagtgacgaccatgtctattgattttaaaaataataataatagaaactttcattgaattagaataactacatcaagtttaatcacgagtttggtattatatatactgatactacccatcgtttcacttattcaggaaataaaccaaacagcatatttgcaaatggaatataatttatgaataaaacttttatatacgtgcgtgttcttaactagtataaaaaaaaaggatgaaaaataattttcgatgataaaaacctcaaattaactttaaatttaaagttgaaaattcaaattttgttcaaggaaagttccggccgccaagcagaactgaccgacctcctacttgccggctgaaaatttgactttgtacttctcttctatgaccaataattgattaaagagtgagagaaaataaaatggcatactgttccattcaactgggaattaattgtgcagcgattagttgacaggaaaatgacctggcagcacagccatggatgcttaagcttgcatttttaattaattaatgttgcggcatgcatgaagcagctagcgatggatcacgatcacatcgatcgttttgatctactcatcgtggcaacataatggacaggtttttgcttcatctgctgttgctcgaaacttcacaaaaaagagaggtaaaaaggttattcagaaagtgaaaaaagtgacataaagcagagtggaaggaaggtgcagaccgtgttctttacagaagaataattgtaaaggaaaaagtatgaggtaattaagtcacttgacagtgaaattaggagaaatcagcaactagctagctagcatccagctgtacttaacctagatttagctagacctttatatccttttgctttaacagtagatcattaaaagaactccaattgataagttaattctagaagagattttagctttgcgtgatcgatcgatcgatcgatggagagtatagtagattagtagttggtggtcatgcgtgatgcatatatacttgtctgcacatgcttgcccagttgcccctgttcgaatttcatttcatattcgcctctcatcaactgtaaataattcagaagctggttgttcaaaccgtataataatatattctcccaactaattgcacgtatgcgtgctcacgagctgaacaatacgttactgctcagtccatccccttcacagaatggagtt

SEQ ID NO: 35694 - DNA, 1502 bp, Oryza sativa
  unsure (1)..(1502): unsure at all n locations
nnnnnnnnnnnnnnnnnnnnnnnnnnnnnnnnnnnnnnnnnnnnnnnnnnataaagcagagtggaaggaaggtgcagaccgtgttctttacagaagaataattgtaaaggaaaaagtatgaggtaattaagtcacttgacagtgaaattaggagaaatcagcaactagctagctagcatccagctgtacttaacctagatttagctagacctttatatccttttgctttaacagtagatcattaaaagaactccaattgataagttaattctagaagagattttagctttgcgtgatcgatcgatcgatcgatggagagtatagtagattagtagttggtggtcatgcgtgatgcatatatacttgtctgcacatgcttgcccagttgcccctgttcgaatttcatttcatattcgcctctcatcaactgtaaataattcagaagctggttgttcaaaccgtataataatatattctcccaactaattgcacgtatgcgtgctcacgagctgaacaatacgttactgctcagtccatccccttcacagaatggagttgtattttttttattttttttagataatggagaatggagttgtataggactcctaattagtaattaacatatactcctatacatttgttaatttaattatagcaagttgagttatgtttgcatgtgtgtgaactgctcctaactaatcagaccatgttaagctctgcatatgcatatttggtctagcaattagtactcaacatttactacttgagcacgtggaattatgtcatctccatccattccatcactgaggaacaagtcgtgcgttgagcatgcgtttgcactgttgaccgtgctagcttcatgaaatgtctgctaattttttgttaatcagatactaatttttattcctctgaacccaaactataccaaatatggtcatcatttaattagcagaagtacagaaatgaaatgatcagccgctggatctatcgatctcaagctcaatcgttcttaggtctgcacttgtaaagaatcaagaaaggtactattactaccgaactttttcagtaccactccagcgtatgtagacaggaagagtttaattaattaattgattagtcatgtaccatcacccttaatcataaagttgtcagctttacatctgctaagcctagaattatactgaaatgatggaggtttagctttctactcacgtggttaatcatgttgcagcagcagttttctcctcatcttttaatttctggaaggattacgacagtgaaccggacttgttctacaggcctgcagcgatagctctaggattactgattgaggttaggtcggtgaggtgacccatcatatatccatcgaatacattaattatccagttgattaatctctggtcaaatctaaggatttatttaagactcgagcatatctactgccaaacaagtgaaagaatacatgtatggtatcccaataaaaaataatgcatgtcagg

SEQ ID NO: 35695 - DNA, 2305 bp, Oryza sativa
  unsure (1)..(2305): unsure at all n locations
aatccaacaggcaaaaagcttcagcctccaggattacaaacacagcaccaaataatgcatatatttttgcattgttcatctctcctgacctcacattggaataagactggattatagtgaggacaaaattaattaaactatcaagcaagggtccactgaatcgacatctttgtatcgttgatgacaggtacatgtattgtgcatttgtgcattgacatggacacgttcagtggagtagtttcacttctccacgttttttactcgtcagcgaacccaggaagaagaagatgaagaacatgctgaccaagctgaccaccaaagtgtgtacacacgtagcatgatgtgtactgcattgattgcatttttcagagctttttttacagctctatttcacagtgtatttggacacatgataattgataaagaatataggagcatttctaacataaaataaatatactataaaaatatatccaacggtggatttaataagtttaattttgtgttgttaattgttgtgtgtttttcaatgaacttgatcgaacctttaaaaattaacttaagacaagccaaaaaaacgctttataatactactactcctactatggaacagagggaataatacattagagttcctatgtcccttctgctgtagtaaaagctgttgcacagatttgggattagttaggtgaaggtgataatgcatttctgtttggtggtggtactaccactaaatacatgaacaagggaagtacagacaatacacatttgctacaattataatcctcctcctactctacagatataatcctgcaatttgctccacatgagatgcgtggagactatacagctaattaagtgccattgcatgatctgctcaggtgaccaactacagctaattgctgcaccttggtttgcaacaactcaggactgcacgaaatgctgtgggctctctcgtataatactgcacattcacaccgacagacaacaggaccagctgctgctactgtactaaatcctgcaaagacgtttttgcaacttaattactccgtgccgtactaattagttttgctatgaaaaaggtgcagcgtagttaacacaactaacctatctcatacgccaatagatttcagatcagcatgagtattttatttagattctaatctgacttactgactacttgctgaaacttgatcaacacaattgtcagccacaagaattgttttgggagcaaacaactttttttcttactatttcatacaggcagtagcattatctatctatttaattatttatttgatcaagcatttcgttggatgagtactttgaaagtctgaaggagtaggagcctaggacgaccgttgtaagcaatttgctccataaatactcgatgcttgattaatgtgacggatgtgcgtgtgcgcaattaacgctaagcttgtacgcaacaattaaacaatcttccttccaagctcgaaacctcactgattgagaactactgctactgttccattagctaattaatacgcatgttaagtgcaccctattagctaattaactgtgcattacccactcgcagacaacacattttatttcctttcgggcgagtaaaacatgccgtgtgtttgtgtgtgttaccattaaatatgtaactaaatccacaggccaacaattttctggttggcttcatctggtctttaatttgaccttttgctcatatttcaatataggttcacaacttcacatatacgactgtcgtctgattcgtacgttnaagtcagnncngggtcntaaagttcatctctctagaagaatatgtttttttaaaaaaattaatttgtttgttttgttttatgtaattggcttcgcttgataaaaaaatatgttctttgtgctaaaacaatggctgaaacaagtatcttgattaatccagtataaatatgcaatggataattaccactggacaatccttttgaccagttttggctctttgcagtgttggtcattgggttatcaaatcatgacttgcaagttaaggcttgtcatcacctcatgatcctttaactaatgcatgaaagtattatttgttcaagaaggttgaatcaaatgtcacctaatgagtacgcctgcagaacaagacaattaggatttgggacaggaaagtatggtcaatacctttctgacagtttcgtggtgctgaaaaatgcaccaagattaattgaaccagtgaatgtgcatgctcccttaacagctaggagaccagcgatgcagcaagtgcccttgatgctcagttccaacagacaat

SEQ ID NO: 35696 - DNA, 12350 bp, Oryza sativa
  unsure (1)..(12350): unsure at all n locations
cttgattcttgcatggagtagtttcattcatgttacttcttccaaaatagaaagagcacagaagaaaatgcaactgcattactggaaaaatcatgtactgtactagtctctcaggcatgtgaagtttggaaaatgaataactaatcatactataatcaacaaagtttaggccacgtttaaaacagatttttacgtgatattgaggcagattatttacatgataaacacaataaatcgaaattttaataaatgaattccacaataatatactccctccgtcccaaaataagtgcagttttaacattgtttatgctcaacgtttaatcgttcgtcttatttgaaaaacaattatgattagtatttttattgttattagatgataatacatgaatagtactttatgtgtgactaatatttttaattttttttataaaatttttaaataagacaagacggtcaaaacactagacatggatatctatggctgcatttattttgagacggaggtagtatgtaatcttttaaaaaattactctcgtttaaaaaaagtccaattcatagtacgtttagtaaataaaaaatcggagaaaaaagggtcagattgcatcagagatcacagtatcgtcgtcacagtgactaaatgcagcagcagtcacagatgactagactaaatcaaagattaacagtagcagcagagtaaagagaggctttttttccttggaatcttccccctcactcctcgcaaatcccacgcgccttttcttcccacgtgcatctgtcagtgacacattactactaccacaactgcctcccaaaaaaagagagaaaaaaaagatgaactaatattcggagaataacctgtaaagaaaagagagagagaaaaaaaaagaaatggaaaaggaggcaggcgaattgctcaacggaagtacggtgaaagaaagagaagagcggttgccatcgccagccacagcagccgcggctactataatggtgggagagacaaactagagagagaaagaaaccaccaccgccccaagaagagagagagaggacgcgacggttgccaggaggaggcagccaacggcgctcgaggcaagaaacgacgcggccatggtgggcttgccttgggagtcgtgacgcgctgtgtttgctgccgttgagagatgaaggtagtatccaagaagcatcatcagcaaggaggagggacgacgacgatggaggagggcgccatggacggcgctggcggaggagtggcggaggaagggtgctccggggaggagagggagggaagtcccgacgtcgctgttggcggcggcggcggcgagggggagcgggaggggaggacgctggtggtgggcgtgcgggcggacnccgcgagccggacgctgctcacgtgaacgttcatcaatgtcgccgcccccggcgaccgcatcgtcgccgtccacgtcgtgctcgcctccgcgcccgtggccgccgccaccaccgccgtcgacttcgacaccatgctcgccgtctacgagggcttctgcaatctcaagcaggtctagctccctctcccctcccttctctcgccctcgacttgccagtttgctcgccactttctaccaaccatgtccatccttctcttctgcttcatcttttttcttctcaattgtttggttgatttcaatctctcctttatttttggctgtttttgaaggattagatttttagcccatatccttacaatttttcacccatcctgcataaattatcccagttgcaacaaatattcagagagtggtttccgctaacttttgcagtaatgcgatttttttacctttatttatggctttccttctgcaattcacatacttcccgctcgttcccctctgcaaatcgcagtattttcgcagtaattgactgcttcagcaagctaactttggggtcttgtgttgtgcagatcaatctaaagctcaagatttgcaaggactcctcggtccgcaaggcgctagttcgtgaggccaacctgtttggggcatccaaggttatcgtcggcatcgccaagaagaagcgcgggatttcgtaagtgacattcgatccgcatccgctatcaaatctcatcaacttttatttttcacccaatgatgatatgattgatggccaactttcgttttttttgggggggattcgtcaggtccctgcactccgtcgccaaatactgctccaagaagctgccggccaagtgcgcggtgctcgccgtggacagcggcaagatcgtgttcaggagagaatccaatgtccactcaggcaaggtctccgcggagattcctggatgtggtgataatgagttgtattgcgaggtgccgttcctagcccgtcagtgtaaagaggaacctttacctttacatgaaccacccagagatggtggtggtagtgcgggcgaggaagaagaagagcacgatgttggcacaaaggagaccgagccggtgaatgccgtctccggtgaacagcagccttccggtgtggatcctgctgagttgtctccggatcaggttcagggtgatgttgatccatctgacaagggtgaagagtcgactgccgaccagaaagatgagatttctgagcttccgggtgagggtgctagtgttttgtactgtgtgttaccagagaggaatggccattcagctgcaagcacgtccagtcggcaatccaatgattcgaccgagccaccgactgaagggaatggggagctgtactgtattttgcccccaagaaatgatcattcaggcaggagtagcggtgattctagccgttcaactgcgagtcggaaacacgatgattctgccagtctgtctgctgaaggagatggtgaactgtactgccgattgccaaggactggccattcaggtagaagttctgggggatcaaagcgttccttcggtgcaaaaggtttgattaggcgcagcagtagtttctccagtgatattcaaaaggatgtctcagtttgcacgactacaactgaacagacttcgtccatggtatctacagaagctgaggattcaccaaagaacgctgcacgtgatgtcgatacaccctccagctctccaatgtctctaagaaggatgatagagggaaggcccgaccgctgtcgacttcgaaggaggatcttcaatcatcaaagaagctcatcttttgaatgggccaaaatttccatggttcagtgggcaatgaggcttccaagccgttatacttcagttgcagacaacaaatcatttaaatcagatgcaagtccaaggttgaattgtgattccgaatgtgaatccacttcagctgttgacacagaatctatgttttcgttctctttatatgatatatcatggcctccaaatgaagtggaatcgcttcaagagaagtactcttcaacgtgtaggctgtttacctatgaagagctgaaacttgctacgtcaaacttctcaccaggtaatgtcatttgggatgtgcattactttgattcacaggctttttggcaaagttgtctgctgattttcttttacaccaatgcagatatgttaattggaaagggaggaacaagccaagtttacaaggcacaactatttgatggcacattatcagctgtaaagattctgaaaccttcagttgatgcaatacaagagtttgttacagaggtggagattgcaaccagcttgcaacatgacaatattgtttcactaagaggattcagttctgataactacagtcttgtgttggtatatgattacatgctccagggaagcttagacaaagcacttcatggtaatccttaaaatgaaatactttgcatatttattccctgaccttattgatagctcatctcttactttgtgattgactggttgtaactgctcttcaggcaagcatgacagcaaggatagccttagctgggagaagagaaacaaaatagcaattggcatagcaaaggcacttgaatatctacatcatggaagtgtcacccaatctgtgattcatggagatgttaagtcttcgaatatcctcctctcagaggattttcaggcacaggtaaataaccataagagatttgcaaatactgaaatacctgaagcaattatagttttttcttcatacagtaaatatttttttcagatcaaagcaagtgctttaatgcgttagcagtgacgaattacattgagtatttggtagccttactagttaattttgattctgcttatgacatcatctcttttgaaatttccagctttgtgattttgggttggcaaagcaagtctcagcttcaaccccccacctaacatgtactgacatcacgggaacgtttgggtaagtaccatctctatgctatttttaccagctattgctacttttatcaagtgtgaaatgcctaagcaaactactcctgtgacagatacttggctcccgagtatttttcgcacgggaaggtcaatgagaagattgatgtctatgcatttggagttgtaattctggagattatttcaggaagaagacctattagaacaggatgttcaaagggtcaggaaagcctagttggatgggtgagtgatccttaaccccctatatgcctggctggcttgctctgagcagtaacatgccctgagccaagaacaaaatggtagttgcacgttcagtcactgttggaattaaagctgtctaggaccattgctgcattttttttgctctgttgaccacacaatcactcctgcacgagcgagttattaattattttttctttttgctaattctttgttgacggattcaggcaaagccattactatcaagtggggaaattaaacaattggttgatccattcttgggaaatgattatgactgtgatgaaatggagaggatgactctcgcagcttcgctgtgcacaaggacatcttctcattcccgacccgaaatgtcacaggtaagaacctgaacaaattacatgtacaaatacttaaaaagtcttgatgattgacctcaacttgctatgttctggcaacacagatgttgaaactgcttgaaggagacgacgagacgatccactgggcaagaacccaggtcaccgcgagcttcgacggatcggacgaggaggctgtggcggctcctgactcaaacatgcagtcacacctgaacctcgcgttgctgggcgtggaggatgacaccctctcgcactgcagcactgaacagaccatggacacttcagctgacgggtactggagccggtcatcgagcttcgactaacctcctgcttttttcttaaccaccatttgttctgattttgagccatgtgaatggggagctgtgtgtatagagtctctcaattctcataactttgctgctgctgttgtgtcgattggttggaatggtgaatgcaaattgaaaggaagtggatgatatgcacattcggatggcagatgtagtagcttaggaattgtggtagatctaaccctgctggcctttggccctacttggtaggagtatgtatcactgatgggcttcatggtgcatcaagatttgattcttttccaagttgcttttgttttgcttttcctctcagatgccatgccatgacaggctgcctgtctcagatgctcatctaacaccaccatttgatgaagaacatactacacatactgtatgtgtgaattggccagccacaccattagtagtaggtttctctctcactgagacatatgatgtaactgatcttgtcagctactgtacagcaaagatctggtttgcagttccaggtgtaaatgtaacatggcatgacgaaacgccgttcttgatgtactgttctcagtacaggaatggctgggccagttcagacaaaaccagagtctcatgaatacaggactgacaccgcatgctccctaccggagctctcttcgcatcaacacatgtgagccttgtctctctgtcaaactctgaagtttcaggacacctccaatacaaaggatgctactggggtaaacctaacacttgcaaattttgcatcattcagatatgactagcctgtggcccgtacgttgcaacggaaaacaaattgagtttctaacttattaaatcaattaataagcacttataagtaatactatgatttctttttattaaacaagtagatgattttaaaattcgggggaactaatagtatagagaggatttgttgaaacgtggtgcaatagtatagatcgtgggggtcagatatttctagtaggagtgctgtgaaaatggacatcatcaaactgagaagagtgttacaagatcatttgggcctcagttcactgggcggttggataacaattgggcctagctatttgcccatcatcaactgcaactgatctggcccaacctagtaaccggcccatgtcctctcaacaagacctccaaaaacaaagtcctcaggaagacaaaaacactagttcatatgattccagatagatatgttccggagtgatctctaggagaagcagcaaataatatgctattacctgttagtatcatgtatgatgtatccatttatttattattaagagttggtgcctagtattcctactatctaagataataagtatgctccagcgaacttgatctgagttatcggagcgatgacatttggagcacaagacaacaagcaaggcagcttgaaatatattcattactactacataaatatactgaatggcaccatcaaacagcttgttcctcgctggattgatcaactgatagcttcctatttgtcctcctctgcatcatgctcgtcattttgcagctaagtcctcacaaaaaagagagaggaactttccatcaaacagcccgtttggagactaaattgcaactctacagaacagttattatcggttgatcgggaatgaaccatatttacccattttaattgttacttcgtcctaaaatataatataagagatgctgtgcacgtaattatatgagaaaatctcttatattttaaaacagaggtaatatttagggctgattataatatatacaatgctaaactaaattttatataggatgagagttagaaacaataccatgttttactgaaacgatgctcggacggttggttgggaatttccgtcaccgttttaatcccgatcgtatatgttcaaatctgcgtatgcatcgaccgatccgcacattaattgtgattgtgtggacattctcaattctgactgccaaaatcacgcagcaccactacagtgaaccttctacttgactacttttatacatgcatggttgctaattgcatggtccgatctgtaagcagctagctgtaaacacgatcgttttatttattcaagagcgattagtgattaccagtactgctaatcactctcatcgactgtactgatgctgtcaacagccactgcaattaattttctcgctggtaattaacttgcatgtgcacgtcgcttgcctgtaaaaaatttccaagaaagcgaggtgccatgtgcaaataatggctttcgctgcacataaaaacgcaagaattaaacgtcgagtgatcaagctctggttggtgacgccaatggcgttggacgagtcgttcaagaggccgggcaccatcccgttcaagtgggagctccagccaggcgtcccgaagcagcaaccacaccacggcggcggcggcgccgccgtcggaagtagcagtgcatcttcttctccggcgccggcgccggcggcagcatcgacgctgctgctcccgccgaggctcctcgcgcctcctcctgcaggcggggggtcccatggcggctgcgacacgggggcgaacattctcgcttcgacgacgacgccgtcgccttcgtcgtcgtctcaccggcggtccatgtctgcgcggttcacggcatcgctggtgctgccgttcacgcggccgcggcggggacggtcagccaattcaaaggacgaggacgacatagccttcacggtgctctatggcgacaagattgtgtaaatattcatactccctttatcccaaaatgtttgacgccgttgacttttttaaaaatatttgactgttcgtcttatttaaaaaaatttaaataataattaattcttttcctatcatttgatttattgttaaatatacttttatatatacatatagttttacatatttcacaaaagtttttgaataagacaaatggttaaacatactttaaaaagtcaacagcgtcaaacatttagggaagtaaggaatattttgggtctattttcaaaataaattttattaaaggtcgatttgtcagaatttcggctgttttgatgtatatatgtgctttacgtgtctaaattcatagaatagagagtactaaagtaagcactgagcactgaggcatcatttccttcatttcggtttcgaaaggaggttggaaagagacaattggagcattatgcatttaattacaaactctacactgcgtaattgccagagttaaatgagtgtgtagtgtactgtgacaataattgaacttttaaattgcagcactaaatagatcatattagtcattgctttggtgacgctgatgaatcagtagaacatagataatcctcagcacaacatggtagcatggcaatctgtttcaacacagattttcctaccttccccctctccccgcactggcatggtgttttgctaacacggctaagcgcctgaagagttggagtgaccgtcacatcggcagcgtccgtctccaactgcagatggcgaaggagaacgtcttccggtttgacgtcgcgcaagagaaccggtctctctccccctggagacttggttgcagcgggatttgaaactgaagtgccttgggctagcttgcctcgctcgagcccgctagcgttcgcgtctgatctggctcaaggagggtgacagaaacaccatgtttttcacctgcacgctagagcccgaaggcggaagaacttcatcacacgtcttcaagatggggaccaacttgccgtctcccacgatgagcttcaggagcttgcctcttctcactttggcgctatcttggggacgtctgttgagcgcgatttcgcccttgacctccactcccttggtctctgccctgcgcatcttggggggctggacaaccctttctcggaggaggaggtttgggcggtggtcaaggccttaccttctgacaaggcgcccggtccggatgggttcacgggccggttctacaagacttgctggtcggtgatcaagccagaggtcatggcggctctcaactccctttttctcgctaacggtcgggggttctcctccctcaatgataccctcatctcccttctgccaaagaaggacgaggctgttgacgtcaaggatttccgaccgattagccccatccacagctttgggaagttgttctccaagatcccggcttcccgtctctctcctcaccttggcgagcttgtggcgcccaatcagagtgcctcgtcaaaggccgatccctttcatgacaacttccgctatgttcagctcgcggccagggctctccacgccaagcatatcccccgcctccttcttaaggtggacatcgccaaggcttttgacacggtcagctggcagtttctacttgagatgctcgcccacctggggttcagtcagcgctggcgtgattggattttcctcattcttggtgcctcctcttcccgggtgctgatcaatggggtgccggggccttgtttcccggtcttcggcagggagatcctctctctcccatgctcttcattctggtcatggatgtgctcaatacgatgctccgcaaagcctccgagtcaggcgggttccttccgctcaacgaccatgcctccctctacgctgatgacttggttctcttcctctccccggttcgtcaggatctcgaattcatccagggtatcctctctatctttggtgcagcatccgggcttcgcactaactttgccaagtgttcggttactctgatccgctgttcggcggaggacctggacctggtgcagtcctgctttccccgctcaatctcagattttccctaatcctatctcggcattccgttgtccattcgcaaattgccgaaggcggccctgcaacctcttgtggacaaagtttcccatcgtcttccgccctggaagggacaactcaccactctggttagccgctctgtgctggtccagtctgttctctcctccattccggtccatgtgtctatggtgatcggtcttcccgcctggatgatcaaggccattaacaagaagcgccgcgccttcttgtggacgggtacagactcggctcatggagggtagtgccgggtgtcttggacgaatgtctgtcgtcccaaagctttcggtgggttaggaattcctgacctgaagttggcagggtttgccctgtgagttcgttggctttggctccaacactcagggaatccttactgggacggcctgaaagccccagccgagcgagccgtcactgacatgtttcaggcgtccaccttcttcgtgccgggtgatggtgagtcgattctcttctggtctgaccaatggatcggtggccgctctgttgcctccttggctccagatctcctcttcgttgtgcccccgcgtctgcgtggttcgcgcacggtttcttctggcctggcgaacaacgcttggatttctgacatccgcggggccctcactgtcccgggcatctcccagtttcttcttgtctaggacgcggtgcttcacttccaactttcaccgggtgtcggggatctgttgacgtaaaaatacgaggcctgggggatctacttaactccagtgcaggtccaaaactcgccttcgggtatgctagcgtgccagttgatttgatcctgcaatcaacaagaaacaaagacaaagaaaccgcggttaaatccataaacgatagccgatcggctaggtgccgatgacatatcatttatctttgagccgatgtcacatatgcatcgatcggcagtcataaataagtaaggaagaactaaatctactcgatcggctgtagatattaacaatatataatccccgtgtcgatatatacataaatcaagtgattgggatagattggtcgccatgccgagacaatataaatcacttagatcaaaatatatattaacaacaagactatatacgttcatagcatagccgatcagatagatctagcatgtatcggctaatattccgatacaactctatactaggatatcaaagcaaataggatatattaaacaaaggcctaatatacttaaatgcaacaagatcttaatataaatggcagatttaacatatcagcgaagcatatagagtaaatatagttaaatcaggtaagatcggctgaaaccccgatactaccctaatcggcaaccaagaagcaggctagagattgagattctaatcacgacttataagatcaaactcaactgatgcagctataagtatgaaaagaatgacaatatctagacaatcaagccattggaagtttcatagagtggtggatatcctatataatctaagtcaacatcgatatctaacctaatcggctgccctcttccgacagatgttagccgattataggttagatagcgatattgccggagattatgtaagatatatgataactcgacaaattacataaacaagattagagtatcataaagatggaagcactaatcccgagaacgcaagccaccataacaagttttacctcttgttgaagatcgaaaccgatgcagctcaacccgaaagcaagaactcgtcgaaacaagacgaaagtaaaaagggtggcgatgcgccgagattgtattgaacgtgtgttaatttgattacatggggctcggggtctatttatacccgagaattacaaaacatgtccatatcaaacacgactcttatctctaacaaactctaagataccataagtatttgcggcaaacttttgcccacacttatctctaaggaaattacataaaatatcctaattaatagatacaattgccttcttaggactctatccatgtgcggcaatcatcacgaagtgcatcaacctaaaccgacaacgtatgccatgtcatgctgtcagatttggctcaatcggctaacccatctgaccgaactctgccgatttcagtcgtagccgattcagattctagctgatccttactctgtttccggaatgatttcaatcttgattccttctcgatttcttcctcatctctgatccctggattagcaaatttggtcgttaacaggatcgtcttgtnnnnnnnnnnnnnnnnnnnnnnnnnnnnnnnnnnnnnnnnnnnnnnnnnnnnnnnnnn

SEQ ID NO: 35697 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnttccaagccgttatacttcagttgcagacaacaaatcatttaaatcagatgcaagtccaaggttgaattgtgattccgaatgtgaatccacttcagctgttgacacagaatctatgttttcgttctctttatatgatatatcatggcctccaaatgaagtggaatcgcttcaagagaagtactcttcaacgtgtaggctgtttacctatgaagagctgaaacttgctacgtcaaacttctcaccaggtaatgtcatttgggatgtgcattactttgattcacaggctttttggcaaagttgtctgctgattttcttttacaccaatgcagatatgttaattggaaagggaggaacaagccaagtttacaaggcacaactatttgatggcacattatcagctgtaaagattctgaaaccttcagttgatgcaatacaagagtttgttacagaggtggagattgcaaccagcttgcaacatgacaatattgtttcactaagaggattcagttctgataactacagtcttgtgttggtatatgattacatgctccagggaagcttagacaaagcacttcatggtaatccttaaaatgaaatactttgcatatttattccctgaccttattgatagctcatctcttactttgtgattgactggttgtaactgctcttcaggcaagcatgacagcaaggatagccttagctgggagaagag

SEQ ID NO: 35698 - DNA, 791 bp, Oryza sativa
  unsure (1)..(791): unsure at all n locations
nnnnnnnnnnnnnnnnnnnnnnnnnnnnnnnnnnnnnnnnnnnnnnnnnnnnnnnnnnnnnnnnnnatgagcagacatttgttttcttcttatgcacgaactgattcagtttctatgcttagatagctctgaaaagacctatatatgatcaattgtgatgtacactgggatattataccttgattcttttattaaccttatttaagaaactatatatgataaagatttagacaggggacactttgtgaaggatgcaatttcagtcatctcaagtattgagcttcagttgtgatgtatcctcaagccataaatgatgttactttgctaacagtatctgggggcggacgctccaggcagtgaagctgggactgggagcagccgccggcgaatgcttctccaagagcaccaagattcacagatcgtagtggttctggaaaaaaaaagtcctatatggcgaatgtctgaagctagtggttgatggaaaacaacagtcctatgtgtgaagctggagagaatattcagagatgctcgtgtatagattattatcagttagtactctgtttgtgaactatttactccctccgtccaaaaaaaaaaactcaaccaacgaaaggagtgttttttgggatggatggagtattatgcacggtaagggcttgtttagttggtgaaataaaaatttttggatgtcacatcagacgtttaaccagatgttggaaggggtgttcgacacgaatgaaaaacctaattcataactcgcctggaaccgcgagatgaatcttttgagccta

SEQ ID NO: 35699 - DNA, 683 bp, Oryza sativa
  unsure (1)..(683): unsure at all n locations
nnnnnnnnnnnnnnnnnnnnnnnnnnnnnnnnnnnnnnnnnnnnnnnnnnnnnnnatgcatggtctaaactgactgggtatagctggcatgctttttcaaggactgctttctgccatctatgccatcattgcccttctgaagattaccagaatagcatctctcccttgctattacgtataaattgctcagtaaaagaggcaggagaaagtcaatcaagaacgtgagaaagaataaaggaaaaataataaagagagaaagttgcagtttcagaaaatgaaatacctgagaccttcatctcccagcccctgatggctgcaagcaataagagcagcaagagaagcactctcattcatcatgacaccaagattcttcattttctcaaagagctctaaggccttgctttcatagccatgaaccgcatagctcaggatcatagcggaccatgagaaagtgtccagacatgaaatctgctcaaatgtctgttttgaagccttaagatcacctatattcctgtacatagcaatctgggaattgccagagacagtcaattgatcaagaccagttttgactgcatgacagtgtatcttgcttacaggttgttggtacagaaagagcagcacaggcactcatcacacttgatatggtgaattgatctgtcccttttctggtggagagaagctcc

SEQ ID NO: 35700 - DNA, 644 bp, Oryza sativa
  unsure (1)..(644): unsure at all n locations
nnnnnnnnnnnnnnnnnnnnnnnnnnnnnnnnnnnnnnnnnnnnnnnnnnnnnnnnaagcaccgaaatctgaaaccttagtagtgaaggtaccatccaagagtatattagttgatttcacatctctatggaagattggcattgcagcagaggaatggagataagcaagtgcccctgcagcctctagagcaatcctcattcgatcatcccatgtcaacaaacaattggtgctcagatcaccatgaagaagaccatgaagtgtgccattagaaatgaattcatacactagaagaggcacctcagattcaaggcaacaaccaaaaagtttcaccacattacgatgaataatctgggaaaggatggcaacctcattaacaaattggtcaatctcactctgctccacaattttggacctctttatggcaaccactcgttgatcggataaaatccccttgtaaacagtaccatggcctccatatccaaggatacgtgttgggtcaaagttgttggctgctttctctaaatcttccaaagaaaatattcttgtgttaggagtaacattgttactggatgagatcagctgctccaagagaagccctctgttttttcggaagtatgcccttcgaatttcttccgagtgcttct

SEQ ID NO: 35701 - DNA, 1027 bp, Oryza sativa
ctcttttgtcattctatagaaagatatcattcttgtgaatgctgtcgctgttgcacctatagctcaactgtacatgataagggcatcatgtgtaaactatgatcttttttataaaaggtgaactgaatgtcatcacatgcaaatgtttatgtatctttctcaaaacatgatactagctggatcagctatttgaatatgaaagtaacgtgatagacttcctgaggaagtaaatgtgattcttctcgtcatttgtatgtgattttattcccctgatattgttcttgtcaagggtatttaagtccgtcttttatctttggtatcacacagctttcggttggtttctcatgtaatttatatctgttgacgttcaatccatatttacagtattaatctgaatcatgttactatatattttcatttttctgatgtaaaagttgctgtgtcagcttctcttcgctgaatgggaaatgaatcaccacttgataggaagacattaggataacttgcgtgtattacctggacaaggacaagactttcatcacctctaaaagatgcttcgtaatgcaagaaatgtatttacaaaggcttatatacctcaatgggaataataaagaactacatgcgtattagtgctattggagaagggcataaatcttacctaccaatgggaatagatacaacagaaagaatagccagcacaaaaattggaccaaatcacactatttgattccatcaaaatccttgaacctgactgaaactttgtctgatgtcgatgagcttccaattataaccaaaaatttgtctccaaattggttggtgtcactgcaactgccgctgtttggagatctgcttaagcccagcttccaggtcttccaatgtgattgtgatcatagtattcgcatagtcgcagttgaaatcaagacgtagatctagattctcacaggcattgatgagcagcgtgtctacaaggccaccattcatctgtttacgccgctgttcagttgtctccctggcaaacagctctcca

SEQ ID NO: 35702 - DNA, 1697 bp, Oryza sativa
tctacaaggccaccattcatctgtttacgccgctgttcagttgtctccctggcaatcagctctccaacgacctcgatgctgcagcttgggtccagcttgaacccatacagcaaactgctctcagttgggttattcatcttcagatgtaagatctctgctaattctgttgtggtgaaatcgtcaaaataaaagaactttgtgaccctcctacagaagccgtcgttggaggcgatgacgcgcttcattggctcacagtatccagcaaatatcacaactatcttgccattgtccattacagacattatctcctccaaggcctccacaccgtaatccttatcatcagatttttgcatcggtatcaacctgtaagcttcatccacaaacagaattccaccctcagcatcctgtatctgtagaatgtatacacattatgatgtataagttaattaagtagagcaatgacaaatttaatcataataactccaaagtcaaatctacccatgtatttatccaatgtccctaaaacctactccctccgtcccaaaatatagcaacctaggaccggattagacacaatctagtactacgaatctggacaaagttactatattttgggatggagggagtatttatttccagatttaacaattttttttcttttccactttatctcaaattgataattgagaaaccaagtcttctgacaaaagcaagtatttgcaaaacataagaatccaaatactaaggaccagtgtaagaaataagtaatagtttgcataactagtaataacagataaatagttggagctttaatactccgatttccatttttaaggatagagtttgtatagtcacacgggaacaaaattcagaactcaattgaacagagaacatagctacctttcgcctagtttttggtccagtgtgccccacaaattctccaacaagatcagttcgctgtacttcagtaactttgtcggtagggagaaccccaaccatatgaagaagctttccaagaatccgagcaaccattgttttacctacattagaggttgcaatattatatagctggctttagcacctaaactacaaacacttgaatgatttgtatggccttgtttattgttttaaaacttgtttacccaagctttgggagaaatgctttcagcatgcatcaaagcaagaatcacatgcaagaagttcaccaagcatacatatttcttaattgtactgttccaataaaattcatcggtgcacaaaatagtaattatgaccgtaataccatgatgataaatcatgcttttgattatcaaactgaacataattgtggtacctgttcctggattgccaagaaatgccatatggggagcccttctgctagcaatccctaagcccatagctcgtcgtttctcatcaaaaagcattcccctggcccatctacgcaattgcatttgaggtcctgtaatcctacaatttgtgatattgcttcttcaaactccgccattgcttttccttcacggcatgacatgagggctttccgttttctttgctcttccatatggcgagtgaggagtttctgcagcttttcattaccagctcctccaggaatatgattcgaagggattttgcctactgaaggggcaatgtgtgatgagaacaagattcagtacactaaagttgttgtaaagaaagcattt

SEQ ID NO: 35703 - DNA, 10833 bp, Oryza sativa
tgccatgccattctgcaacaatgagttaaaacagattaaatatgaatacccacaaataatacgggatagaaagaaaagtaatactagatagacagatcctacatttgctttggcttctatatgtgcaccacgttcaagtagcaattttgctgattcacaagaactgtttttcacagccatgtgcaggggtgtctctccatactgcagaacaacagaagcagtaatttatatcttaagctcagagcatacaattagtgtcgcagaggtgccaataaggctgcaacaaatgccagatacttcaattaccatgttctttgcttccagctcaactttatccgtgccttggaaatcaagcaagaatttgactatgccagtgttattgtagccagctgcgacatgaagcggtgtttgggacatctgcatggtacattgtcaaagagaaggtaaggaacacaatattatgcagtacttcacaatattatgcatagcaattatgcactacaaaattctagtcagaaaacaaaaaaaaattaaggcctcagttgtttagaaactaatcaaattcatcatcgtgcaattcaggtctagccttcatgttatctctggcaggaatttggtgtgttgtgaactgagatatacgcaatatccttttactgatctatttgcaaattgtgcgcaaatcaagattgcagtggcagcaacattacaagatatccaaatcttatcagttcaccaaacataaacgtctaaatcatctcgaaatgcagagttacaaagtgtataagaaagcgaccaatctgagagaagtcgcaaaccatttcaaagaggaattagagaaacctacaattgcataaaactaaattccaccgaaagaaaaattgacagtttgaaaaccattgctgcaatagtctgaaattccacctaaagaagaaccgacgtcggaattaaacgaatctagaggaaattttgaaaactcttggcgagaaaagaaacttgcatccatatcacaaaccgagaaagaaacatcagagcaagcaggaggatggggagaaaaaatattcccccaaagaaagcaccacctcagcatcctaaataaggaacgaaatgggggaaaccgccaacatggggataaaaatccaagaaccaataaaaatccaagaaccaaagctcatggaaaccaagaagcaagcacaaaatccgatcaaaccaacattttttcttcacaacgaaagagaccccatctcttgcgaatctcgaatgctcactccagtccactccacactgcaaggagtgtcaaacgaaaccgcgcaagaagcaagcaaaagatcggaatttctttaaaaaaaactaaattaaatgaacaagaagcaaaagggggggggggagcaaggcgcgggcacgcacgacggggttccggtcgttgatgagggcgggattctcctgcagcttcctctgaacgccggcaaggtcgccggcgcgggcgaggccgtggatggtttccgccttcgccggcctcggccgcccgttctggctccccggcaccggcatctcctcccttttctgctcccctccctgtgatagtgtgtgcgcgctcgctcgagcagcttgcgcgtgtgaaaaggaggaggagacgaggaagaaagggaggcgacggggggcgagccgacgggtaccaaatccctcctgctgtgctgtgcgctttaaaaattggatttttttttttgtttctggatttgttcttgttttggtttaattttagtttgtttctttggagctttatttttggcatctatcccggggttttctggctttgttcgttgtgaaaaaaaaatgaacattttttctcgttttctttccctgcttatcgcatgcaaaaaccaatgattgacactaattacaccatgatttggtaatgtggtgctatagtaaacatttgttaatgatggattaattaggtttaatagattcgtctcgcagtttacagatggaatctgtaatttgttttgttattagtctacgtttaatacttcaaatgtgtgtctatatacgtcaaaaaaatttactttcaggattatggataccacataactaatattagttgactaaatcttggcaggacccaccacataccatgtcttatacggaaacaaccttcagatataggagaagttccgtatgaggaagaatgaatagagttctacatggaaacgacgaggactacggtcgtagtgcagagagtattgttgatcctttgtacttcctccgccccctaatatcaaggattttgacattttgctttcactgtttgaccacttgtcttattcaaaaaatttatgcgaatataaaaaacgaaaagttatgcttaaagtactttggatagtaaagtaagtcaaaaaaatagataataattccaaaaaattttaaataagacgaatggtcaaatagtgtaagcaaaatatcaaaatctcttatattaggggatggagggagtaacattttaggtggcgtttctcccgatgaagatgaagattaagtttttttacgtaaaacgatgttgtattaacgtatgattgattatttttaactattgcaaacttgaaaaatagattaatatgatattttagagcaactttcatatagaaagtttttgcacaaaagtcaccatttagcagtttgaaaagcgtgccacgaaaatcttaatcttcatccaactcttgttggagaaaagaacgggaccttgaaagcacaagaatataacgaaaatacagaaaatcatggaacatgaagaaaatgatgttttaaatggcacgttgaaaaaaaaagtgaatatgaagaaataggaaaaatgaaaaaacacgttttgatttccacaaaattcctatggaatagattgttccgtatgctttcaggtatctttcatgagctaatcatttgtttcaaaaggacttgatattcattttatccatatgatttaaatcataatttacttttctttgttcataaggggaaaaataatcaagtgattcttaaacactccaatttttttatttgatgtactaaaatagtatcatccttccagttttatcgaattcaatcatttatcaagagtgcacaaaaagactatgtagcattacatgaacgagtaaatgtgccacaaaagggcaacaaaccaaacaaaaaggaaaggggaaaggagaaaaacatagaaaattaattataaaaattgttttttagcgcatctgcttacccaacatattttttggatgaatgtttttgtaacaaagattttcgaatgaaaattttcatatgaaagttttcctgatgaaagtcttcagaagttatcgaaaagacttttgatagaagttaatagtgcagtccttccaattttatcaaattcaaccatttatcaagagcacacaaaaggactaagtaagagacgagtaaatgtgccacaaaagggcaacaaaccaaacaaaaaggaaagggaaaaggagaaaaaaaagaaaattaattataaaaattccttgtgttttttggatgaatgttttcgtaacaaagattttcgaatgaaaattttcatatgaaagttttccggatggaagtcttcggaagctatcgaaaagacttttgatagaagttaatagtgtagctacatttaaaagttttccacctaaatacttacaatagttttttagtagtcctaatttagaattacttgtacaaaaatatagttttaacttttatccgatataattaagaatttgtttattgtaaatgggttatatccaatgtgttttatttgataacaatatatttgaggccatcaacctagcttgctgacagactcttattccagagatggacgacatgatttgtgtgacatacttgcatcaagaagaggactaatcgatcttactttgcatctatgatttgaagaagccaagcatttgatttcttagcaaaagaaccattgttacagagcacctcacacgtttacgtcgatatgctaaaagaaaattatattatgttggtaacataggatcattttgtagttatgccatataaaaatattgttagtgtaaaaacttattcaaataacttatctaactaccaaatttggtatagttgaactaaaagctaaatattgaaggcgtgaggaaaaacttacatgaaactaaacacctgtatgttactaatagtatttctattttgagtctgattaagatacaaatttcgtttttttaagttgtcaattggtgtgtttcgtgcgaaaacattcttccgtacaagttaatattaaatctattttcgaagtttgaaataattaaaacttaattaattatgtgctaatgaatatttcgttttgcgtgtctgtactcgagacatctatagcttctcccaattatttgtattttgtaaacgcaataatacaatgcaatttgttattcttccgagtctgatttagggcttgttcattttatagccattttcaatctttccaaaatttggtattgccaaaatcttagcaagttagcaacattactaagttttggtaggataggttaaatatattattgtcaattctctaagtatgacaaatatttgataataaactaaatattatcatgcatttgttaattttatcaaataatggtatggtttaaaatatcataaatctgaacgtgcccttaaaagtaatcagtttttcaaggacaaaatcacatatcaaaacctctagtactagtaccaaacaagaccagcacaataatgtaattgtacagccagcataatttagcttgaggatagcgtagatctacgcataagattggattaattttgggctagcatagctacattgaggcaatgtttctttcagtttaggattattataatctaaattattgagtcagattactataagctataagctagattgttataatctatagtagaataagcggttagttgtttcttttctagattattagatcctagattattggatttgcaagtctacaatgggagtggggtggcatggtgggtaatttttacccaataatctgaaaaaagccaataagctacttcaataagttgtctgttattttttagcttactactaataatctaaattataataatcccaagcttaaataaataggacattttcagcttactactaataatctaaattataataatcctaagcttaaataaatagggaaataaatagagcctgactcatctggacccgcccccgtacggaccccagtccccaagtgatgcaggcagcaggctgtctgtcggccagcacgtgggaagccggctcccccgcgcccgcgtcggctcgcacgcgtgagtgcgtgacgcatcagctgttccgcatctcgctcgctcactgccagtgccagctccccgccgccgcatcgcatcgaatgccagcggtgttacgtcttacgtgttcagagagagtgattttacactgttcaattattagtatagatttacatgtcatttaaataataaaaaaaataaaaaaagagacgatggatattttcatatcactcgaatattatattttctaaaggaaatgagacgatggatttacataagttaaaattcaatttctacgggattaaaaccaaattaaattatactaactagttaacatatatttatagttaaaaatgtttattccgttgtaatatgtataagttaaatttgaccttgcatatttacgaagtgatcaatcacatattaatcttatctcgttgatttttttgattttttcataacttatttaaatgatatgcaagtgcaaatcataaggcgcagtaacaatgcaagctacgctatgcgtgtctcttgcccatgcaaagcatgttacctcttttgtgtggccttaattggggtgaggtactatcgaagccacaaagcccacaatactggtgaccaaagcaaggaaagtagcccacggaattaattcccccaactaatctcgacgagtctctcttggacgcatcgcatccctcaacctgtcgcctccaggtccactacacgcctcccaatccaccacggcgcatcgctgaccaccatattccgccgcgaagagttcacggcgatggagctctggagcgaactggtgctgcttctaattggatataccccatctaggccgacaagagtgagggcatgaaaaagaggggcaagaaggtgatggtagtcgtcaaatccttgcactgagagatcagacttgtcaattgagatgtggaccgaacctagggtctaggatgtggctgacattgatgttctagctcgtccacttccaaccccgttaactgtggaacaggatgtgatggcggatgcggtgctggcttcagctccacctgtagcagaggcttcttgaactcctccaacaaccaagtcaactcaggtaatggatctcaatcctaggtttttgtaaatttgggtgtcctttggatatgaatcatacgaagttgtgctcttgatttaatggcatgaatcggtgggcacgtgagagcgattttagggattccatcttcggtgtggcgtgaggggaaaacgactcggagccatgccctccacagcgcaggcgcgatgtgttttctcagccgtgagtggactcacaaagggcaaagaacgtgtctctctgtgtgggggaaagaggctcaacagaggcgcgcatttagtcgacacataagtgaatatccgagctggcaatacgaagtaacttaccgcatcctcgcatggtaaaggcctaaagggcctaggggcacatcctctccgagagttttcaatagttttccccattttctccatgcttgggcggttgggcctccatttttcctctctccgttggcttacgcctcctattaatgggcctaatatcggcccatttcatgggtcggcccgtgcatcggtgcatgccacctcaggcccattcgctctaagaaaaaggccctaaagtctaaaaccctacgcgtccgttatcccaatcccctcgattctccggcgactccggcgatgatgccgctcctcctcctcctcctccccgtccgctccgcccctctccggcgcctcctcctatgccggtgctcctcctcctcctcccccgccgccgccgcctgggcctcgtcatccgcgtgccccgtccccgcctcctcagtcctcgccccgtaccaccgcgccttcgcccgccgcatggccctcgccggcgtccacccgcaccaccgcgtcggtacgaatgcggcgtcgctttattggttttcttgctgaacgagtggctctgaggtatggttggttggctggtttgcagcggtgggggtctccggcgggccggactccatggcgctctgcgtgctcgcggcggcgtggaagaaggccggggaggggagggagcaggaggatgagggagagggcggcgtctcgggattcgtggacgggctcctgggggtcgtcgtcgaccatggcctgcgccctgagagcgccgacgaggcgcagctagtccgtgatcgggtgcgcggcatgggtaaatcttacttatggattaacactgtataatttctttattttaacacaaatttactctgcacctgcgcacatagaaaattgcaatgatgattggcttccgttaggtctgctccttgagttgcatttgaatgggaccttttcttttgaactgttttttttaatgcgacttgatccacaaaatagacattttgaggtgccacaattttgttgtaggtgttgtttgtgagattgctacatgtgaatggccgaatgggcgaccaaagctggggcatattcaagaagctgcccgtgaaatgaggtgtgcgtctccctctgccatggttcactacttgtcaaggataatgctatctgaacaatttgattttctgcaaacttagtatttgtggttgatatggccaattttttttatgtctcatcgatttccaaaacttacatgcatgctgtatggatatctgaaaaaaaatgtacctcacctactaacaactttgtatgaaatttgtgtagaccatttacttgcacaaagtgttaggagttaaggggctttcccttctctttaccggcacttaaggcattagatttagttgtttgttatacttaagagggcacatatgttagtattttgaactgtgggttgtgtaggcgtgtgttgtatggctttatttgccacttctcttatatgaaatgatacatagctctccggcatgttcaagaagaaaaataatgaatattttgttttgtttagttaaaactctgaaccttacatgttggtattagtgcattattctcacaatatattggcgctgagggtatcaggaatgttctttaggattcttcatggacattacctcctgcacaatgtgcattttttttttcaatttccagtgttgagaagctgtaaacttgccacttcaaaagtaaagagtgacatggttcacactgactactaaaatatatggaaatttagtatgctatggcattgtgaaaatgaatgctatgttcttcatgactgtatatatctacctgatatatgctctgccagttccataccaatttattcacaaacacagaaataccttagtgcattttaacaagacttcacattttaataaattcaggtaccaaaaactgttggacatttgtataaagcaacgaatagcagtcttgcttatcgcacaccactctgatgaccaggtctgttaaattgagagatgtatttttcctttttcccttggttttgaatgagtgttgccccacttatggaattgtgagttaacacataaaatccttgttatgtaaaagcattgagccaaatgacacctgttatcatcgtcaaataagcggtgctaatttttttctcttatattttaagtttttgtggacttgacaacttgcatatagggaactattattagatatgatactattgtgccttcatgtattactgtatctttgtttgtgcatttactctctaggctaacatacattgtcacatgaatatctgatatcggatttagtggaccttgcactgatccttgaatttagacatggttaccttctaattgtcgtagtatccaatgtggtattgaattaaagattactgaatctaatgtatactgacatctttctaccattctatgttatgattttatgccattatagttactgcagatgcagattatatgttttctctgagtgaatttaggcttataaatgcaggccgaactctttgttctgagactatctcgcaacagtggtgttttggggcttgctggtacagcctttgtatctcagttgtttgcgcctaatctaaaatatgatggagataacttcagtcgttatggtgttattcttgtccgtcccatgcttgaattttcaaaagatgacatgtataaggtaaatcatgatctcatgatatttagaatcagccttgcattttacttgaggagccttatcttacttttatctttcaaatatagtcaatatttcatcattagacacttaatttgaattttgatttcccaaaattcatttaacatgctgtatttaatgagttcagcttatgtatgtttctagaaattcctcaccaatattcctaatttctcctgctgactagcctttctctgaaaaagcaacatagccttttcttgtaggagactttgatgactttgctttgagctgtcatttttttttaaaaaaaatgatcatatttgtgtagctgttactgattgatctgtcatacttggttctccacagatatgtcaaggaagtaatcatttgtgggttgaagatccaactaataatagtttgctgtacgttaggaatcgaatccgggcatctttgagaagtttatccatagaaggttcacaattgcacttaagctgttgcttttgagtgattttagaatcatcatgttgaatcctttgtcttcaactttacctcatttatatcataatatagatcattcacagatgatgattgatgaaaggtgatgtccataaacatttgacaaatgtataaagcttgattgagcatgcgtacgttttactcattataaatttcaatgaattttccatcactattaattatcaaatgccatgtttggtcacaggaacaacttgttctattgaccatccgcaattgggtaattctgttgaataataactgactattgactgtagatacaccatcttctggaatcagcataaatgtttgcttgtgtgcaccaaattgtgatttttcatgtttcttgtctaggttggtctgtacacaaggtctatttattttatagtaaataaaaagtgtgtcagactatcagtggcccagaattcatgggtatctagctcaagagattgtatttagttaaattcacttgtggaagtaggtcacagaatttgtagcaaatgacaacattttcactgtttcacatgttgccaattcgtggccgaagttatttgtggcaagtcctagctccaattggtatgtgtgaagctacatcagctctggccagcttgtctgcagttgtaaatttgcaaacgctatcaccttatgatgagcgatgaacgaatgcacattcagctgacaaattttgcttatctacaggtacctttcagtcagagcttcacaaactgatctatgcgtgccggttgacacgagcatttatagataatgcctgcagtatggttttaaagaagtctttaacaataatggaggtataccctttttctgtaattcgatgtctcctatatcatgccattactaaaatttatatactaactcttttccccc

SEQ ID NO: 35704 - DNA, 1203 bp, Oryza sativa
  unsure (1)..(1203): unsure at all n locations
nnnnnnnnnnnnnnnnnnnnnnnnnnnnnnnnnnnnnnnnnnnnnnnnnnnnnnncaattgcaatctgagtttactattattttgtgcagaaaaagattttcttgtacgtgttgggttatctcatttgctgaactgtgcgatagcatttcatgtgctaacttatggattaccaaatcctggtctagcaccaaataaagattactcattggttcccccaaaacatgggttaagaatcgacctatggagggtgggccctaggggcctcaaatcacgggttaaggcctgatctgtagggggcgactccttgtgtaggggggaccgtctattgtgacctttctcggcccctgttgatcagcgtataacgttgctgcaccgagaccaagaaaccaaatcaactctgcatgcacatcatttatagctaattctccctaattagcatgcagctcaacggatttattctgcatgcatctcaacgcatgagacttcaaaagactctgcatgtacatgcatagcatgcgaggcatttactacaacctgagaaaacgctagtacctagtttatacgctgatcaatttggaatatttgaaatttggttaggcgctgatcaaaagggaatggagggagtataatacattagggaggtctttccctttggggccgagttctttctcatctttttattattattattatattagaaccatagaaaatactgttatatattaagaaggtttgtgaaaatattgttgaagtatttggagatgggtacctgagatctccaaagaataatgacacagctagattacttgccattgcagagcaagggggttttctcggaatgctttggtgcattgattgtatcacatattaataattggaggatagggggagatagaataaatgaatcattgatacaatcaatgctccctagcattcctggaaaacctctctactctccaattggaagtaatctatctatgccattatcatttggagatctcaagtactcatctccgaatacttcaacaatagttttcattcacaaacattttaagcttatgacagtattttctccaatttcaatattgattatccatagcatctcttggtactacataagttcgcattcaaaagctgctgtacacttgtgcaaaagatataacccaagacctccaacaatatatctttttttgcataagata

SEQ ID NO: 35705 - DNA, 4144 bp, Oryza sativa
  unsure (1)..(4144): unsure at all n locations
ccgattgggttgttccttgctaaagtttgtaaatccaattcttgggaagagaataagaattattcaaatgctctctgtaacaagttgaagaatgctaaactcgtgcagcactctagatatttgcaattgtcagcaatgaaatctcttcaaatcttgagatctattccagcacctgcaagacgaatgctaccagtgttgaccaactcgcaaggtgctgtattgagtataccggtaaggattccactcaaaagacattattttgttttcattttgtaattttaatatgttctatttttttaagtacttcattaatccgatgcattgtttttttaaatcaaacgtgagctaccgaaagctaggtagtggtgaactactccaaaccttctaattgcatgaggttagcacagcatgaagcacacatgacctagctgcccttgcatgcatgccttttatttgttagctaactatggaaaacagctgaatatcaaagttggcactttgatatcgatttactataatatggtgagtatgcgaaactccaagagcagtactggccatgcgtggcatagttctcaattctcaaatattgaaaatagtaaaacctgtttttggacctggcaactgattaggaggtctgacttcctagtgattagccaattgcttcagtctgtcacaatttttaacgggttcagtaccaactgaaacagcaggtgactaggaaataggaatatcgtgcagccagtgacttggcttggaacagtgacaaactgaagttgttcataacatggagtagaagtcctaggtagaagtctataaaccatctggttatcttgaaaattgaccagagaattttcatgttgatttcttttctgtccaaaaccatactgtcattctattactacatgtagttactgaatgcacagttttctataagatcaaaggcttcatgattcaggtggcaaagaaaatttacagatatgaagttctgggagatattatatgtagtctttctggaacttgcatattttggtttgacatactcctagcatcgtttatcagatatttgaaggcatgtagacagtgaatgcatttattccttcagagaaaggctttactcctattgtgctaatattctctcttttttcccttcttgttaagagtattggcttccgatgttgcccaagcctattaattgaagcagtattcagtccaagagtaccacttggtggaggatacacttcatatttgtaagtggttgatatctattgatgacaaaacatgaaacatcaagtgtataactgctgttgagatgtaagcagccgctggtaatacaaaacatctgatcaatcttctccctcagtcaatcattatatgcgagctgctaatgatatatactagtatcatgtttgtcccgtataactatttcaggtgctgaatcgcttgcaacaaaccgtccaatcattgccaaatgcgaaacagccttagcttgccaacgtcgttgtgcagttaactgatgtttcgtgatccctggttcatacatatgatgatttgacaagcttgacaagaacgggatttttacacgacatttgcggatttgccagtttgcagggataaatcactacaacagttatatgccagaacaggcccgattctgcactggtttccatctcaacacctgtcgttggacatcagggtgatcatggctgaaatctcgtagcttcgctttgcagtgccaaccaggtgtcgctgaggcaatagcaacttttggcactaggcaagtggaaatgaaggtaccactagatcactgtgagagcaattttgtcagcgctggaggtggctcaagtgcctaatcgttaagaattttaaataggaggatagataaatatatcaagtacctgagcgctggaggtggctcaagtgagatttacctccccaagaatgcatcgcctagcagactcccggttggacatcagcctgtaatttgaagccaagaatcgtttcatgtgaattattcgtcagacattcttactagaaaagcaatgcttaactctacttacgaatacgataacagtgttcaagcagtgacagacaaaacactgtaaatgattgttcatgtcttggtatgtatgccttctcattctcttcacatccaatgggttcgtgctttgttcgcacggacaggacataccaccctccatatccaacagcgattcgctgtcagaatccgaaccacttgtgccttccagagtttggttcatattcagattggtagctgatgtgggacttgctgctgcagctgatcacagcatatgaacagagtagtgagcaagaacagctaaacatctgaacattgtgccccatcattagatgcagttttgatgcagcacataacacattaataactactgtccatgtatgtccattgctggaatctccatgtgctgaaacatcccaagttgacaacgtagaaactcctgttaggctgttaaccagaaaaatgatttctcatcttcccatgcttagaattcagggttccctcttaccaggcaattcgaataaaattcctctaaaacatgaaataacgttcgtttgtagactaaaattgtgcgagaaaaaaatatactactagtcactatgaaaaagttactgtagtagcaaaaaattggtagaggttgaaacagtcttctacttgaaaggtagcaggaggcaggagctgatcagtagcagtaaatgaaatttgaagacatgaaattgcagtcaattatatatggaccgtgctactacaagctacttccggtaaaactatgaagattaagttgacacatgtaaaacgagaaagatattaatatatgattaattaagttttaattattacaaatttaagaaataaatatatatttaatattttaaagcaaacttgatatagaaaatttttacacgaaacacatcattagtagtttgaaaatcatactagcagaaaccgaggtgaaatgtaaatcttaattagaaaagaacagttaataacgttaaaagtaatgatatttcacttgtgagcgagggcttccacttattctacacctctcaaatcatcttatgaagtcggtttaaagtcaagctcaaagttttcttttcctgctgattctgtcaagcccattccttagctgtggtttcctttctttttttttttctaatttaattgagaaaaaaagtctcatctttaattttggctactcaccaaaggaaaggagaaaaagaagagggggaagctgttttggtccatccaaacgccccaaaagcctcccccaccgccccacgtctctccttgcccctccttcccctccgtatttgcaacactgccattccgtttcgttcaaaatctgactcaagccctcgtccacgtctagtactgcagcggggagtatttcggggaaacttgggcgctgctagtttagggcatatttgggttgaggagcttcagctgctgtaacttcttctaaaatcagaagctctccaaaatagtccagcttttgatctagattctaaacctatagtggtataatctaaaaaataaactaaaaattaaaagctgaaaaaccttttttagattcttataagctagctaccaaaccaactgtcttgagcaacagacccttgggagttgattcggatccgcaccacgcaccgacctcccgcgacatgacggcgcaacacgttggctgccgcgcgatgtcctgcatgcgctctgacacgtggggtccaccgagcgggggcccatctaggggtgggacctagcaaggcgcatccttggtggagactggagagccgtggagtctctgcctgtgtgcacgggaggcgggctacgtgtcagcttggcgggatcttctggggcatgccggcatgtggccggccacaggttttgcacgatgagtggtggtgaatggacacgaggggagagatgatgtacatgtataagagcaaggtaaatattatagcagctgatggttttaattagtgttcatgttatttatagtagacactatagttaatatgtacgataaagaaattttatgttaactgcgatattttattatnnnnnnnnnnnnnnnnnnnnnnnnnnnnnnnnnnnnnnnnnnnnnnnnnnnnn

SEQ ID NO: 35706 - DNA, 1399 bp, Oryza sativa
  unsure (1)..(1399): unsure at all n locations
tnnnnnnnnnnnnnnnnnnnnnnnnnnnnnnnnnnnnnnnnnnnnnnnnnnnnnnnnnatttacctatgtttagcaaatctgtggcgacggcgcagtgcagaggccggtgtcttggccattcacaaatcacaattacttgaagcacaaagaaaccacactaaattatcgcctttaattgttcagaaacgtagtattcactccagagtaaaattcatttaccatatcccctatcagatgaaaacttttggaccgtttggtcacttacctgaattctccaggctctcaccaagtggatcatggattcagaaggcaactgcaataaaatcagagaaaagctctaacctccacaacatttatacttcgtagtttttcagtctcttaccaaatactgtgtactatatatagctagtcagttctattacaggacgacacttgacacgacacgaggactctgaaaaactcaagtccgttcacttgggacatcacatttttatacgtagctgagctgacaaagcagtaagaagtagttttcacttggacatggcgccattggagtggttgtcccagccccaggcgtcacccacctcgccaccgccgggcatctgcacctgctccggcggggacagcccggtgaaggggtcgtcgccggcgtagtccagcccggtgagcacgtcggggacgcggcacgccccctgccgggggttcagcgccggcgacagcccgcccaggtggccgaggccgcacgacagcgccccccgcgccaccatgtcctccgccatcttcacctgtacaaaactcggggacagcttcagagttcagaaacagccgaaatgcgtgatgccgatgtgatgatgatcaaataataatgcaatgcagtgtgcagagatgaaatgcatgatcaccttgacccggagggcctccacgtctgatttgaggattctgttgtccgtgaccgccgtcgtgaattgctgattggcatctgtcaactgcttgaaaagcgatgcgttttcgccccggagctggtcaacctgatgaacgagcacacgaattttgaaatctgaataaacccatagaccatcactcaaaattacagtaccaattggcacaatattttgttactcaatctgatatatggatggcgctgtttgaatttttaacattagcaaaggcgcaacgggtacaaatcaactcagtttacctgcgtctcgagatcagctaagtgagcttgctttctcttccttgatcgacgagcagactcccggttggaaaccatcctgtaatttgaagccagcaaccgtttcatgcaagttctttgtcaaatattccttctgaaaagtaatgtttacttctactactagcgaatacgcccataattttcatgccgtgacagacataatg

SEQ ID NO: 35707 - DNA, 5213 bp, Oryza sativa
  unsure (1)..(5213): unsure at all n locations
nnnnnnnnnnnnnnnnnnnnnnnnnnnnnnnnnnnnnnnnnnnnnnnnnnnnnnnnnnntgaattgctgattggcatctgtcaactgcttgaaaagcgatgcgttttcgccccggagctggtcaacctgatgaacgagcacacgaattttgaaatctgaataaacccatagaccatcactcaaaattacagtaccaattggcacaatattttgttactcaatctgatatatggatggcgctgtttgaatttttaacattagcaaaggcgcaacgggtacaaatcaactcagtttacctgcgtctcgagatcagctaagtgagcttgctttctcttccttgatcgacgagcagactcccggttggaaaccatcctgtaatttgaagccagcaaccgtttcatgcaagttctttgtcaaatattccttctgaaaagtaatgtttacttctactactagcgaatacgcccataattttcatgccgtgacagacataatgcttgacataatcgctgatgttcttggtgtaccttctcattctcttaacgtccagtgggtttgtgctttgttcgcatggaccgccctctatatccaacagcgactcactgtcagaatctgaaccacttgtgcctcccagagtttggctctccttcatgttcagagtggtagctgacgtgggacttgctgctgctgatcacagaaaattgaacaaatagtgagcaagaacaattaaagaactgagcattgtttgtgcctcatcattaaatgcaattttgatgcagtaacagcacttgtactgtactactgtccatgcatgtccattgctgaaatctccatgtgttgaaaactccaggttgcatgtgttttttcagtgtgcagtacagtagcaaatcattacatacatggatgagtgactgtttttggtgtgcaaactgcagtcttattaactgatgaaaattgtggaagaggacgtgtgttaggccataccacagattgatgattgcgactcaattgtgtagactgcaggatgccgtgcgttgaggctctgggactggggccatatgtgattgggaatgaccccagtgatggtgctctgcttgaaagaaaaacaaaagcataattaatcgagtaatcaatcatgcatatcaagaatcaagtacaatttaagataagcaaccaaagcttgtatgtatatgctgctacttataattagttgtcagtatgtactagtactaacaatcatcttcattacctaaataaattacttatcatcaattctcaataacaagtttttttttttcgaggatgttctcgataacaacttaatcaaccctgtcatgtaaactctcctgttaggctgttaacctgaaaaatgatttctcctcttcccttcccatgcttagaattcaggactccctcttatcatgctattcaaatattttttcgtgaaacatgaaacatcgtttgtttgaagtttgaagactaaaattgtgtgtggtgtgtgagcgtgtgtctcttctatatgatctaaaagaaacatccttcattttttttcctctctttttttttcttgttctctgctttcccgctgtatttactcccctccaacttaatacaatgatacgcaaaagcttatgcttattcgcgccaaaaaaaaaagagttttgaactagcaaaaaaaactggcaaacagtcttcaatttgaaaggtgttgcaggaggtgaacagtagcgattaaaaatttgcaggcaacaaattctagtcaagcataatatggaccgtgctactaccaatagaacaagaatcttagccgctctttaattaagtacacgaattaataatactccacccgttttgaaatgtttgacaccgttgactttttagcacattttgcccgttcgtcttattcaaaaacttctgtaatatataaaactataggcctacatgaaaaatatatttaaaaataaatcagataataggaaacgaattaataattacttaaatttattttttaaataaaacgaacggttaaacatgtgntaaaaagtcaacggcgtcaaacatttcgaaacggagggagcaagtagtactccactcttttaatcaagcacaagcatgatcaacaaaataatcactcaccgtcaccgagtccgcgaagccgaagctggagaggtcggcggcggagaacatggcgaacggcggcgggtgcgggccgccgccgggcttctggtcggcggcggcgtcggcgtcgtcctcccccctctcgccgtggaagaacgcctcgaagttcagctccgacgggcacttcttcatctcctcgtgtggcctctgctgctgctgctgattctttcagcggtggtgaactggtggtggtggcgtcggagtcggatgcttttagagatgccccagcgaggcagatcaccgagggaggagaaggagaagaaggagaagggaaagctcctctttttcgccccccacaaagctgagctgcccacccgtgcgcggctggagcggtgtcagtccggcgtggaaagaggctagagtatcatccttgcccctctttcccccgcatatttaccaccccctgccattgggggtccttctccacgtgtactccactcgcaagcggtacttgttaggaaggtacgctgtaggtggtctcttcctacctccccggcggccggctccggtgccggccgtcagatctccgatgccgcacacgacagggaggaggcggcggcagcacgaccactgccacatgaggaggaggaggaggatgatttggcggctgtgacgtgcggcaccgaccattgcaacgaggagagactgcgtgcaaccgtgcgaggaggtagcggaagcgtgctccgcgagggagccacgtggattctaagatttattgaatcataattcacatattcaacagagaaatattagtaaaattttacagattgctaatattttaaatctgcttcgcgattgctctagtgagcttcttcaacaactcgtgcggccttgttgaataacaacaaataacgagcaatcatgcctctgagattaataaaaaaggcagcagcagcaagcttccaggatcgatcaatcagttggcaagacagcgaacgacggcggcgtcctggttctgggcttggaaccttggcaatctccttccccacctctcctcctacctccaaatcctttgcttagcttctagagtcttttagccccttgtatccttccaccttccacctcaaaaccttccactattgtaatagaaatcagtggcttcttgtattggattcgcactgctacttctgagtttgctattgttccaagcgagataactgggatcctaacaatctggtatcagagccaccattcccccaccaaattccaccatgagtgaccaagagtgcttggaggccaatcataggctagaggagaagatcgatctgattttgaagaagttgaatgagatagaagctaacaggagcaagttcttcgaggagatgagcgcctccatcaaggcgaccactactgtcctcacggctgcatcacatcctccactccaggcaccaccttcttcgacgcccaccacctgtttgatgaagtgctccaacgacgatcgtccttgggcgacgtcgagctcaggccacatcgacaaggagactgctccgacagttgccctagaccttggggatggcgaggacaaggttcatgacccctgcatcgtcaccaaggactcatccaaggtcacgcccaccatgtgttcgatgaaatgctccagccccgatactaagcccgatctcaccatggttgcggaggttacctacgccagcgcagccactgcctctatggagttggtaactgctcaggaaaccattggtgccatgtacagcgacacctctgaccattccaaggtgatgcacaccaagtgtttgacggttgtcctcgatgccattggtgacaccggtcaagctatggttgtgttccagacctggacagatgcatttaaggacgatccaacctccgttcagttcatggactttttctcatcaagtatgatggctaacatcaagtggaacacaccaatgcccactaagtgttcggtacagtgccttgggcatggcagcatggcattgatgcctacaaacccttttgatgttaatccatggccacctcctactctagaaaaatatagaagtcaagcagttgtgcatatgttgttatttgagacactattcaatgaggagctaaggttggagagaattgaattgaagccatggccacctccaacctacgatggagtaattagtggatgggattcacagcctatggctggtccaaaattcaaactctattgggcaagagtacgtcgtttgccaccttggccgccacctatcgaagtaagttgtcttgcattggtgtgtcatgacaatgtaatgattttcactgagctgaaggatattaatttgcattggggtgagctgaaaccatggcccccaccaagtcaaacaaacttcaaaaatattatggttcagcccgagcaatgcaagtattggaaaattagagtagaaatgagtatatttgctaggaaggagaagtggaatttacttaatcagaaaagttgcacaatggttgcaatatctagcttgaaggagcatgtcaatgggcaagaacagatctggtgtagaccttggaatcctagtgactacaaggtctcccctgacataattatgttgattacttcgtccgtactgcacccctatcatttggaccatattgttagccttacatatcctgaaggtttggacactctagttagtcataaggtggttcagtttgggagggctgatactgcatgcagtcatcaaaatagacatacaattgttaggacaacagggacatttgttaggcctgagcttggtactgggaatggtacacacatattacttgtttcagaggcagaagctggatatgtgtccataaggaatttgcttgaactgacaaggaatgctaggcagtggcataattccatggttgagtatttgtcatggtttgtggatgcatggatggttgccaaacatgcaagtaattttggttggtatcttagttgggcttcccaaattaaaaatatggtgaagaatttgttgcgacaggcaaatagggccagcaattttgannnnnnnnnnnnnnnnnnnnnnnnnnnnnnnnnnnnnnnn

SEQ ID NO: 35708 - DNA, 21320 bp, Oryza sativa
  unsure (1)..(21320): unsure at all n locations
nnnnnnnnnnnnnnnnnnnnnnnnnnnnnnnnnnnnnnnnnnnnnnnnnnnnnnnnnnnnnnnntgagtatttgtcatggtttgtggatgcatggatggttgccaaacatgcaagtaattttggttggtatcttagttgggcttcccaaattaaaaatatggtgaagaatttgttgcgacaggcaaatagggccagcaattttgacacttctatacttgagatgaacacacatgttcagaaacattcagcttatactcaagtgcatagcagagctgaggtagttactgttaaacctgaaacaaaggagctattgaacgctgaactctagtcctttgctatgcttgtcagcaacaagattgaggacaatgattttgtattgctgcttctgaaacatctcacttccttaagattgatagctaagattgcattgatcatgccatgggatctagctgaaagcgaaggacaaatttataaagcttttgggacagtacaagtgtgcaatataaatcaagagtggagctttgcaagttcaaaagtttatttgatatcgacttgcggacaagtcgaatttcaaggagaggggattgttaggatccgtgggctgtacgtgggccaattcagctgctacgcttacaaaggcccaatcatgtctatgagattaatacaaaaaaggcagcagcaacaagcttccaagatcgatcaatcagttggcaagacggcgaacggcgacagcgtcctggttctgggcttggaaccttggcgatctccttccccacctgcagctcctcctacctccaaatcctttgcttagcttctagagtcttttagccccttgtatccttccaccttctacctcaaaaccttccactattgtaatagaaatcagtggcttcttatattggattcgcactgctacttctgagtttgctattgttccaagcgagagaactgggatcctaacataatcttgaccatttagagtcctaggttagggtcataatgacaagagggtcagaaaagggggaagatagagggggggggggagtcgttggttctattgggatgactgtgggtgttggaggactgacggtgggatgcaccatcggcgccgtggggacggaggagaacgatgggtcagcgtcggtggtaagggctaaacaaagcagttggtttggagctaggtggtgacagattatgcggtggagtacttaatggagacgtgaattaggggagggggggaggggctcgccggtgttgtttgtgccttctgcccaccaatgatgcttggtggcggcatcagtgctcgaggaagtgtgcgggggcaagctcgcgtcacacttgtgctgcgtgcggctagggaagaaggagaatgggaggaaaatgataagatcatattgttacgtacgaatcttaaagcatatagttgtccaaaatacgaaagacatgagctacgattttatgtcataagatatactcatctctagctcattcagtagtatagattaatgccctccgtttcacaatgtaagactttttaacattgcccatatttatatatatgctaatgaatctagacattattatatatatagatttattagcatctatatgaatgtagataatgctaaaaagttttacactgtgaaacagaggaaagtacaattttaagctgatgatgcgttcttaattagaaaaccactagttgactagttgtaacgaggctatatataggaattgaagatggattctcgtgcagaccagatttcggcccatccacgtccaatgttaggtggtaaaagttcaattttcgtccttcaactctatatcgagttttattcgtgtcccttgtctaaaaaaaatctaccttactgagtggtttcgataatagttttatcacatatgatacagtataggtttaactggacccaggtatatgtgaaatcctccctttcttctacacctttgaatgacgcgagtgacagcaaagtgtatggatgtgacgatagtgctaccatatattgcatcctgtgtcgccattatcacacacgaacgataactatatattgcatcctgtgtcgccattatcacacacgaaccagaacgcaagtgtgacaagggctccatggtctccgtcccatgctttgccttattctatgtcctcgtcttgacactagacaaccttatcgacgagattgaccgcttggagggcctcttctcttcgcctcatcgaacaattcctctgtttgcacatttttaccacaatcagccacccagttccctgatcccctcacctattctcattgaaaataaaactaaacaaaactgacatattacatattatattcaaaacatttaatgggtagcatcaaaattccaacaaaaatatgaattattggattagtaagagcaagtctaataatacagccaattgccggtgacagtagtatccaggtcatcaaaaaccttcataagagccgtcaaatacaataacagtataataggatggtccaccatattatctaagagaataattaactctgacaaaagcacaccaaaccttctctctctaccttgtctccgtcgcgccagccaccacacaccatccatttatttctgatatcttttgtgtactctcccatcttcttccttgtttttttatgaacacaagcagcaggccaagcttgctcttgagcttatcgtgggccgtctcccgagtccttacacgtggatgctgtgtcagcccgcggcaccacctatcgccgccatggtggcatgtcctcgagctcctctagtcatcttcatgacaaccttgagcttcacgggtaagctaagaagcggtcgcaagtgagtccgcccgctggaggtctggagcaagctaagcaatggtgtgacggtagcgagcaagcaaggagatgacgacgatcccgcgacaatctttagctccttctctcctcatcaacgccttcatatgggaagttgtgctgtagtcgggtgataggatagtcgccggctcacattctctctcactccctctcccttccaacccatcaccacattcgacgtggtctccttttcgccagtccacggtgtcttattatacctgctctaatatttgataaggtaatgatgtgatttaaaaaaaaaacaaaattcagttgcaaatgcacaggcattcgtagaccaatcctaccacgccgaccaaacaccaccttccccgccactagcttatcctcctcgtcttcccttccatcccccaacccaacccaccaccgcctcgccgcggtcgccggcgagaggcgccgcgctgcgcgcgtcgagaggatcgcctcctcctcctcctcctcctccggcagccatgtcctccatccacttcttcccggccacctcccaggccgccgccccgtcgcgccgccccctcaccaaaccctccccaaaaccccccgccgccaccgccgcgtaccaccgcggcggagacaacgagccggtgctcttcccgcgcctcttcctcaggaggcgtgcccggccccgcccggcgcccgccgaggcgcccccggtggcccccgacggcagcagcagcggcggcgggggaggaggaggggagggngggcggggcggaggggaccacnaggaggatgaggggacgaggaaggggcttgtgccggagtggctcaacgtcacgaacgacgacgccaagacggtgctggccgccatcgccatctcgctcgctttccgcttctttgtcgccgagccgcgcttcatcccctcgctctccatggttttccccccccccccaccttcgacgtcggcgaccgcattgtcgccgagaaggtccgtctgctcttccttgacttctttcctttttgtttttgtcaacagaggattcagattttacttaaatgtgctgattactgagttccgggtgcacacatttgcctaatgtttctgataaaatgtgtgccttttgaatttcgacttgggtaagtaatcaatacagcacaatcgtagaaatttgttcacgtacttgttacttgttggtttgcttcctggttgcgtagcatatgatgatcactgccaaattttgtttagacgataacctggtataagcattggtaaaacaaaatccccaacatactagaattccgcattgacatcagcaaataggcatatggacacatgacacatgttcacattatcatgctcacctctgcaggcaatggctgatcttttgcatattgttttgtccagccatcagtcaaacagtcatatatagcttgagttagctataaaaattatgaatgagctgttttaaatgggtttcacagcacttctaagtgtaacagggaagcaggcgtagacagtccgattgttggttaacattttaggacatattttttttttcatttttgtgttaaattataagaaatgatcatcgtctagttagatagcatgccttaatatgttctatgcctcctgttggcagtaaaaagttctgaaatgaggctatttattttgtaaaaaactgccttcacaagacttgttcataatctcaatagactttgatcatattggggatatttggagtaatatacgataacctacataagtatagaaaacaatgacaatattccacataaaaaagagagcatgacaatatgcaccctttgaattgcattaatctttctacataatccttagtccaaagtatgtgcttgttgtcattaacagaactagcacggtggcccgcgcagattgcgcggctagcatcactatattttctctcatataatagcatatatgttttctcattatattatttaaatatattaaaatgacaacataattttaaattttgcagtaactttacaaaactaataatgtgtaatattcatattgtattttatatacgtgttagttattaattatttttaatatcaaattttagttatttgtaaattatatatattcctatatggactctagacttgtcttttaatatttcttttttttttaattctgaattttctgtaaattgtatttctatatagactctatgctcttcttccaatattatttattttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcgaattttagttatttgtaaattgtatttttatacggactctaaactctacttttaattttattatgtttatttcaaattttagtttgttttaaattcctatatggactctatactctacttctaatattccttaattttaattccgaatttcagttatttcctaattgtatttttatatggactctatactctacttttaatattccttaattttaattcggaatttcagttatttcctaattgtatttttatatggactctatactctacttttaatattccttatttttaattccgaattttagttatttcctaattgtatttctatatggactctagtctcctcttctaatatttcttattttttaattcctttcaactatttctaaattgtatttataaatggactctagtctcctcttctaatattccttatttttttaatttcgaatttcagctatttctaaattgtatttctatatggactctgccttttctttttctccgattaatgtgagaatttctaggccatgagagcgagtgtggaggctcctttttctattcctttaataatataatagatgtcacaattctctcaaacagttcctagtacatcttgggcacagggtttgacctatcggaacactgatttgtatcgggggtcaccgaagttctgaaatttcggaaatattgcggaaattttggacgatttttttttaaaaaaatgaattcaaatttaaaaattgtgggcgaaatttccaaaaaaagaacaaaaacagatagcaacactcgctctgtttggcagccatacaagcagcagcagctgcatcacaaatttgcggcaattcttaactactgcagctgtggcaaccaagctggaaaaataccaagctgaaaatgcacaaggaaatataccaatctcgtcctagaaccaataagcccaaccattcttccatcaacttctagaatatgagatgcacatgaacagaactagctggttgttgaagaatatactgagaacaaacaaatgtgaagaagagggataaccaagctggttgttgagcaccatcaccttcaccggcaggttctcgacgtggatcatggcgagcnnnnnnnnnnnnnnnnnnnnnnnnnnnnnnnnntcgatgtcgaccaccgcggcaccggcggcggccggcaggccgaagcccattgcgcctagcctggcggatgagagccactgcctgggtctcctgtaggtctagtactatgtcgcccacatctggtgctgcccgacgcccggctggagcggctgcaggcgacggctaggggcgccggtggtgggctgcgtcggggcggcgaggcggcgaccggcgtcgaggcggcgcctggcgacttggcgagatggtgatttttttcgatctgggtgtggtgtggcgcaatgaggggaggcggagggggggagagaacggcgatttagggttaggggagaaaatcgcgtcaaattttttttggccgaaatatttgaccagagctcacttacaatcgggacccaccgaaacgcccgaaatttccgaaatttcggttccaaaatttccaacgccgcttcggcataatactgctttgttttatccaactaccttttctagttgtgatgattgattagtccattattaatattttaactacgatgaatcaggataccaaattcattgtggttgttgcttattttcatttgctgaattccaacctttagtgtctttataagttccaaaatttgtttaaatttgcaagatggtatgatggaccactattaaaggtcacctgcatgggtgtataacttcaccctatatattgttattcatgttgagtttgtttatatttctgtcaaaagatgtctttttatatcttactaagcaatgtattcacatcatatcataaatttaccatatgaatgcttttcaggttacatactactttagaaagccatgtataaatgacatagtaatcttcaaaagtccaccagtgctgcaggtacttgcatattagctaaaagtgtggtgttttgggaatttggatgatgtttgctgtttttcttgatatcactgtgaatgtttctgttcaggaggtcggttatactgacaatgatgttttcatcaaacgaattgttgccagggagggagatgttgttgaggttgctttcaaactgagaaacttctttttcatgtgtataactatatcttgtaatcttcacttaattagtttctttttctgtctatgaattccttcctgcagtctttgtgtgtgttaatttcaacaccatgaaattctttgaaattttttaggtagtccaaggagtgtactaaaattgggaaacgtttactccatactgtttaagcattggagaaatcattatgtctattatgtgatcacaaaatagatttgtgatctttccatcttcctgtgctcactttgtgccatgagctgcttcatggtctcttccacatggcatgatactccacgtcagctgcaccaggctcaaaggcaaggcccgctatggcaactcctcagccacatggcagttctactttggggatggtggcgtcagtcttgcaggaacggcattgatgtttgagatgctgagtgtggatgtgaatgctggaacagtctcactcccacttgcagtggctagggcggtgatgctgtcactgatgatgagtcttgatatcttgttcttgtatgttagcctacaatgagtctgaggtcttatattcttctatgttagcctcctcgctgccactttctgccctcttctcctgcattgttgttcttcagcactgttcttccagatcagttgttttgagctagaatttgcgacaggatgacatgtctcatggaactttagtacttgtgaagtataacataagcaatagaaaaatccttaccctatgaattgtttggagtgacctacttactgtgctcaagtattaatttaggttctttctttctttctttcttttgaaacactgtgacatcctcaaacaacaaaatacttaattttcttttcatcttattgcaggttcataaaggaaaactagttgtcaatggtgaagttagaaatgaagagttcattcttgagccaccttcttatgacatgaacccagtggtaagatattactgagccacccatgaatgatacatgagctcaataatgtaacaaccaaccaaatatagtttgaaccacattccccagttaaggctgatgagcaataagaggattaagaaaacacaaatggtttattagttttgattcactgacactacatatgtggatgtgtcagtggaatgaatggagacatttgaagaaacaatcttgattagatcccttactgttactgatttttaaatactttatctgcattaataatcagacgtatatcatgacgaattacatataaaaacttgcattttgcgtgtggtatacctccaagtaagctgaagacataaaatttctatagaatctattgaatagtgctcactagccacacctaggtggatatagatatggttaccactatttatagatacattattgtgtatggtttcttgtgttgtgtgctgtgtgcatattctgtacatatgcatgaacatgaagttgtcaacaacacttcatacttgatttatgtttcaatccttgtagaagaaaaatgaacatgattcttttctgggttatatttttgtgtttgttgatactatgtttttcatgacagcaagtacctgagaactcagtttttgtaatgggagataaccgaaacaacagttatgattcacatgtgtggtaatactctctgctgattttcccatgttacttactattaacttgttttgtatcttaattgaattggcctgtacaatactgctattattttcctcaggggccctcttccttctaagaacatattggggagatccattttccggtattggcctcctggccgaatagggagcactactactgattgcctcatccctgagacaaatccaagctcgcttattgatgtcaaactggcaaagtagaagttcaggcattgattattgcagtgtgaagtttgcgcttcatgtaagctcctattctttaatattccctctctcctggaaattcggaggaatatttgacagcaggccacgtagaaattagaaaggagaacacatttggttctccttgatgtcacaaagaatgctagcaactagcatgagcatagaaaccattttgtttcaaggtttctgcgactctcgctctttgttgtatattaagactgtaaggatgttgccttagtgattcgcatcaaatgattcttcttgtacatcacgttttgtagcaccacgtgtgtatcatcctcatacagtgcttgacaaaagatgtgtaacgcgttgagccggcagttcacttcattgccttacatgttgctaatgctgacagattcttcagaattcaagttactgccatccttttggtctgtatgaacaattgctcccccgtgtcggtgtactcatggatggcatataaatatttaggtttaaagaagtggattgaaaaatatatattggttatcaacaatacaatttcccaaactatatatgatgattctatgagcagggatcctgcatatttttcagacgggagaaatctgaaatctgtgcaacctatatatatatcaatccatccacgcggcacgtcccttcaatatcaacacggtggcgtgcacaatacacagtcgcacagaagaataacaaacaaattggtgggtgttagtttccctctactgactgaaatcgcttgcttgctttagtttagtcgcgttggcatggaagtaaaacccatatttagtcagattagattccctcctcacgcagcaattggcaaatgcttggttggttcgcaaacgcactactaagagtgaataaacagtcactgcaacatggcccagcagcaaattaagcaggataaggccatcatttcgatccaaaccggccaaccaagcaagaaaaccagcaacacgtctcgatgtcatcacatgtacatgatctccagcgatatagagcgcgcgcggcgacgagtcacgactgcaatttgcgacgcaagaaacctcctccctttagatcgcggcaacacatacgttatctctgacaaacaaccgtgaaaagaataatggccgtttcggtagatcgatctccaattgacgatcgaattgggaagaagcacctctaaccttactgctccctctgatgtggtgttcactgatatatagactcacaagctatggaaccgatatgccaaccactcaaaaacagagaaaagtaaattagagattcatgagctgtgaaaaataattaagggccgttttctagctgtcctattcatggatatgatcaattggtaagtgcctgcaggcacctagccagagactatcccgccgtattatttcgaccaaattctccaagcaaacatgggaagatagatacgtactcctacgcgtgtgccgtggccgtacgtacgtgtgcctgcatcttcaccgcaagtcatgcacatgcgcatgtgcttcatcctagcctacgttgctgttcccgctcgccacacactttcgcctttctgacttacacgcgcgtatatatacacgcagcacgtctgcaccggccgtttcaccattcctcgaacaccatcatccacaaacacacaagtacatctcgatcgaagctagctagactagagcacgcacacgtacgatctcgtccatggcgggcgtcgctcgcatgctcgcggccgtggtctgcgcgatcatgccggcggcggcgatggcggccggcggcgtgggcgcgctggagccgagcgggtgggtgagggcgcacgcgacgttctacggcggcgcggacgcgtcgggaaccatgggcggggcgtgcgggtacggcaacctgtacgcgcaggggtacggcacgaggacggcggcgctcagcacggcgctgttcaacgacggcctcgcctgcgggcagtgctacaagctcgtctgcgaccgcaagacggaccggacgtggtgcaagccgggcgtctccgtcaccatcaccgccaccaacttctgcccgcccaactgggacctccccagcgacagcggcggctggtgcaacccgccgcgcccccacttcgacatggcccagcccgcctgggagaagatcggcatctaccgcggcggcatcatccccgtcatctaccaaaggtaaacaacacaatcacatatgtctagtggtcgttgcagtgacctgaatagcactctaaggttctaagttcagatcttcataggagtgaatttcagattatgttgtttgagggactgagtttccgattcaagacgatttgagaggctggataaaaaataccattctctaaaaaaaaattatcaccttcgacatcgcaacatcgatcaagcattgatgattgattctactgggtggcggagtcaaaaaaaaaaacattcacatataaggctgagctaatgaaagttcaaatattttcacaaccacatagtattttttaagattataatgagagctatggatctaggcattaggctcgagtcctggctgccccatgcctgatgcggcctcaaatttgtactaccaccgtaaaaatcactttatttttgatgtttttgtgtagggttccttgcatgaagaagggcggggtgcggttcaccatcaacgggcacgactacttccagctggtgctgctgaccaacgtcggggcggccggctcgatcaaggccatggacgtgaagggctccaagtcgccggactggatggccatggcgcacaactggggcgcccagtggcactcgctggcctacctcaccggccagggcctctccttccgggtcaccatcaccgatggccagacgctcgtcttccccaacgtcgttcgccccggatggaggttcggccaaacgttcgcgagcaacatacagttcaagtgagccacctgatcgatcgaagcttctatataggcgcagctagcatcgtcgtgcatatgcgtgaaggatttaatttggcgtccaaactttatatatacttcttttccaaaatgatcgatcactctctcaatttggatgctgatgggggttgatttactatggtattgtgtaattaattaccagcctgaaaccaacattttcattgggcttttgtatgtatgtgcgatgtacataaagagttcgatctaaatgattcttatggaagtatgattatcacgcgatttgagtaaactccaaatttggtgtttagttgagtagaccataagttggattcccttgaggagataattacaaggttcttaattagtgtgttaaatttgtaacaccttctggtatatagctattttggttcaaaatccgtaaaaagatctcagataataaaattgtcgaacgatcaacttgttggaaagtttttgtaggcagtggcgagttacattggggtccagtagatcgtgtatagtagttgtgcttgcttgttaatactacctccgtctaaaaaaataaataaatcaaatttaacttacgaatatggactgatgcttattgagattcacagcgaaagaaatcaattttaacttatggatatgttacaaccgtgcgcgtaagtaaggtcgatctacacgcgatgactatactttgtttaagatattcgcaacgggaaatataatcttgaagctagctaccttgtgcgaaagattattagtcaaaacggtgaagtacatttgtgggtttccagcgtcaatgcacctagctagaggcagctatatgtatatagcttgaacagtaagcgttagactctgcagctaattcaagcaatggcgttgagaattcgttccccacaacatccctcacatgcatatgaagctactacgtacttgggatttcgtactaacggttcagttttctctcgttgaccttcctggcgtacaaaatttgtcctcgctttgcgtcaatataatccgcctcgacgaatgcaagacgagaagcccacgtccgtgcgcgctgtcagcccagcccaatttgccttatcccttttcctcttcttgccggcccagtccacttcctcttccgttgaaaaacgagatttgaaggaagagacgtctctctattgtgttgaggattgaacatgggactttagtattactactacactataaagtgtatctggcttcgtcttccatttgtcttatcgcgataaccgaattgagctagatcgagcgtaggcgatcgaggtgcccggttccggcaaacgatcaagcttggggaccaacatgatggatgggagttgggtaacgagaagactcgctgtcgccgatactgaaacccgctacggcggcgccaccgtgcgtcgtcgacttggctaattgcaacatccacaagaagcaacctgtcacaacaagtactacaagtctctacctgatgagcccggcaaggtgcaccgctgcagctacctcctggtgctccgcgcgcgcggcgagctgctgctgtccagcgtcctacaagctacaggacgccggctgcaccggccacgagcgcccctctcggtgtcggtgcacgtacgctttccattgcgacacagccttgcacgcgctcgatcacgatccggacgacgacgaggcgccgccgccgagcatgcatgggagagaggagagacgacatgctcggtgaccacgtcctcttcctgggttacccgtgcagcttctaactaaacgttaggcaataaacgataaaagaataatagatcaatcataaaagacacaagatttaacgtggaaaacccttccaaagcaggagagaaaaaaccacgagcgccagccaacaaaatatcttcactatatcggggtgagattacaacaccgaacgacggcttaaaagaggtatatatatgatggtggaaccctaaaagggatgacgatccgcttcgctctggctcaagcctccggcgacaggcctccgctgcgctccagcagaagctagcctttattatgtgtaaatgaatttggaccacaactcaacagcttcgccgcggacgccgtgcggtttggctgggacgcgcgcccaacggcagcgttgacttcgttgttaggtcggagttagtgtaggaagaaatagaaggggtttaaataaactagataaactacttccccttcccatttacatatagtaaaagattttagtaggggcttcatgagagctctcatggtcctcgccccagtattagaggctcgagaccctgccacattcatgctagatccgcccttgggtcagaccgtcggagccttgccgtgtgtataggtacaacttcacgtggatgcatggcggcagtggcggcacgtgacactggtggacatgctgcccgccgaatggaacgacaagagatgcacgtggttctttgctgagcccgacattaatgcgaagaagaagaagaagaagaagaagaagaagaagaagaagaagaagaagctccagcaagccggcaacgccgagacctgtggatctacgttgtcgatctatccccgaaggtggatacgaaaagcacaaaataaatttcctaagaggctaggactaccttaggcaactctcgcaatttcctaagactaaccacaaaataaattacttttaattgaaaaaccatatcatatcatttgtgtgtagcactagcaacttttgttcgaatggtcagaccgttgctgacgttttatataaaaaaaagggtatcctattttaaggagaaaacgagaccaaactttacaatgcatagttgggaaaaagtgaaattaaaccacaactacaacaaactctccaactacgacggcaacaaaaagggacagccaaacacaacactcaacaaacgttgctcaacatgtgaacaacaaggggccaatcaacaagctagaacaaaacaaaactcctacactggtcggcgtcagatgcggccctagaagtgaaggcatgttggatctggggcatccacaccttggtccggcaactcaccggctcggctggtgatgatggcggctccatttattggaggatgtcgacaactgtggtgcaagaaagtaggccacctccatacgctgtgatgggctagggcggctccaaacacacctgcgagcgagcgcaaccgatagtgggattgctctaacatttgtagctcggtgaagaccaaggtgaaaacttgaacgatgatgcctgtgggcgtcgtttctttcttggaagcattttatgtgtctccccgtccagttgtgttttgattctctgggttaaaatctagcacaattcttgaatcggcgatgaagacgcattctggcatcatgtccttcttgaagtcatcatggaaagaaatccatggtagtccctagttttaccttgcattgcatgaagaatggcatttgggaagtctgagctgcaatgttgaggcattcgacgagcttggcaacgatgactcgaagctttgcttggtttcattcagggtttgtctgttgtcctttgggaagtcagtgctgctgcgcgattgcaagcttggcaacaatgacccacatcagaccacgtcagtcgtgtttcgctcttgtgtggggtagcaagcttttcagtttgcatggcttgtcggtcttgctcacccgtgcacaagcaagactggtgatcgtgaagtcggagctacgacatcgacgaggtgcgacgtgtgacaacgatgacatgagtccttttgagttatgcttcggcatgggtcgaggcgttgtcctgacttgttcttgacgaaggtgttggagtcacctgatcacgtgggtgatggtgtaatgacgagcactagcagcttaaacctgccatacttgagccacacacatgtgacatatggtattcgtaccccatcacagaccaagtcatttgtgaagggcaataaaacacaataggtgagtcatgtgaggttggaatttccacccggttgatcataggggttaactcttagggaccctgtttagatgggactaaaacttttaagtccctatcacatcggatgtttggacactaattataaatattaaacgtaaactattaataaaacccatctataatcttggactaattcgtgagacgaatctattgagcctaattaatccatgattagtctatgtgatgctacagtaaacattctctaattatggtttaattaggcttaaaaaatctatctcgcgaattagttttcatttatgtaattagttttggaagtagtctatatttaatactctaaattagtgtttaaatacagagactaaagttaagtccctagatcaaaacaccacctcataaattcttgcggaatgtgacattggatctataaattttctttttaacataaaaaatttcactatgatttgtgataggtattttatacggaccatcattgtcatatatcactgatgggtctcacctctattacgattactaggatcctaccatcacactccctccgtttaaaaaaaggcaaactctggctgtgtagatatgatgcatgtccagatacatagttagagtatactttttttttttttgacagagagagtacaattgtcgtagtgcctattaaagccttagagggtaataaatagcgtttttcgcatcgagcaggcccatgcatgatgcttgtagagtcgtagttgagtctgagcccgactttgcgatgaggctggccatgtgcacccatatcacccggttctccctaatcagatttatcgattacgagtttattatagactagaaaaagtgcccatgcgttgcaaagggaagaaaattaaggaaaatctccttggcggatccgaccgtttggagcagagggacgcaagctgccgtctgtctcgaaggcccgtccatctcgaaggtggagcaaggagagcggagccgataggtggcactaaagatgacatatgtttttatgatctcgggtgtgttaggtcttggatacgactcatatgttccgcttgttattgtgctcttttttgaggatttttgttctgtcacaccctcattttcgtttaagggatttgtaaattatttctaaaatttatattaaatttcattaatttacaagtgaagtttaatgtgagaaataaaatttcctaattaaaacatgtctatatttaatcatttttaaattatatatccatgattaattatactcttaggaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaatgaccacgcagccgaccctccgaaaggactctagaactactgagaccgaagagagcgcagagtcaaacatcctagagttacgttccttccacagctgccaagagaccaggaggaccagggggtcgaagctggcacggaggtgatcaggtaaacaagccctagaagatggctaccagtcctggagccagctgccacggggttgggggggggggagagcaatccacccaagaggtgacagcacccgtaactagactcgacgagcgaacacgcagtcgaggaggatgtggtttgccgtctcaagctcttgagcgcaaaaggggcaagccgagtggctattgatgccacgcttctagaggagatcagccgttcaacagcactgctgaaatgcaaaccagaggaagaatttgtatttagtagggcccttcacgtgccagagaagattgacacaagcaaagaagtgctggccaaggaagaatgcctggtacaccgaacgcgccgagtagtgctggtcactcgtccaacaccagacaagacgattcccgacacccgacgaaagctgaatgtgaagcaccatgtcccagacaagaagaaactaggagatgaccgggacagtgagggcgctgtggatgtcaaaaatccaagtgttgttcgccaggccagaagcaactgtgcacgaaccacacggccactgatctggagctaaggaggcaaccgagcggccattgatccagtgggcagaccagaaaagaatcgactcaccatcaccctgcacgaagaaggtggatgcctgaaacatgtcagaaacggcttgcttggctggggcctttaggccgtcctagtaaggatgccctgagcgctggagccaaagccaacaaactcgcagggcaaaccctaccaacctgaggtcagcaattcctaacccaccgaaagctttgggatgatagacattcgttctagacactcggcactgcccaccatgaaccgagtccgtgcccgtccacaagaaggtgcaacgcttcttgtcaatggccttgatcacccaggttggaagaccgatcgccatggacacatggactggtaaggaggagagaacagactggaccagcacagagcggccagccagagtggcgagtcgtcccttccagggtggaagacgatgggaaactttatccacaagcggttgcagggttgccttcggcaacttgtgaacggacagcggaatgctgaaataggagcagggaaaaaccgaatcttgtgtggaagaatgaagagtcgtgcattaaatcctcataaacaagcgattcattgatatttacatttctcgatgcgcatgtagccaatcttgtgtggaagaatggagagtcacgtattaaatccgagaaagtcattaatatgatacgtggttggattgaaatatgtctatcaaaagtaaattttttagatttggaaatatgcctatcaaaaatagatggaagggagtattaatgattaaatggtctagataaatattttgttaaatactttgagtgtccaattattttcatgttttttttgaaattatttaagcattggaagtgtttttgaaaattcaaagatcatttcagtgattaacattgacgacgggtgaggagacgcgatggcgcatgtcgaaaagagctacgtccacgtacgctagctctctggagaatcgagggtccagagtcggactgcttgcacgtatccatgccccagccgcaagcaatataatcggacaaatactactacgtctctatctctatttctactattaagatgtttttactggtggtttagtaagtcatccgtatccgaatctaattgccatatgctatcttcgattcaaaaactactgacgtgatccgtgggaagcagtgccatgtccacgtccgattcccacgtacatcgccatcgaatccaaatatgctcccgttgcctttttttttttcttaagcatgtccaaagcaccccctccgattcggttttaccattgccacgagcccacgatcaagcgagatggacttggctctgtactccgtatagattggagagatgtgcgcctggttagattggaaggaaataccgatggtgatggcctgcatgtgcatggctgcatagttgcttttttgcctaatctataactaatataaatattcgtattttttcgtttgtcacatctaattttcgtccgtgttttcgtccatacacaatccgattcggttagcaatagccacggaaaaaaactacaaaaaaaatcggtcgtcgccgaaccgccgtcgccgccgcagggacgcctagccgccggcggatcccctcctgctggatccggcggagggaagagcgccgccgctgctaggacgccgacgggccaccgccgcctcccctcccgctcgatccgccgccggtggtgggggagggcgccaccgccgctgccggtggtggggaagggcgccgccaccgctcgtgggaggaggggcgccgtcgccgctgctcggggggaagggcgccgccgccaccgccactcggggaaaggtcgagagagagggagagagcatcgggagcgcggaggggagggtggcgaaaagagagaagggagggaaggaaatgggctagggttttttcggcggctgaggagagggaggggggtttgattccccgatctcgacgctcggctgtccgatcaaaaccctagagatcggacggccggcgtcggccgggctgaaattggccctgagggatcgagagcgaggccacttttctggcccaagcctaggttgcggcctggagaggggaagtgcgcccgcgtgtttgcaaaagccatgggccgactagcaagggctggaaagaagtctattttaggtccctcgggccgaagaaaaagagaagttcattttagtacttttttttccagaagcatttacgattatagttattgaatgtgtttatttctgagcaaacctaaaaggaaggattttctttctttttccaattaaataattgttaaataatatttgtattattaaaattagcaattaagctctgaaaattccaaagagcgtaactaattctagagaatttaataaaattaaatttaactatgtcattttatttctcaacttgctttacttgtaaatttatttaattatacacttacctaattaacaataccaaatatttcagcgaatttgtagtttaattaattgcatatttttttatctgtacgcttcccgttgcaacgcacgggcacttttgctagtccctcataaagtataatttatactactaggatactacagggaaacggttttaacagctcgtggatgtccactagtttattgcatatcatttaaatagttatgaaaaaaattaaaaaaatatgaataagatagatcaatannnnnnnnnnnnnnnnnnnnnnnnnnnnnnnnnnnnnnn

SEQ ID NO: 35709 - DNA, 1136 bp, Oryza sativa
aacagactggaccagcacagagcggccagccagagtggcgagtcgtcccttccagggtggaagacgatgggaaactttatccacaagcggttgcagggttgccttcggcaacttgtgaacggacagcggaatgctgaaataggagcagggaaaaaccgaatcttgtgtggaagaatgaagagtcgtgcattaaatcctcataaacaagcgattcattgatatttacatttctcgatgcgcatgtagccaatcttgtgtggaagaatggagagtcacgtattaaatccgagaaagtcattaatatgatacgtggttggattgaaatatgtctatcaaaagtaaattttttagatttggaaatatgcctatcaaaaatagatggaagggagtattaatgattaaatggtctagataaatattttgttaaatactttgagtgtccaattattttcatgttttttttgaaattatttaagcattggaagtgtttttgaaaattcaaagatcatttcagtgattaacattgacgacgggtgaggagacgcgatggcgcatgtcgaaaagagctacgtccacgtacgctagctctctggagaatcgagggtccagagtcggactgcttgcacgtatccatgccccagccgcaagcaatataatcggacaaatactactacgtctctatctctatttctactattaagatgtttttactggtggtttagtaagtcatccgtatccgaatctaattgccatatgctatcttcgattcaaaaactactgacgtgatccgtgggaagcagtgccatgtccacgtccgattcccacgtacatcgccatcgaatccaaatatgctcccgttgcctttttttttttcttaagcatgtccaaagcaccccctccgattcggttttaccattgccacgagcccacgatcaagcgagatggacttggctctgtactccgtagagattggagagatgtgcgcctggttagattggaaggaaataccgatggtgatggcctgcatgtgcatggctgcatagttgcttttttgcctaatctataactaatataaatattcgtattttttcgtttgtcacatctaattttcgtccgtgttttcgtccatacacaat

SEQ ID NO: 35710 - DNA, 2028 bp, Oryza sativa
  unsure (1)..(2028): unsure at all n locations
caaatataataatatttataatattaaattagtttcatcaaatcaataattgaatatattttcataatattttttcttgggttgaaaatgttactactttttctataaacttgatcaaatttatcaaagtcaaaatgttaacctgaaacggagggaatagtataaaaggacatgtttactgaccctgtgtcaagcactcttgttacagaatttcggtaaagagaataatatagtgtgccttcctccaaattttattttacggattttatgtccaaagttagcaattccgttacatatagtctgtaacgctccgcttttcgtgaggcgttaaaaactaattcggcaaaatcctaattgcgaaaattttcgttctttgtgtgcgagtctaagttgtgccaatatctcaattcaaatcccgttgttccctctcatcgaaatcgaaatcctccacctcaaatttccaatcccgattcaagtcaccgagatcaaatcccgaaattcaattcctctctttgaattctcgccaaatacttgtaccgactcgaaagatatccaaattccattcccaatccaaattctctccaactcaaattctaagcaaaagtctaatttgcatccctcgggttcgtgggccgaatcccctccctaggcccatctctcccctctgcccttctctctcacgtgcgctgcacgtggtcactcagcagagctgagggaggaagagagctcccgcctctctgccttttctccccctctccgttcactctctctctccccggcgccgattcccgccgacgccgctcaaatccgcaccgccttcgctcgttcctgcgcgctcgcgcgtggctgaccgcccggttgccgccgcgtcagccctgacgccgcctgtccccgcgcctgcgccgcgcagccgcccggccccgctcgcctttagccgtcatcgccgctgtcatcgctcggccccgatgcccccatgccgcatccttccaaaaccaagagacagagctcgtgctcctctccctcgttctctctccctccttcctccttcctcccaaagtggcaagggagccaagctcttttcccttcccttttcgcctttttccccgaccacacccgctgtcaccacctgccgctccttgaccgcaagcgccgcgccagccgagnnnnnnnnnnnnnnnnnnnnnnnnnnnnnnnnnnnnnnnnaatagtcaatttaataaacaatcatctcatcaatattcctgactcaatgattagtgaatagcagtttaattataagtagaaatgatacataggtttgaatgtgacatatataatctatctatttgacggagcttggggctcctcaccgggagaccgcgcaggcctccctttgccggttcggccgggggccctgggtgaggttctaagctcctagcctgtggaaagttcgcgagagtggaaacacacaagacacgggcgatgtatataggttcgggccgctgagaagcgtaataccctactcctgtgttttggtggatctgtgtatgaagaagctacaaagtgcgagccagcccccgatcgttctgggatcgtttttttccttctaagtgggcaaggtcctccttttatatctcaaggggataccacatgcaccatctctccctttctttcttttgtgtggggactcatcctctcttccctccaacttcacttctcttcattaatggacggagatttgtatggctgccgtccgaatgaccttctcatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcat

SEQ ID NO: 35711 - DNA, 1290 bp, Oryza sativa
tcggtgacttgaatcgggattggaaatttgaggtggaggatttcgatttcgatgagagggaacaacgggatttgaattgagatattggcacaacttagactcgcacacaaagaacgaaaattttcgcaattaggattttgccgaattagtttttaacgcctcacgaaaagcggagcgttacagactatatgtaacggaattgctaactttggacataaaatccgtaaaataaaatttggaggaaggcacactatattattctctttaccgaaattctgtaacaagagtgcttgacacagggtcagtaaacatgtccttttatactattccctccgtttcaggttaacattttgactttgataaatttgatcaagtttatagaaaaagtagtaacattttcaacccaagaaaaaatattatgaaaatatattcaattattgatttgatgaaactaatttaatattataaatattattatatttgtctataaattttattaaatttgaaacagtttgactttgaccagtcaaagtcttataaactgaaatggatagagtactactctaatcggtgtctaagcaaaagagtggcacctacgggcacggccatggctgtgcaatattgtgatgtccaagatcgtttgattaaccaggaatattcgtcttaatttagctactcttcatatctgccttaatgatgagtcaactctaaaaattagtttccatccaattaaccactacacgccgttggtcgagcgcgattgatgttgctggccaggtgcagtatcacctgtaagtttcaaggaacagatgacatcgtttcttagacaagggagtaccccgaacattgaatactttctgcaaattaataattgagccgtccatttcaccattagaagtaaagcaaaccaagagaggtatcttctgaaattaaatcaattttatgccaagcagatcagtagtttggacaatacgtgtcttttttctaagataatggacaatacgtgtctgcgtgttcgtaacttcatttacaaatcttccgattaacccataagccatgctgcggctgcacgggcacatgcacgcatggcgatccttgtagaattaatccgaacaggctatatatatctagaccaatcatcccacgaatcatctcacaatcatcagaaccaaattcacagctaaatcgcacgcacaccacagtctacagcatctctgctttgcagctgcagcttaatttcagagctagcgagctacaactttcagcaaacgcctactgaccacgacgaca

SEQ ID NO: 35712 - DNA, 5349 bp, Oryza sativa
  unsure (1)..(5349): unsure at all n locations
ctttactcgcagggggatgggacgcggaacgcggcgctgagcacggcgctgttcaacgacggcgcgtcgtgcgggcagtgctacaagatcgcctgcgaccgcaagagggcaccgcagtggtgcaggcccggcgtcacggtcaccatcaccgccaccaacttctgcccgcccaactgggacctccccagcgacaacggcggctggtgcaaccctccacggccgcacttcgatatggcgcagccggcctgggagaagatcggtatttaccgtgccggcatcatccccgtcatctaccaaaggtacataattaacctacaccggacaaacacaaatcgtatttgtttttgatattgcacacctatatgacaatatataagacatatttgtaacatgtattttgtgatgtttttcagggttccatgtgtaaagaagggtggtgtgcggttcaccatcaacgggcatgactacttcaatctcgttcttgtgaccaacgttgcaaccaccggcttgatcaagtcgatggatgtgatgggctccaactcaaccgactggctgccaatggtgagaaactggggtgcaaattggcactcgttatcgtatctcactggacagatgctttcctttagggtgaccaacatggacggccagacgcttgtcttcagaaacattgtgccgtcaggatggaagttcgggcaaacatttgcaagcaaactgcagttcaagtgatcatcctgaattgattgggtttctactgcctgactgattatttatgatggacatttgcacagtgtatatatacacgttgtaaggactattgaattgtgcttctgtgcactattgcacatatgattttttttattttttattttttattgtttatacctgatttattggtgtatatatttatgtctttatcccatatgtatgggtgggtacttgtatatacaaagatgtttatgctcttcattgaatcaaaacatattcagattaatttttattacacttgtatcaacttcaactaaagttatataaaattgtaaatatcttataagagagggagtcatcctcctatccctctctcccccactttcacgtaaaaaattcttcctttccgtaaaaactgttcatcctgaaaatagatttctcataaaaccgaccatggtgtagaaaaccgaacaggtcacctctctgaataatttcactaaactaaataagaaaaacagttgcaacgcgggcctataatcagtagagggaaacgtcggatttactaggccaccaagccttagcacaactaaaagatggggtggaatggcagatgagctctcctagcataacacagcagctaaaacgattgctagcacaactatgcattgtaacaagtgaggcgcctgctgtgtgtccacgttcaacagatttgtcacaagaattgttcacacaaggaagcataccagccatgtgactctgaggcaaagatgatgttggaaatatggtcgcaatttggcatattttaatccaaatcattaagacaataagcatgacatttttagggaataaactagtgtgaatactaatcaagagcaacatacaaatcatgcttaatatagaataagcataaacattcatcacatggcattgttataaaaacattacgcttaatagtagtatatcagaaattagcgtgttgggaatagagacatactctaaaaatggtccttcgctggagtgtgaggcatagttgcctccgttgatggagccgttccctgcaccgcctcctccattgctgacatctcctccagctgcaccgttggcgttgtcgtctgtcgacatgttggcgttgatgaataggaaccaggaactcagacccaggaactcagacggaagaacgctccgcaaaaactttattgcccgcctacccgtgcaggaactcagacggacagagtttcggaggctctactcgtcccaatctcttttgcacgtaagagatcaaagctagggacgacggaagccacggcctcggcccagccaacgcgtgcgcgcgcacgtggtagtccgcccaccttctcaaccggtcaatagagagtcataattgtctctctatttaagatgagatctctccactaaaatttttaagatggtattattatcactaacattaattataggcctagggaatttaattgaattaaatcggacctgtcccttttattcaacagatgaatcgcgtggtttcaaggagtattcatgtttggcaacatcatgtgcatgatttggatgagcggtcaagatgacccatgtatacacccatttcgtttgatctctgtattttcagacggaattgctggtggggacgatttctgacgcattcatagtgagcaattacaccttaatcttgtttttcattaatagaaatggcacatgaacccttgtaaaataataattatgtgacttattttatccacatcaaatgttcaatggtacaaagcattgtaattagagtagtactatacatccgactgagccatacgactctcatacgactgcaccaaaccaaccaatcacatgagttcataaatattcacgtgggcccaatcaaaacaagttaaaatctgttatgtgcagtcgtatgcaggtcatacagacacagtcgtacgtacagtcattccgttgtaattaatctcgttctatattctatactcttgcaaaatttcgggtctatcagcccaccccccattcccaagtacgaaattatttaacccgaacttttttttatttttcattttttatgaatttagccattgtgttaaaatattcaaataatttaggatcaaaattaccgaaattttagtcggtacccccatacaactagcaaaaaagggatttagaaaacattgaaggctgaatacacaaaatatattggacaaagcaataccaaattgttacgagttttctaatcagagtggcgcagcggaagcgtggtgggcccataacccacaggtcccaggatcgaaacctggctctgataattttttccataatttttggcgctacgcaatttcatttaatccttttttttggctcaatttcatttaattcattttttggcgcagtttcatttaattcatttttggcgctacgacgatttcttttaaattgattttttggcgcgatttcctttaattcattttttggcgctacgacgattttgtttaattcatttttggcgctacaacgatttcttttaaattcggttgaatttttgggtcgattgttttgtcaagatttccattaattcaatttttggcgctacgacttttttggtcgattgttttgtcacgatttactttaattcattttttggcgttacgacaatatcttttaaattgggtcgaattttcgggtcgattgttttgtcacgatttcttcaattcattttttggcgcgatttcctttagttcattattggctctacgatgatttcttttaaattgggtcgattcttttgtcatgatttcctttagtttatttttggagcgatttcctttaattcatttttggtgctacgacgatttcttttgaattgtcttttttggcgctacgacgatttcctttaaactagaaaggtagcacacacacatgcgtgggcatcttatttaatgtgtttaaaattttattaccaacgtttatttgtgggtgattattattgaaatactttttgactatattctaatttgctagggattactttgaatgtcactccctccgtttcacaatggaagttattctagtatttcccacatttatattgatgttaatgaatctagacatatatatttatctagattcattaacatccatatgaatgtggaaaatgctagaatgacttacattatgaaacagagaaagtagttatgattttcttgtagttacccatgcaacatataaattctaaactaaaattacatcaatccgtatagttttgaatttatgagaaagtatatggtgtcacaacaattgagttggtttctataaattatactatatacatttgcactatgtatctttcttttgttaatatttagcatattttttacattaaataacattttttcttgtctaccatagattcaattttttcccataatataagtgaatctaaagtacaattgttctatccaaccaccgttcatttaatgtacgccgtgactgaccccctcccgtcttgcccacgttggtcgctcctcaccgtgacagagagatcgatggggaaggaagaagataagcgagagtgaaagaaagatgatgaatctgacaggtgggtcccacgtgtagatgaggaggaagatagaaaacgtaacgacgatggcactctaattttgtaaaatttgagtggacagctatgaatagacaaattgtaatgatatttatctgaataggcatttttcaatggcacgaatcaaattaacacttacttaataagcgggtatcatagtaattttccttcctcgttagcaacaatgttgagcaccctacgatatcttgctactacaggtgaaataactcaaatattttttttcaatttgttaacacacttggatgaattttaaatctaataatttctccaattgattatatgctttaatgattcaataaatacataggttatattccaatgagattagccgtgattatctttgattatatgtagggtgtatgttatggatttttttcaatttttttcatattgtcatatacatgttttttcaatttaaaaaagttacgatgctgctttattttatttcatgagattgacctattctgttgtttgtgtttaatctatattgcaagttaactttcttctttaccacttgacagcatagatttaccgaatctcgaatagtcaatttaataaacaatcatctcatcaatattcctgactcaatgattagtgaatagcagtttaattataagtagaaatgatacataggtttgaatgtgacatatataatctatctatttgacggagcttggggctcctcaccgggagaccgcgcaggcctccctttgccggttcggccgggggccctgggtgaggttctaagctcctagcctgtggaaagttcgcgagagtggaaacacacaagacacgggcgatgtatataggttcgggccgctgagaagcgtaataccctactcctgtgttttggtggatctgtgtatgaagaagctacaaagtgcgagccagcccccgatcgttctgggatcgtttttttccttctaagtgggcaaggtcctnnnnnnnnnnnnnnnnnnnnnnnnnnnnnnnnnnnnnnnnnnnnnnnnnnnnnnnnn

SEQ ID NO: 35713 - DNA, 376 bp, Oryza sativa
tccgcagattgggatcggagagagagaggagaggagagaggggggagatggatcgagagagaggcggaggtgggggaagtagtctctccacttcctctttctgttcttaaattctcttgggagggagagctcgcctcccattggagggaacacctggcgggttggcgggtccggatccgacacaggtcaagtgcctgtggtgtggggccacatgtcggtgtcagaggatgagggatgtgtgctcctcctaccgtgctggaagatgcttttaattagctcgtgttactgatgattattagttgtagtagctcgagttagttggaaaatggcggcagatgggaaccgtacaaggtagttggttaatgatgaactactg

SEQ ID NO: 35714 - DNA, 475 bp, Oryza sativa
tgaaactaactaataaattatgctaggttacgaatgtagcgatggaccagatataacacaagtggcccaacctgaccaagccccacaaggatttggcctgctaggtatgctcaaaattatgtcagtcaaggcccaaaaaatatcattaaactgggctagtgaatatgtcaaggcccaaaaaatatcattaaactgggctagtgaatgtgtcaaggcccttgtactcttcagcctagcttaagttatcagcctgtcttcaaggaaaattagtccagctggaggttgcaatgttgggttgggtccctactgagttagggggtagtagggcttgagattagaaacttttatttgattacttccagttagaggattttgctacaatgccaatttttgcattattctcaataaaatttaattcatgttctggtcttatagacttgaattgaattacagcttgaagaaaacattgtacaaa

SEQ ID NO: 35715 - DNA, 759 bp, Oryza sativa
gtaccctagatcactcaagagatcagagctcctgaatcccatggatttaacattttcattttttttactccacaacagcttgctagaagcctcgaatagtgatagaattcggatgccgatgcacgtagtaataattatccatcgactaattcggctgtcaaagttctacaaataatcagtatactgtcctacttatttaccacaagcacgaaggcaagcgtctctgatgaggcgcatctcgtcggcggcgacgctcatggccatcctctcgtagggagctcgccgggagcagctgagcccgaccctaatggcggatgccaagcaatcgcgcaccgtgacgcgcgcctcgctctcctcctccgacgtcgtcgacgacgctgctccgtcgagctcctcggcctgcagcagcagggccacgtcgaggatctcctcgatgttgtccgggaacgcgccggcgacgaactccggcagcgtcaggccgtcgcggagctcgccgtccgtcggcgccttcccggagaagatctcgaggagggttatcccgaagctgtacacgtcgccggaggccgtgaccatccccgtcgtgccgtactccggcgcgacgtacccaatcgtgccgcgtatgccgatggtgctctcggtgttcgccgccgcggcgccatggctggccggatcaagaagcagcttggcgaggccgaagtcgccgatgcaggccgtcatgtcctcgccgaggagaacgttgctcggcttcagatcgcagtg

SEQ ID NO: 35716 - DNA, 823 bp, Oryza sativa
  unsure (1)..(823): unsure at all n locations
aatgaatttttggtgttcatcggtttgcaaataattgagctttgctaatggacaatcacctattagcttgagatcctttgccttattcagcacatcagttgaaaatttagagctcggaaaaggtgtgtttgggcagttctgtcgaaattgatcagagtatatgcgtgcttcagtgactatctggttgatctcggatactggtggtggttgctttacataggaacacttataggacatatgaacagaagatgactccatcagatcaacagaacaacagacaagtacttttgtacctttggaccttggaactgcacaaaggtaacaaccagctacactcagggcagcctgcatgagattcaagcagaactgaatgaaccatgaaggatcttattttgctaaagtacagaattacccaatagtacttttcctatagagagatcatgatgagtattaacatagcatgtgctgtagaagaacatgatgagtatcttatgcaaaaaaagatatattgttggaggtcttgggttatatcttttgcacaagtgtacagcagcttttgaatgcgaacttatgtagtaccaagagatgctatggataatcaatattgaaattggagaaaatactgtcataagcttaaaatgtttgtgaatgaaaactattgttgaagtattcggagatgagtacttgagatctccaaatgataatggcatagatagattacttccaattggagagtagagaggttttccaggaatgctagggagcattgattgtatcaatgattnnnnnnnnnnnnnnnnnnnnnnnnnnnnnnnnnnnnnnn

SEQ ID NO: 35717 - DNA, 558 bp, Oryza sativa
gaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaatgaccacgcagccgaccctccgaaaggactctagaactactgagaccgaagagagcgcagagtcaaacattctagagttacgttccttccacagctgccaagagaccaggaggaccaggggggtcgaagctggcacggaggtgatcaggtaaacaagccc

SEQ ID NO: 35718 - DNA, 1026 bp, Oryza sativa
gaagaaaaagaaaagttcattttaggacttttttttccagaagcatttacgattatagttattgaatgtgtttatttctgagcaaacctaaaagaaaggattttctttctttttccaattaaataattgttaaataatatttgtattattaaaattagcaattaagctttgaaaattccaaagagcgtaactaattctagagaatttaataaaattaaatttaactatgtcattttatttctcaacttgctttacttgtaaatttatttaattatacacttacctaattaacaataccaaatatttcagcgaatttgtagtttaattaattgcatatttttttatctgtacgcttcccgttgcaacgcacgggcacttttgctagtccctcataaagtataatttatactactaggatactacagggaaacggttttaacagctcgtggatgtccactagtttattgcatatcatttaaatagttatgaaaaaaattaaaaaaatatgaataagatagatcaatatgtaatatgtaatatgtaatatgtaatgtatcaatccacaaacatgcaagctaaaattcaacttctacatattgtaacaaaaataacaaacaaaactcaaattaatatatgtatgttgacagttaaatttgttgttttttttacaacttgtagaagttgaatttgaactttgatgtttgtggagtgatatattacatattgatttatcttatcaattgttttaaaaaattttcgtaaccatctagttgatatgcaataaataaacaggtggacgtccaatcaagttattagaatccatcccgtttacgtttagtttcttgtattttggtacgatgagagtatgaccaattacatactaggacgattggtacgtaggcacgcgcgtgtacgtctttgatcgagatcgagttgctgttcccgggagatcgatcgatcgatacacatcatgacgttaatctcagaccttccaccggagctggttccctgcatcgccggccacct

SEQ ID NO: 35719 - DNA, 1447 bp, Oryza sativa
gtcaaccctctcaccggccgcgccgccgcctgcgccgtcgacgacccgtatctctcggactggattgataacgagggctcccgctgcatcttctccggcgacggcaccctccttacgtgctgcttctacgacgcagggccacccttatctatctacggtgccatttggtgccccgattaccaacaggtatggaaaagactcggcgacgccgacagtgacgaacgcgcctgcgccgtcgcctaccacgacggcgccgccgtgtgcgtggacttggcgagatgctacgtccacgagatcggaggtccagcagctggggatcaaaccacgtttctgccgctgcctgatgagcccggcaaggtgcgccggcgcagctacctcttggagcttcgcggcgagctgctgctggccagcgttctacaagacgccggctgcaccgacgacgacgacgacgacgacgacgaccgcctctcggtgtccgtgcacgcgttcgatctggtggctgcccttaacgctctcgatcagctagatgcagctgtggacggcgccggcggcggcgacccgccgtcgccgtcagtgtgggagaagatggacggcgcaaccggtgaccacgtcctcttcttgggctacccgagaagcttcgccgtggaggccgcgaggtacggcggggaggtgcccggcggaagcgcctacttcgtcggaaggtcgaagccgtgccgcgtgtacaggtgcagcttcgaggacgacggcacggcggcgacgctggtggacacgctgcccgccggatggaacgacgagaggtgcatgtggttcttgcccgagccggacattgctccggtgatcggagcacggacctaggaagaagaagaagtagaagctccgcgaagcctgcggcggcggcgagacctgaggatctacgccggcgatctgccacagaagatgtatagatccaggcggcggcgagtgatgttcatcaggcactggaaggaggtgttccttgcgtgtactccaatggagatgatctacgccttatgttttgttggcctcctcttgttttttggctcactattttgtaggctgatttgcggttggtttttttagttttgctatgttttagtgtactagcaaaaggatcgtgcattgcactgcatgcataacgacatggtgaatgaagtttgaccttaacgatttatcaaaacacccaagtatatatgattactaggtgaaaccccgcaaaaaaaataacgtgtaagatagctagataacatcagattaagtaaattaatgtggtttataataatttaaatttaaatagtgtgtagaatgatgattcaaacgaaaaactaaggcggcgtgattttatggaagaagaaaagtaaggagatagtttggaccgtagattaatcatctaaaggcaaaaacaattgatgtgatatgatttaattagagg

SEQ ID NO: 35720 - DNA, 1768 bp, Oryza sativa
  unsure (1)..(1768): unsure at all n locations
nnnnnnnnnnnnnnnnnnnnnnnnnnnnnnnnnnnnnnncttcaaatatctgataaacgatgcttggagtatgtcaaaccaaaatatgcaagttccagaaagactacatataatatctcccagaacttcatatctgtaaattttctttgccacctgaatcatgaagcctttgatcttatagaaaactgtgcattcagtaactacatgtagtaatagaatgacagtatggttttggacagaaaagaaatcaacatgaaaattctctggtcaattttcaagataaccagatggtttatagacttctacctaggacttctactccatgttatgaacaacttcagtttgtcactgttccaagccaagtcactggctgcacgatattcctatttcctagtcacctgctgtttcagttggtactgaacccgttaaaaattgtgacagactgaagcaattggctaatcactaggaagtcagacctcctaatcagttgccaggtccaaaaacaggttttactattttcaatatttgagaattgagaactatgccacgcatggcaagtactgctcttggagtttcgcatactcaccatattatagtaaatcgatatcaaagtgccaactttgatattcagctgttttccatagttagctaacaaataaaaggcatgcatgcaagggcagctaggtcatgtgtgcttcatgctgtgctaacctcatgcaattagaaggtttggagtagttcaccactacctagctttcggtagctcacgtttgatttaaaaaaacaatgcatcggattaatgaagtacttaaaaaaatagaacatattaaaattacaaaatgaaaacaaaataatgtcttttgagtggaatccttaccggtatactcaatacagcaccttgcgagttggtcaacactggtagcattcgtcttgcaggtgctggaatagatctcaggatttgaagagatttcattgctgacaattgcaaatatctagagtgctgcacgagtttagcatcctccaacttgtcacagagagcatttgaataattcttattctcttccaaagaatggatcttacaaacttcagcaaggaacaaccaatcggtatcgaacatatgcctaatagcaagacttccatcctgatttaccatacaatactggcaagtatgcttttgactgtcatgcaagcacattccattcacaacaacctccgaggttctccatgtaatcaagaacctgcccataaagtggcatgtttcaccaggccagagatttagaacttctaaataaggaaagcttgttttctccaagtactgttcttgtccatgctcttttgttgtaatgaatttttggtgttcatctgtttgcaaataattgagcttttctaatgtacaatcacctattagcttgagatcctttgccttattcagcacatcagttgaaaatttagagctcggaaaaggtgtgtttgggcagttctgtcgaaattgatcagagtatatgcgtgcttcagtgactatctggttgatctcggatactggtggtggttgctttacataggaacacttataggacatatgaacagaagatgactccatcagatcaacagaacaacagacaagtacttttgtacctttggaccttggaactgcacaaaggtaacaaccagctacactcagggcagcctgcatgagattcaagcagaactgaatgaaccatgaaggatcttattttgctaaagtacagaattacccaatagtactttt

SEQ ID NO: 35721 - DNA, 1185 bp, Oryza sativa
attgtgcctatgtgctacgtaagaattactagttcgctatcgtcatcatcagatggctatgtcgatgaatctaagagagatcaatgacttatttcaagcatagaaaaatatatgtatgtatatgtaagcatctttgatctggaaaggaagtataaaatgtccatattaattttcaattcagactttggaccagacttgggtgaactttgaacaggtccttagggcttgttttcatttcaagttgattgggcttccaatcaacaacagtaatatttaccaaaaaaattacacacaagagaaataaaaacttaaggatgtaagcagtacacatgcacatcaactagaaggaaccttgcaggggatggtacggatgtagtctatgagcaattgagcagatctaccacggagtggcctatgcctttgtgaaacaaactacaatggagaaaaaaatgaatcaatgtcccgtggcaataaggtgtctaagatcttcaaacttcagaatatttttttctcccaaaagacgtacctgtaatacatatgctaaatatcgtgaaagaaaaagatcatcaacgttatgtgggtcaagtttttccaggtcaatgacagcatatccatgctgcagaatgataaatgaattttacgggggaaaagagttagtatataaattttagtaatggcatgatataggagacatcgaattacagaaaaagggtatacctccattattgttaaagacttctttaaaaccatactgcaggcattatctataaatgctcgtgtcaaccggcacgcatagatcagtttgtgaagctctgactgaaaggtacctgtagataagcaaaatttgtcagctgaatgtgcattcgttcatcgctcatcataaggtgatagcgtttgcaaatttacaactgcagacaagctggccagagctgatgtagcttcacacataccaattggagctaggacttgccacaaataacttcggccacgaattggcaacatgtgaaacagtgaaaatgttgtcatttgctacaaattctgtgacctacttccacaagtgaatttaactaaatacaatctcttgagctagatacccatgaattctgggccactgatagtctgacacactttttatttactattaaataaatagaccttgtgtacagaccacacctagacagaaac

SEQ ID NO: 35722 - DNA, 970 bp, Oryza sativa
  unsure (1)..(970): unsure at all n locations
ccttatatgttattacggaactaggccgcacgccatattttccttttacataataagcatttctttatctcttcataataattctgagattaaaatatagcattgacaagttatacctggcaccgaatctgctttgagatctatctactatgggcaaatcttttatgtaaactaccaaaacatggtctcacctatattgacacaacaaatgaacaaaacagttgtagcattttattagtgcttcataaacttagaacagaaccgccacaaagtttcacatacttgtggcattatttttttgatacacctatactatttcattagtacatcactctaaggcctcgttctccgactcatttgagaagcctgggtaggtctgttgttgatatctaggagtgaaggcaccgagctcttctcccctattattcttaaggcttcgtgcttgctccctcgatatgcggtaagcattagcgatcacatccactggcatggcacggaatattgagttcttccctgcaaggtggctcaccatggagtttgcattggtcttgaatgaaatgtattggcatccttcatgctctgctttcttcaagacaacgtagtgttgtggaatgatcagcaattgacctggacgtagaacgccattgaataccgtctttccaaggttactaacgacctgaactcgagcatgcccttgaacgatatacaccaggctatgggcattaacgttccaaaacggagagagaatagcattctgtagagagtagagaacaatattatatataaatggtggcacagataaaactatttttatagaaatataggggggagagagatggagagtgaacaaaactccactttgataaatacctggtatagatttactctagtagcactcaattgtacaannnnnnnnnnnnnnnnnnnnnnnnnnnnnnnnnnnnnnnnnnnnnnnnnnnnnnnnnnnnnn

SEQ ID NO: 35723 - DNA, 12103 bp, Oryza sativa
  unsure (1)..(12103): unsure at all n locations
nnnnnnnnnnnnnnnnnnnnnnnnnnnnnnnnnnnnnnnnnnnnnnnnnnnnnnnttctgttctaagtttatgaagcactaataaaatgctacaactgttttgttcatttgttgtgtcaatataggtgagaccatgttttggtagtttacataaaagatttgcccatagtagatagatctcaaagcagattcggtgccaggtataacttgtcaatgctatattttaatctcagaattattatgaagagataaagaaatgcttattatgtaaaaggaaaatatggcgtgcggcctagttccgtaataacatataaggaccgattccttggagaatcttatccaagcatcttataatgtgaccatatgaatatttgattcccctggctaggttatataacaataattgtgtgtttgtcttgggacacttgtgcaagggaggaagatagcccttgaattcctagaattggttttgggcccccccttgagtaatagcccaaagtcttgtgtatatgttgactagatgtgtatatatattgggtacattgtggatgggaaaaataggtatagacctagccaacaaaattggagaggctttaggatgttgctgggctttaacgggactagtcatagtcatttttgttgatgagcctatgtgtttatacctcctaggttctccatgtttatcttgggcttgtagggacaaagcaaaaaaatgaagatttttttaaaaaaacttttaaaatttttaattttgaaaataagtcctttcaacacataattcctagatccgaaccttttggccacgccagccgaatttgcatggcaaaaccacaagacaacactgtcacaccggtctggctagcgtggcaacgttatttggtcatactagtctagttggtgtgccattgttttttggtcacattggtctggctggcgtgtcaatgatatttggccatgccacccttgctggcatggtaggacaaaattgtcacgcccattgtgtgtggcgtgtcagtattgttttgccatgccagacggggtggcatggccaaaaggttcaagttctagtaataaattttggaagggtctatttttaaaatttaaaagtaaaaaagtttaaaacataaaaaaaatcaaaatggcatgtccggtataacaataaagatgaaaccagcagatctaacatggaaagtgtatgttccaaacttgtcaactaattgtatatatataaccgatttccatgttagaggtatatcatatatttgttacatatatgcatatagaatggtggtcagtgtgtaaaatatggcatgccccactcctaggaaacactatttcacgcatatattacctattgttgtactagaaggttatcctcaaaccggtacagcaccaaacaaataaggaataccagcctgttagcggcaaaatttagtaactactgttagtcaagatcgggtcaatggagtgactaatgatgtaattatatttgattcagttggaaagtgtatcaagtttagagttattttattttagcctccgtattaggaaacgtttctttttagcttcattttctatagatggagtcttgagccaatcaaattttgtttgaatcggacttgtttatttttctgtaaggtagccgatcaagttatgtccgagtaggacttcttctagctggaactaaaaataacaatgccacactagctagaccagcatgaccaaataacgctgccgcgctagccagactgttgtgacagtgttattttgcggttttgctaaggcaatttggctggcgtggccaaaaggttcggttcttggaattacgtgttgaaagggtttattttcataattgaaaattttaaaagtttaaaaaataaaaaaatctgcctttttttctctttatccctacaagcccaaaatgaacatggaggacctaggaggtataaacacataggctcatcgagacaaacgactacgattagtcccgttaaagcccagcaacatcctaaagcctctccaattttgttgcctaggtctatacctattttccccatccacaatgtacccaatatatatacacatctagtcaatatatatgcaagacttcgggtactcaagggggcccctaaaaaaattctaggtattcaagggctatcgtcttccttccttacacaagtgtcccagacaaacacacaactattgtcatataacttagccaggggaatcaaatattcatatggtcacattataagatgcttggataagattctccaaggaatcggtccttatatgttattacgtaactaggccacatgccatattttccttttttttaggggaaacacgccatattttccttttagataataagcatttctttttctgtttataataattccgagattaaaatatagcattaacaagttatactttgcatcaaatcttctttgagatgtatctggtatgggcaaatctttttggggcatttgcaaatttgccaccggtttttttaattttgcaaggatgccactcgaatgatagttctagtggtatttttgcaattttctagtgacagtctcgtaataacgattcaaaggagtggtaaatttggaattgccccaatctttttatgtaaactgccataacacggtctcatctatattgatagaacaaatgaatcgaggaaaattttgctataggacatcgcgactttacggttttagctgtaggacactgcacgaagtgagttttgggggaaagcactctgtaaatgtggaaattagctcgtggagaccgcgcgcattggaatattcatttttagttggataggagggagaaattgcatgaaagtactaaaatacccctgagcccacaagtcagctctttcatctctctatttgtatctctctagcactgaagggcgtcgatagtgtagagcggcatccctcctcctcccgacgcgactcctggtgagagatcgctcctgcggccgcctcgagggagtgagctagataggggtcccgatctcgtcggccgcatcggtggtggtggggtggggtccatccatggcgctggcctggatctaggcgggttgaccacggatcccgtcgagctttctccctggtagggcggcgatagtgtcttcgtcgtcggatgggtcgtcttctaaatcgtttctcatcagtgttgggaatgtcgctttggggttgtcgaattggggactgcggatcatgcatttggttcaagtgtttatgagtccacagttgattgcttagtagcggcagcccatgcaggtaatgtgattttgagtttcatggaccaggtggtcaaggtgctctgcctcctcccatccttgtgcaggcggcagacctcccggtagtacaacatgctagttgagacgcttctgtgtgagagagatagacagagagagatgcaagacttggcatttgggaccaggggtattttaatattttcatgtggtttctctcaccaattcaattaaagatgaatattcgaataggcgcgttgtccacgagctaatttccatctttacgtagtgtcttttcccaaaagtcacttcgcgtagtgtcctacagctaaaatcgcgaagtcacgatgtcctgtagcaaaaattgcatgaataaaacagttgtagcattttattagtgcttcataaacttagaacagaaccgccacaaagtttcacatacttgtggcattttatttttttttgatacacctatactatttcattagtacatcactctgaggcctcgttctccgactcatttgagaagcctaggtaggtctgttgttgatatctaggagtgaaggcaccgagctcttctcccctattattcttaaggcttcgtgcttgctccctcgatatgcggtaagcattagcgatcacatccactggcatggcacggaatattgagttcttccctgcaaggtggctcaccatggagtttgcattggtcttgaatgaaatgtattggcatccttcatgctctgctttcttcaagacaacgtagtgttgcggaatgatcagcaattgacctggacgtagaacgccattgaataccgtctttccaaggttactaacgacctgaactcgagcatgcccttgaacgatatacaccaggctatgggcattaacgttccaaaacggagagagaatagcattctgtagagagtagagaacaatattatatataaatggtggcacagataaaactatttttatagaaatataggggggagagagatggagagtgaacaaaactccactttgataaatacctggtatagatttactctagtagcactcaattgtacaaggttaagaatggggaacttctgactgttgagacgtgtgatccttccagcacgtgggttgtaagtatcagcatggctaggattttcgatgttcaaccttgccttgattgtgcagaagttctcatctaaaccgttgcaacgcgtagatggttgttgttcttcactgtactgaacttggtattgagcttgtgcttgttcctgctgttgtgcttgttcctgttgttgtgcaaaagcaggtctcaacagtttaaggccattctttacccgtatgatctctcctctttggtcgttttggccttgtagcctctttgctaccaatgcattgacgcctaaggcctcacttagtagctcattgttgaaaccgctaaatatgttttgcccagagtgttgctcgattgagcgaccatacatttgttgctccctgttgttgttacccgccaataagaactcctaaaatttttatcagtgggaatcaatgataaagttttgccacatgaactgcaacatattcatatatatgacaatgagaaacaaaaatggtgaagaaatttagttaccttctgccttggttcaagctgattagcgttgttgtttaagtcgaagacatatagagcaacaactggtgcatcgccttcattgtagaaccaatgcgcaacaccagctggcagtgcaacgatatctccttgtctaaattggtggatcttttggtgctcatccctaaatttttggctctggctttggccttcaggcaagaattgttggaattgttgttggtaggttgctgggcagccggggaaagttaatcccatagaacctctccctgaaagttagaaatgtccatgtcaggtggatataacctaaaacgacattattgtaacatggagaatcataatttgtacccatatgaacaatgtattccgctatacaaaccttggatgatgtagaccatgccaggagtattgctgtatcgaggtaccagaaggccttgaggctcaatgacacgtcggatgacaaatgtacctgtgcactggaattgttcattcttctcatcaaagtactctgtaaccccggcttctgacctcactctccgaagtggttcaaatgcttgtagtctatcaaatctacactccctaaaacctccttgccgagggttgtgccatggatttacgttcggaccaaatagctgggccatagagccatggcataggagaagaacacaaaagtagatagataaccgagagaaagctatggtcgccatagctatttgaggatgttattggaaacttgggctggttgatgtgagttcaatgacagggaagccaacttatatagtgaagaaaagaatcttcagatatgacgtagggatagagtttgttgacatgtatagataatatctagcctataatgcgaaaagtataatagaaaaaaggtagctttgcaatgttgagatatacacactatgactcatggatgacatgtcttgcgctttaggggtaatacaaacaatgcttgttggtaaatgtatatccaaagccttaagatgttcctttgccttatggataaatttccttttgtgcaataaagtttctctagtatgttatcattttgtgcggtatgtcatagatgataagttaggcgctccttaaatttgttggtttgttgtcagttttgcgtggcacactatgcttgataagttagcggaacttttaaaataagaaacttgtaagcttgttgtcattttctttgacatactatcctctcccatatgtaaagtaaacaaattgatgaaatatatggaggttagatgattttgcatatccaactagtacttccaagtttataccaaaaaatagaaaatgttggatttaatttttaaaaaagtagaagcaatggacttatgtatcttttcttttttttatcattatattttctggcgtgcatttattaggcagtttattactgtgacataaatttatttaactcgccggtaataaaatatgccatatgtttgttagtcctcactgtcgaccatatcatacaagacattaatcaaatcgtcttgtctaaaatgaccacaatgtccctgcgtggtgtggactatgatttcttttcattcatggttagaactactgccggtccatgaaaggttaaactataaaatgccatctgaaaaaaaaaaggtaaacagacaagtactcgccctcgcaattaaattgttcaataataatagaaatggaaggatttgtcgtgtgtgtgtacatatatacaagaaaatatcaggaaagcatgtatgttattttacacaccgaaagaataaacgcacaacgaaacttatatacaatcatatgtttgctaggcaaccagagatgttactcccaaaagaaacgctccggtatcaattcaggcttctcctctcacttgaactgcagcttgcttgcaaatgtctggccaaacttccatcctggtggcacgacgttggtgaagacgagcgtttggtcatctgtgttggtgaccctaaaggatagaccttgaccggtgaggtaggccagtgagtgccattgggcgccccagttacgtgccatcggcatccaatccgctgtgttggaacccataacctccatggacttgattgaccctgccgccgcgacgttggtcaccagtactagctggaagtagtcgtgaccgttaatggtgaaccgcaggccacccttcttcacgcaaggaaccctgtagaaatcatcgcaagagtaggatattttcatatggaagcagcggtcaggatatgcactgttctctccataatgtccaaaataattggagtatttgtattggtacctttgatagatgaccggtatgatgcctgcgctgtagacgccgatcttctcccaggccggctgtgccatgtcaaagtgcggccgtggtgggttgcaccagccaccattatcactgggaaggttccagttgggcgggcagaaattggtggcggtgatggtaacggtgacgccgggcttgcaccactgcggcgccctcttgcggtcgcaggcgatcttgtagcactgcccgcacgacgcgccgtcgttgaacagcgccgtgctcagcgccgcgttccgcgtgccgtacccctgcgagtacaggttgccgtatccgcacgccccgcccatggtgcccgacgcgtccgcgccgccgtagaacgtcgcgtgcgccttctgccactgggtcggcgcagccaccgggtttgtgggcgtcgtcgtcgctgtgttggccgcggccgtcgatgcactggcgactgcgagcagcaccaacacgaacgctcgagctggggccatgtctgtcgtcatgatcggataactctgtaactaggcccttgagacttgatgaccgagttaattatctggagctatctatctctgaaagcaacactgctctgttgctttgtgttgatcttctatgtgatgtctgtttgcttggtgatctcctgatgattggatgggtatatatagccatcgctcggtcattgttggattgctgcattagtggctaatgaaatcccaataatgaagtagtgtgaactctggaaagccacgggacgaagctagcgcgcggcgacgcgcatgtgcatgcatcgccggccggcgcagccgcagtactactataacttgctcgccaattaatccgaaaaattttcggtttttccctgattggcgcagaatgacgcaaaacacaagcgcggcgacgtccaggctcccgcaatcgcaagcaagcgcatgaaggcaacgttcaacggcggcgccatgaagaatggggtggcgtgtgttgtgtgtggccggcgatcgagtgaggcatctctgaagtctgaactgaagcatctcgagtgttttggactcgtttcttttcctggtgacgttatgaggtgtttttttttccggggagacgttttgatgaggtgttgatcagaattcatcaccttgttagaatgtcaacaagaacaattgacggaagaaacaaataatcgttttaaaagttgacaaaatcatcgagggaaaaaacgttttcaattagacaaaacaattgacgaaattccgttgtcaagtaaacaaaacaatccacggaaaagacaatctatctatgatatactgaaaatctattaaaattcctacaaacacactaaaaccgtcacgtgtattcctagtttcgtacaaatacttctaaactgtcacatgacactttaacaaaccagtggacctgatatttttatctattagaatttttttttaaaaaaaaccaaaacaagtagtcacgtatttgatggggcccacccttccaccgggcgtactcacgtacgtgcttcctccctccccctcctatccaatctccttttttaaattattaacatttttgaacattaacaaatcttagataaccacaattttcctatagttatttgtgttctttaacaattaaaaaaattaaaaaaattaaggtgttctttaacctataagaaatatttaatttttatcatatccaaaactttacatatcactttaaactgttatgtaaaatagggaaaatttgataatgctgattatatgatcaattcgccaaatatgcataaataaattaagttagatctattatctctattattaaaaaattgaatatgtttttgccggtactttggtacgttatccgtgcacgagtcggtttttaagtttgttctttttggaaatacggatccatatttgagtcggtttttaagttcgtttacttttgtaaatatagaacaaatcgtataataaatctctttaaaaaaactcacgtgctaactcgaactcctaattacaactcaatatatagggcttttcttacgtatcacttctatgtccacttttcttatgtatcaactagttgggtggcccgcgcaattgcgcggctagcacctaaaaaaaatcatatatttttcagtatgattttacttaaaatttattaaatagctattacgttgtcttaagactttgaaaagccaaatcttatcatccctgtatttctaattatatagttttttaaaagtcacaccagctactaccccttacttctgtcatatttcttttatttgcttgcttgatctaccactatttctattcattctccttaaaacctttaaaaatcagatcttatagtttttataatttctagaagtcccatcaaacgctgtcattatactcctctacaggtcatcaactgtcttttctctatattgtcattgggattttacaaatcgaacataattatcgttcgggttcattttttactttctaaagtcccgctaaaccgtcagcggctttgccattgttttcctttatggcacgcccgctgcctcacttctttatcgtcattgagattttaaaatcgaatatgattatcattatgttttttttacttttagaagttccaaacctttaaaaattagacctcgtagtttttagagtttatagtcttgttggtttcattttttataatttttagaagtcccgttaaacgatgtcactatactcctctatggcccatctgccgcctactctctattgtcattgggattctaaaaatcgaacataactatcgttagaatttattttttattttctagaagtcccgccaaccgtcggtggctctcctatatatcccgcccgctgcttctcctttttattatcattgagattttaaaaatcgaatatgattagcattggtttttttttttactttctagaagtcccggcaaccgccttgatcgattgcttcacggcctacccgtcgtccttcatttcaatcgttattaggattctatttggtgttttattaacagttattgcatgtcgtatcaaccaccaccactctactcctttataggcgtgttacttaattaatctcgtcatgtgttttagatggtattttctttcaatagtcttgattttttatcaccaattttagttatttataaatggtattcctagtatttttctttttttaatttcagaatttattttatttttcgtattgtgttcttttgatatttttattttttattttcaattttagttgcttccaaattgtattcctactttaactctctttttaattcgcctaatttcggattttattttattttttatctcgaattttaattaatctactattaggttgttttatgtactcttatttgcagcgctgcttatatttaatttcgaatttaagttaattttaaattgcattccgaactcttcttttgtttttttctaattttgattttttttaattttttattccgaattttaattaatcttgtattggattcttatatatactcttattttaatatttcttatttttaattccgaatttcagttatttttaaattgtattcctactcaaactccccttttttctttttataatttctaaatttattttttattcctaattttaattaatcacgtattgggttcttatatggactcctctttcaatattgcatatttttaattccgaatttcagctatttttgattttatttctatttggactcttctttttttttctccgattaatgtgggaatttctagcctctacagcaaacgtggttatgtatttttggcttggttatatatttattggcatgaaaatactgatacaattcggaaacggcagagtttgattaggattgttttgtctttcaatgtttctaaaagtggtgttaacacgcgtattcccaaaatattgtccgtttccaatatgattatgtttttcttttcttttgttttttttttgtttttgaccgattgtacattacgtttccagtagattaggttttcccttttttgtttgtttgtttcttttttttgacagattgtccgattccgtttccagtagtatgattaggttttccttttcttttttgtttttgactgattgtccgattcgagtttcttcatacgccttatttctttctttcttcagtttttaactaatcctaatctagttctattttttttcttattttttagattaatgtgagaatttctaggccatgagagcgaacgtagaggcttctttttctattattttaaagatataactagcatggtggcccgcgcagattgtgcggctagcatcattatattttctctcatattatatcatatatgttttctcattatattattcaaatatattaaaatgacaacataattttaaattttgcaataactttacaaaactactaatgtgtaatattcatattgtattttatatacgtgttagttattaattatttttaatatcaaatcctatatggactctagtctcgtcttttaatatattttttagttccgaattttctgtaaattgtatttctatatagactctatactcttgtttcaatattattctatttatttttatttctaaattttaattatttctaattgtatttctatgtggactctaaactcatctttcaatattctttaatttttaatttcgaatttcagttatctctaaattgtattcctatattgactttaaactcttcttcccatgtttttctaaatttcgaattttagttatttgtaaattgtatttttatacggactctaaactctacttttaattttattatgtttattccaaattttagttagttttaaattcctatagggactctatactctacttcaaatattgcttattttttaattccaaatttcta

SEQ ID NO: 35724 - DNA, 6251 bp, Oryza sativa
tttatatatctgctctcatttttaaattatttatcgttttatatttgtaccaagttaaacatttctaatgttgaccataaatttatattgttaaacaccataaggtttttttattcaccgtgggaaatatttttactagtttatttattgttaaattttatataaattgatgacaggacaaagctaaatctaaaaagataaagtaattccaaaccgaagaagaatatttggttgctactggcatcaatccgaacataggtgcgtgtttgcaattgcacccatttgccatggcggacaaggattttctatacttggtacaatggtattcattatttgcatacgacttagaacggtcaaagaaaatttacattaattgaaatcttataattctaaagacaaacctgtaaagctaaatttaatttacaattagagaaacaattaataaaatcagatggtgaaaagtacttgttgaacataaataaattttgtaatttttttcttcatatcgtagacaaaaattagacttgtgtggtatcttatatcatcataatttatcttgtcaaattttatgaaatttttatataattgcttaaaccacaatgcatacatatacctagacgtagaaaaatattttgtgcagttttttccattgacgctgtttttctcgtaaggtggtttcaacagttttgtctataaaagtaaattttcctatagaaacacttgcatatatttgctatatttcgggcacctaaaatttactccctctgttctatattataaattgtttgacttatttcttagtaaaacttaattaaatttgatcaagtttatagaaaaatatagttgtagtttcaacacaaaacaagcatatatattatcaaaatatattaattgttatatctaatgaaactaatttgatattctagatattactaaatttttctataaacttcgttaaacttaatcaagtttgactaaaaaaagtcaaacgatttataatatgaaatatagaactagagggagtacatattactaaacctaaaattacagtgttgtgcttgtgcattatgcaattttagggttttttttagcaagagagggcaggccgccctcctccgttttctattaccagaaacgtgaagtttatcacagcaggagtttgacacaagctaaaacactcaaccttttgcagcaggggatggagcatccatgaacacagacccttacatggtctctgccaaactttccagaattgctcagcgaaatagcaaaatgagtcatctccaggagcttgtatctctctcttttctcgagtggcacggctacaaatagacgaattataatggtatttatctgaatagacatttataatagcacggatcaaattaacccttttatccttacagtcttcccgtgtttaggcaccacctatacattgatacgaaacttcatcggccacccgtcttaatagcagcattactcattgcaacctttattttaactgcagttttttttgttatatattattatgctttatttttatccaagtttatttttttataaaggaaagcttttattaatatcagacgattacattaagttgatagaaccatacttatggcctttgcataatccaaaacacacacaattttgtagatttttatgagttatatgtttgtttcatttaattttgtaaatttattattacaatactttattgtttaaccattgatgagaaacattgtattttcatctaacggatcataaaaatgactaaaattttcaaaaaaaaaaagaatcaggcacccgagatctagacacacccaaacttccacctataaactaagaaaacattcattagggaaaatttttatataagtttcactaacaaattgtaaagccttagtcctatttttttaaaaaaaaaatggctcggctcggtttggctggattagaaaacgagctcgtaactgaaatgagccgagcctcaatgagctcacaagtctcccagtctcccagacctgatgtactgacctagtaaatcggatgttccccttttatttatgatttgataagtttacgttgaagttgataacgagagtagtaaaaaataatttaaagatatttttaaatacaagtaaccacccgttcatatggatatgaacataagtatatacatccataaatcaaatataaacaataaaaatcagatgtgcaacagtgaaccaagcaccaaagcacacaattcaacaatctttacaattaatgtatctttacatttgcacacaatgcaaatgttcatcaccaatcagtcgcaggccgtagaaacccaaatctttccgggaattaaattacttgaactgcagtttgcttgcaaatgtttgcccgaacttccatccagagggcacaatgttcctaaagactagtgtctggccatccatgttcgtcaccctgaaggagagcatctgcccggtgagatacgacagcgagtgccagtttgcaccccagttcctcaccattggcatccagtcggttgagttggagcccatgatgtccatcgacttgatcgaaccagtggttgcaacatttgtcacgagcacaagattaaagtagtcatgcccattgatggtaaaccgcaccccacccttcttcacacacggaaccctgaaaatatcaccaaatatgttacaacttaaaatatgccataggtgctatatgtcaaaaacaatatgtttttttttctcagtttaaattatatacctttggtacatgaccgggatgatgccagcacggtagatgccaatcttctcccaagcaggctgcgccatgtcaaagtgcggccgcggcgggttgcaccagccgccgttgtcgctggggaggttccagttgggcgggcagaagttggtggcggtgacggtgacggtgaccctcgggcttgcaccactggggcgccctcttgcggtcgcaggcgatcttgtagcactgcccgcacgacgcgccgtcgttgaacagcgccgtgctcagcgccgcgttccgcgtcccgtacccctgcgagtacaggtcgacgtagccgcacgccccgcccatggtgcccgacgcgtccgccccgccgtagaacgtcgcgtgcgccttcagccacacgggcggagtttcatcggtagacggagacggagccatcggtgtcggtggcgacggcgcatcctgggccgcggccatcaacgcgctgccgactgcaactgcgagcaacaccaaggcgagtgctcgagctggagccatatccgccatggacgttatcaataggcgctgaaagattgtagctctgaaagctgcagctgcaagatggttgtgtgatttagctatatatgtcacttttggttctaatgattaactaatcaactgatctgagatgattgtgagatgattaggtccctagatatatatagcctttttttttcggattaattcaacaaggactaccgatgacaccttgagttaattaacgacgcttgtggcgtgcagccgtgcatatgcatgtgcgtgcccgtgcagccgcagcgtggcttgcggtttaatccaacgatttgtgtaagcgcagacacgtattatggcccaaactatatattattctcttatctgtgtactttttcgtcgatctttgcttgaacttttgcttgattatattcgattagaggactatctcttaatttgcttgacttcagattgtgaaatggacggcttaattatttgcagagattattcatgttccggtacttccttgtttaagaaagggatggcgtctgttcctttaatagtacgggtgattctgcatctggccagcaattgtaatcgtgtccaaccgcgtgcaatggataattcgccggaaaagtattttttattgtcgggatgacaaaagaaaggccatccgaacaatattaggatcgaagaaaaaagagttacaagaaacactatcatcaaggctatcgagctttattgtgtaccaaagtatgtgtataggaactactcgtctaccacacaaacacatgccactaaaaggggagcctaccacaaaaccagccgccgctatgcgtggccggtcatcatcgggcctacaacgactatagagaaaaaacaacacctacacgaagactgtgacataaggaagctgtcaggtgcagaaattgaatttgaacttgtatgtttgtgaagtgatatattacatgttaatacatcttcttaatttttttaaatttttttataactatttaagtgacatgaaaaaaacgaggggatatcccttcgagggatcaatatagtttccacacactacccaactttacaaaacttcaagcaaaacaacttgtcaaagacaccccaatttcttcaggatcatttcttttcatttatctaccagagcgcaatctccctcctttagcaaaattctccatctttgcatcaaggatacgccacctgcaatggagatttttaccaaaatattttcaaacacctattctttcttagttaaccacatagaccagcacaaagcatcaacaaaaaaaaaaacacccacaatttggacttaaatttgtgtttgaacacataaatgcacccacacagctccctagggatgttatctaactccagtgcttccctaacagtacataagataaattagcaattggacagttaaacatgatatgcttagttgtttcccttttcatacacaatttgcacttctcatcaccccctttccatttcctatagaccaactgcatagcagatggatggtacccactgaatacatgaaatgtttgattttcagcggaatcttgcttttccacacatccatcatctccacacctttaacaccccccatcccccacccacaaattttatcaacctacactcttgacaccatcatgggacgattttgacaacaaagcctcttctgcctacatttgttcctcttgggactggggaggaaggattgacaagttattattcatctgaccccagatgtggtaggctcacttgtccgcctggttcacacggctgtgtgacaattttgtggagttgtatgatttttcctgttattagagttgatgggattgaattggactaaggtaagagccggtggatggtaaaacggatgttttcctattaattatgaactatagtttttaattggaaaaagtacgaattacccccccgaactatcgcggtcgtccgaattacccccctgaaccacaaaatcggacattcttcacccctccaactatgcaaaccggacgaattaccccccttgacccaatccacagtggttttggtttacgtggcgtacacgtggcaatccagtcagcattccatttaaaaaaattgtgtgggacccacgtgtcatacattcatactctctctctctctatttctctctctctcttaccgtctcatggcgggcgaagcggagggcggctagtgggggctgccggtccgcgccggcgccaggtgaggtgccggtgggcgagcttcccggctgacacgccgtggaggtaggcgtgcccttgcgccgcgtcttgcgccagcttcaacctcgtctgccactccagtggaacacgcgccggtcctcggttctctgaaagaatccattgccatcgtcatcgtgtagacattgatgagaagaagccatgagaggagtcaggagagagaggttacggaccattgaggaggctgtggaggctgccattggggacgtagtcgaagacgaggaggagctcgtcggccgacgcgtagaaggcgcaaaggctgacgacgttggcgtgccgccacgtgcccatcttccgcgcgagctcccgcttccgccgctcgtcctcccgggtcgtgccttccctccgccgcatcctgttcatcaccaccacctcgccagccttgccctcctcgacgacgccggcgtcgtccacgatgacgtcgtcgcctcccatggccacgtggtacgtcgtagccgtcgcgcccttgcccagtatctccgcggcgccccgcatgagcgtgcacacgtcgaactccacgcagcagcagcagaagcgcaccgtctcctcccgcgccatcgaggtggtgcgtgagctggcgcgcggcctctccggcttcttgttccttcagccacagtacgccgcagctagagtgccgcggcgaccagcgatgccactggtgcgcccaccgccgccatgatcatcaccaccatccaccggtcattgctcctcctc

SEQ ID NO: 35725 - DNA, 2350 bp, Oryza sativa
  unsure (1)..(2350): unsure at all n locations
gaccaaaaccaccgtggattgggttgaggggggtaattcgtccggtttacatagttggggtgaagaatgtccggttttatggtttagggggtaattcggacgaccacgatagttcgggagggtaatttgtactttttcctttttaatttatgttttaagttcggttcaagttgatatgagagagtagtacaaattgatttgaagatattttgattcaatgaagaggatgaacatctcttgatatacatgtgcaagtacccacccctacatatggatatgaacataagtatatacatcaataaatcagatatatataaacaatggaaatcagttgtgcaaccgtgaacaatcgagcaccgaagcacaatccaacactctttacagtgtatatatacacaacgcaaatatccatgacaaatcagtcacaggccatagaaacccaatcttgaatttttgggaattggttacttgaattgcagcttgcttgtaaatgtttgcccaaatttccatccagatggcacaatgttcttgaagacaagcgtctggccatccatgttagtcaccctgaaggagagcgtctgccctgtgagatacgatagtgagtgccagtttgcaccccagtttctcaccattggcatccagtcggttgagttggatcccatgatgtccattgacttgatcgaaccagtggttgcaacgtttgtcacgagcacaagattgaagtagtcgtgcccgttaatggtaaaccgcaccccacccttctttatgcatggaaccctgaaaacattacaaaaaattgttacaaatctgttctatcgtcatgtcataggtacaatatgtccgaaaatgatatttttgttttgctgtcaaattatattttatgtacctttggtagataaccgggatgatgcccgcgctgtagatgccaatcttctcccacgccggctgcgccatgtcgaagtgcggccgcggcgggttgcaccagccaccattgtcgctgggcaggtcccagttgggcgggcagaagttggtggcggtgatggtgaccgtgacgccgggcttgcaccactgcggcgccctcttccggtcgcaggcgatcttgtagcactgcccgcacgacgcgccgtcgttgaacagcgccgtgctcagcgccgcgttccgcgtgccgtacccctgcgagtacaggtcgccatacccgcacccgcctcccatggtgcccgacgcgtcggcgccgccgtagaacgtcgcgtgcgccttctgccacacgggcggagccgcgtcgtcggccgtggtcagctgagtgcagccgacggccgcgattgcgaaaaacaccaacgcgaaagctcgaggcgatgaagccatgtctgtcgtcgtgatcagtaggcgctgaaagatgtagctctgcaagcagatccgctgtagactgtgtggtgtgcgtttgattcagctgtggatttggttctgatgattgtgagatgatgatgggatgattggtctagataaatatatataggctacagcctctttggattaattcaacaaggatcaccttaagttaatgaatcgtgtagcgtgccatgtgcccgtgcagccgcagcatagcttacgggttaattaatcggtagatttttatacgaagttacgaacacgcagacacgtattgtccaaactattgatttccttgacacaaacttgatttaatttgagaggatatatcttggatttgctttacttccaatggtgaaatggacggcttaattatttgcagagattattccatgttcggtgtactcccttgtcgaagtaaggatgtcgtctcttccttgaatcttactgctgaaatgcacctggccaacagcatcagtcgcgcccaacggcgtgtaatggtataataataaattaataatattcgttggtatagaacttttagagttgagtcaccattaaggcagacgaggaattcctggttaatcaaacgacctttgcacatactagtacgtagtacgcattttgacatcacaatattgcacttgccatggcgtgccgcgtgcctgtaggtgtcactttttctgagacaccggtaacaggagtactgtaaaaaggaaatttaactatttgcgggttactctccattcgccagtctaatatttgttcgtacaaatttaccacaagggacaggggaaatatttcacacttttggtaaagcgacacactatggcctatataactcttgatcacgagttaagttaaatttccccgaaattaagaactggctctgtatcaagtatctgtnnnnnnnnnnnnnnnnnnnnnnnnnnnnnnnnnnnnnnnnnnnnnnnnnnnnnnnnnn

SEQ ID NO: 35726 - DNA, 5046 bp, Oryza sativa
  unsure (1)..(5046): unsure at all n locations
nnnnnnnnnnnnnnnnnnnnnnnnnnnnnnnnnnnnnnnttcgttggtatagaacttttagagttgagtcaccattaaggcagacgaggaattcctggttaatcaaacgacctttgcacatactagtacgtagtacgcattttgacatcacaatattgcacttgccatggcgtgccgcgtgcctgtaggtgtcactttttctgagacaccggtaacaggagtactgtaaaaaggaaatttaactatttgcgggttactctccattcgccagtctaatatttgttcgtacaaatttaccacaagggacaggggaaatatttcacacttttggtaaagcgacacactatggcctatataactcttgatcacgagttaagttaaatttccccgaaattctgtactggctctgtatcaagtatctgttgtaaacaaaatttcagtaaagagaacaatacattgtgccttcctcctatcactactacataaaggcaaatagaggtcaacagtgtagatgccggaagtactaaaaccggcacacatataaacattttcacacctccacgggctgaaaatacattaaagaaaccaagacctttaagcaactataagtgccggttctggagaagaaccgacacctatacaattgataccggtgtttttaaaagggaatctttaatatattataggtgtccaaccgacacttgtaatatattaaaaaaccgacatctaggaaaaccgagccgagccgggagctaggttcctctttttttagcacaaagggggtgagagggggcttatctactctccccgccccctctcgccatccctctttctctccaccttaagcctatcccctcctcctctcctcctctgcccccttccctttcgatcggctgagtcgatagtgacagcaagcaaaaatggatccggcagtgtcggtggcggcgtgagcgacggcgtcggaagcgggtggatgcggtgtcggcgagggttctcgcagcggatgtggcttcagcggccgttcccatgacggatcaggcatcggcaggagctcccctggcagatcctcctgcacgatggcatggtcgctgtcctcgccacccttacctcacaatgccacagcgctatcgtgccctccacctcttgttccacagcaccgtagggtgggggattttttttatattatttttttggttcggaagtgttggctcgactcgatggcttttttgtgttttgcaaaccgtatacctcaaagatgccagtcacctttgagtcctcatcaatgccgtcttcgtagtgtcggttgggaaatcctactcatcaatatatttcatcttacctcatcatatgagataaatgctttttattacacttaaaatcctttaatggaaattaatctactatattagggaaagtaaccatgtttccattgcttaattactaaatgtctgcttgtgacattccaaaatttgaatctcacatattgcatcagaaaactgaaatggaattgattttattttcaatttgtaatggaatttatatttatgccgccatattttttatgaaaaaatggtcagtatgcatctacattgtgagttcataaattgcatatctaattttagtatattgtcatgtaattcccaaagttacatatgtaagttccttaattacatatataattatggtgtatttataatgtaagtttcaaaattatatatgtaattttagcttcacctacattttaagttgagaaatgctattgttcaaaaatttttggcctcgccattttaatgggcctgtcaacgtgacaagggactggttacggacatgatgagatgggttcggtttaggtcaagcacaaatcgcaaaattaaaccaattgaacgattagaaatctgactgtaatgaggggaaaaaatgccgccacaaatataacgattccgtaaaaatatacacacttgtgggcaataagatttggccaacaggaatcaagttacatccaactgctaaccaacctacaaaagccaccgataacatagtaagctaaaaacaatagcaggacaagcaacaaacaccagccaaagacgatccccgttgtacaaaggggatgatcaggcttctccacgccgttgcaacggccgagggccctgtcgaaaccctcctgcgtcgccatggtcacgaacccaaaccctcgcgatcgccccccgcttgtcgtacgcgaccctcgccggcccgcaccaccttcccgtgctcgctgtacatctctcgcagccggcagctatccacctgcggcgacaggtcgctgacgtggatcctcaggtctcgctgctgatgctgccgccgctgctgatatgccctagcggcggcgtcttcttcctgttcttctgtcaggaccggatcaacaatgcagggcaatggcaagaaacacatgcacctctcgttgttccatccggcgggcagcgtttccaccagcgtcgccgctgccgtgccgccaccggcggcagttcggcggaatacagatcgagcgcgtgcacagctgcatacacatcgaacgcgtgcaccgacaccgagaggcggtcgtcgtcgtcgtcgtcctgcagaacgctggccagcagcagttcgccgcgaagctccaggaggtagctgtgtcggcgcaccttgcggggctcgtcaggtagcggcataggggcgtgcggagaagccagaacagtggctctttgtggatgtaacagttggccaagtccacgctcacggtggcgccgccgtggtaggcgtgatagataatctgtccggagagcgccacctcggcgacaagcggtacacaaggaggctgccgtcgccggagacgacgcagtggaagaagcccttgctgccatcggtccacatccatggatacttcttaacccggccgacgttgatccagccggtcaaagggttgactagcttgtcgttgatgaaccaggaggccgtgccgtcggcgtgggccaccctcctgtcgcggaagcagaggcccggcgcgtggtagctcgtcttggagaagacgcagcggcacgccacgccggcggcggcgtcggcgtcgtcgccggacgacggcgcgggaagccacggcagcaaggcggcggccggcggcggcgaccgcggaatatggcgtaacgattggcgccaatcagagcagacggcgtggaaggcgaccacgttgatggcggtgtggagacggcggccgatgaggcaaaccagctccggtggaggtcggacactgacgtcatgatgtaggtatatacctatcgatcgatctatctctcccccggagggccggaacgtactgcagctcgatcgatctttgatcaagacgtgcacgtgagtacgtacgtaataattaatcgtggtcgtaatattgatcgatctgattatattgctaatcaatcgtcgtcgtaatcgatcaatctgattatattgctcgatcaggccgggtgaagactgaagagtcggactccgactccgactcggggttttcaatttcaaaatttaattttatgtcggggtcaccaaaattttagaaatttctagccgaaattatttgaaaatttgtctgaatttaaatgaatttgaataaaatttgaccaaattcataaaaaattacaaataaaacaaataattcgggtgagatttgagcttgccggtgggggcggagtttctgaaatttcaaacctgctccgaatcaacaagagatcatacacatggagaaaccaactttcgacctattgcattgtgattataatcaatgcacatgcataaaaatcatcaattgtgaaaaaaatattataaagtttcataagaaatgtaatttgaaatatttaataatctcctaaattttcatcatcgcctcctgctcaaaggtgagtcattagcccatccgccattcctcccatgtgtcccgagcatcgtccacattccacatgtgtatagcgtacaaattgccaagcacaaatatacctttgtaataattgtccacttatcctatcttactataaatataaagtactataaagttatctcctactaactccttaagcttaacatacaaagatgccacatcatcatccactaacaagatgccacatcattatctactaatccactaattaacaagatgtcacatcatcatccactaacaatcatcacatttaaacatcatgcaaacatgttatattatctataattctatagtatttataatttaagagcttttaaaatacaagcatgttaaattatcatcccacataattcacataatgtttcaatgtatatatttactatgttttataatatcctacatatttatatagttcattctcacttagtgcttaaatgattaatctcctttttttcctctaactccttaagcttaacatgcaaagatgacacatcatcatccactaacaagatgtcaaatcatcatccactaattaacaagatgccacatcatcatccactaacaatcatcacatttaaacatcatgcaaacatgctatatctttatagtttttataatttaagagcttttcaaatacaaacatgttaaattatcatccaatataattcacataatgtttcaacgtatatctttattatgttttatgatatcctatatacttatatagttcatcctcacttagttagtgcttaaatgattaatctatggtccaaattatctttctcctttttttcctctaattaaatcatatcacatcaattgtttttgcctttagatgattaatctacggtccaaactatctccttacttttcttcttccataaaatcacgccgccttagtttttcgtttgaatcatcattctacacactatttaaatttaaattattataaaccacattaatttacttaatctgatgttatctagctatcttacacgttattttttttgcggggtttcacctagtaatcatatatacttgggtgttttgataaatcgttaaggtcaaacttnnnnnnnnnnnnnnnnnnnnnnnnnnnnnnnnnnnnnnnn

SEQ ID NO: 35727 - DNA, 879 bp, Oryza sativa
  unsure (1)..(879): unsure at all n locations
cgacgaaccaggaggccccgccgtcgtagtgggccaccctcttgtcccggatgccgaggccgggggcgtggtaggtcgtcctggagaagacgcagcggcacgcgccgccggcggcggcggtgtcgtcgtcgggcgtcggccatggcgcgagaagccacgggaggaagctagggcgccgcggcagatagcggagcgcgtcgcgccactccctgcagacggcgtggaagcggacgacgtcgacggcggcgtggaggtggccggcgatgcaggggagcagctccggtgggaggtctgagattaacgtcatgatgtgtatcgatcgatcgatctcccgggaacagcaactcgatctcgatcaaagacgtacacgcgcgtgcctacgtaccaatcgtcctagtatgtaattggtcatactctcatcgtaccaaaatacaagaaactaaacgtaaacgggatggattctaataacttgattggacgtccacctgtttatttattgcatatcaactagatggttacgaaaattttttaaaacaattgataagataaatcaatatgtaatatatcactccacaaacatcaaagttcaaattcaacttctacaagttgtaaaaaaaacaacaaatttaactgtcaacatacatatattaatttgagttttgtttgttatttttgttacaatatgtagaagttgaattttagcttgcatgtttgtggattgatacattacatattacatattacatattacatattgatctatcttattcatatttttttaatttttttcataactatttaaatgatatgcaataaactagtggacatnnnnnnnnnnnnnnnnnnnnnnnnnnnnnnnnnnnnnnnnnnnnnnnnnnn

SEQ ID NO: 35728 - DNA, 782 bp, Oryza sativa
atatgtttttagaagaagaagggcccttgaggaaaataatagcagtattgtacaggccaattcaattaagatacaaacaagttaatagtaagtaacatgggaaaatcagcagagagtattaccacacatgtgaatcataactgttgtttcggttatctcccattacaaaaactgagttctcaggtacttgctgtcatgaaaaacatagtatcaacaaacacaaaaatataacccagaaaagaatcatgttcatttttcttctacaaggattgaaacataaatcaagtatgaagtgttgttgacaacttcatgttcatgcatatgtacagaatatgcacacagcacacaacacaagaaaccatacacaataatgtatctataaatagtggtaaccatatctatatccacctaggtgtggctagtgagcactattcaatagattctatagaaattttatgtcttcagcttacttggaggtataccacacgcaaaatgcaagtttttatatgtaattcgtcatgatatacgtctgattattaatgcagataaagtatttaaaaatcagtaacagtaagggatctaatcaagattgtttcttcaaatgtctccattcattccactgacacatccacatatgtagtgtcagtgaatcaaaactaataaaccatttgtgttttcttaatcctcttattgctcatcagccttaactggggaatgtggttcaaactatatttggttggttgttacattattgagctcatgtatcattcatgggtggctca

SEQ ID NO: 35729 - DNA, 1145 bp, Oryza sativa
  unsure (1)..(1145): unsure at all n locations
nnnnnnnnnnnnnnnnnnnnnnnnnnnnnnnnnnnnnnnnnnnnnnnnnnnnnnnnnnnnnnnnnnnnnnnnnntgcgatgcactggcgactgcgagcagcaccaacacgaacgctcgagctggggccatgtctgtcgtcatgatcggataactctgtaactaggcccttgagacttgatgaccgagttaattatctggagctatctatctctgaaagcaacactgctctgttgctttgtgttgatcttctatgtgatgtctgtttgcttggtgatctcctgatgattggatgggtatatatagccatcgctcggtcattgttggattgctgcattagtggctaatgaaatcccaataatgaagtagtgtgaactctggaaagccacgggacgaagctagcgcgcggcgacgcgcatgtgcatgcatcgccggccggcgcagccgcagtactactataacttgctcgccaattaatccgaagaaatgtgtgtccgccggccgccgcagacgtaagtatgtcgcgcttgtattgctttctgttttcctccttgattggtgcgagataatactatataacaaatgaacgccttttgacgtttctctgctcttgttctctcctgcctaagcaacacgtataagtattgagtaatattgaacaatattatagaacttacctagatatgagtacagcatgttctgcaagaagaaaaattctagggtgtaaaaggtttacatgctttgatatcttcatttatatatctgctctcatttttaaattatttatcgttttatatttgtaccaagttaaacatttctaatgttgaccataaatttatattgttaaacaccataaggtttttttattcaccgtgggaaatatttttactagtttatttattgttaaattttatataaattgatgacaggacaaagctaaatctaaaaagataaagtaattccaaaccgaagaagaatatttggttgctactggcatcaatccgaacataggtgcgtgtttgcaattgcacccatttgccatggcggacaaggattttctatacttggtacaatggtattcattatttgcatacgacttagaacggtcaaagaaaatttacattaattgaaatcttataattctaaa

SEQ ID NO: 35730 - DNA, 552 bp, Oryza sativa
agggggtggtaaatatgcgggggaaagaggggcaaggatgatactctagcctctttccacgccggactgacaccgctccagccgcgcacgggtgggcagctcagctttgtggggggcgaaaaagaggagctttcccttctacttcttctctttctcctccctcggtgatctgcctcgctgggcatctctaaaagcatccgactccgacgccaccaccaccagttcaccaccgctgaaagaatcagcagcagcagcagaggccacacgaggagatgaagaagtgcccgtcggagctgaacttcgaggcgttcttccacggcgagaggggggaggacgacgccgacgccgccgccgaccaaaagcccggcggcggcccgcacccgccgccgttcgccatgttctccgccgccgacctctccagcttcggcttcgcggactcggtgacggtgagtgattattttgttgatcatgcttgtgcttgattaaaagagtggagtactacttgctccctccgtttcgaaatgtttgacgccgttgactttttagcacatg

SEQ ID NO: 35731 - DNA, 767 bp, Oryza sativa
  unsure (1)..(767): unsure at all n locations
cttttgcctgcaacgaggcttggaggctggtgaccgcggcggacgcatacgatggcgggcgcaggagacggtaacagcgacggccatggcggacaaggcggacgcaaactgcgacgacggcgaactcaggcgatgacagcggccacgatagctacaacggacgaggcggatgcacgcgacgatgactgctgcggtggatgatggcggacgcaagcgacggaaacatatgcagtggaccagggtgccggccatggcggactacaatggataggcgacaacaccgatgacgacggctgcggaggatggggccgaagttcgcggcagatgccgaaaccgacgccgacgatgaggcggacgtcggcggtgacgccggctgtggcggacgctggcgatgacgccggccgccgcgaacaaggcggacgtacggtggacgacggtgatgggtgcggcggcgattgcgatggacatagtcacggaccatcgctacaagcgggccccacaaccttgggccgcgcgtggagcctcgcgctcgcgctccaccgctctttcttccatgaaatcgcaaaatcctagctggagcgtttatcgccggttattgtaccgctcttaaaattttttactccctccgtaaaaaaaagtatgggacactgttaatttataatataaaataaaaggagtatttataataagttttcgatgttttgggaaaacaacatcatataattttaagatgtannnnnnnnnnnnnnnnnnnnnnnnnnnnnnnn

SEQ ID NO: 35732 - DNA, 493 bp, Oryza sativa
  unsure (1)..(493): unsure at all n locations
nnnnnnnnnnnnnnnnnnnnnnnnnnnnnnnnnnnnnnnnnnnnnnnnnnnnnnnnnnnnnnnnnntgagccactccggcagcagccccttcctcgtcccctcatcctcctcgtcgtcccctccgcccccgcccccctcccctcctcctcccccgccgcggctgctgctgccgtcggggcccaccggcggcgcctcggccggcgccgcggcgggccgggcacgcctcctgaggaagaggcgcgggaagagcaccggctcgttgtctccgccgcggtggtacgcggcggtggcggcggggggttttggggggggtttggtgagggggcggcgcgacggggccgcggcctggaaggtggccgggaagaagtggatggaggacatggctgccggaggaggaggaggaggaggaggcgatcctctcgacgcgcgcagcgcggcgcctctcgccggcgaccgcggcgaggcggtggtgggttgggttgggggatggaa

SEQ ID NO: 35733 - DNA, 569 bp, Oryza sativa
ctcatcttaaatagagagacatttatgactctctattgaccggttaaaaaggtgggcggactaccacgtgcgcgcgcacgcgttggctgggccaagcccgtggcttccgtcgtccctagctttgatctcttacgtgcaaaagagattgggacgagtagagcctccgaaactctgtccgtctgagttcctgcacgggtaggcgggcaataaagtttttgcggagcgttcttccgtctgagttcctgggtctgagttcctggttcctattcatcaacgccaacatgtcgacagacgacaacgccaacggtgcagctggaggagatgtcagcaatggaggaggcggtgcagggaacggctccatcaacggaggcaactatgcctcacactccagcgaaggaccatttttagagtatgtctctattcccaacacgctaatttctgatatactactattaagcgtaatgtttttataacaatgccatgtgatgaatgtttatgcttattctatattaagcatgatttgtatgttgctcttgattagtattcacactagtttattccctaaaaat

SEQ ID NO: 35734 - DNA, 546 bp, Oryza sativa
cccaaggacgatcgtcgttggagcacttcatcaaacaggtggtgggcgtcgaagaaggtggtgcctggagtggaggatgtgatgcagccgtgaggacagtagtggtcgccttgatggaggcgctcatctcctcgaagaacttgctcctgttagcttctatctcattcaacttcttcaaaatcagatcgatcttctcctctagcctatgattggcctccaagcactcttggtcactcatggtggaatttggtgggggaatggtggctctgataccagattgttaggatcccagttatctcgcttggaacaatagcaaactcagaagtagcagtgcgaatccaatacaagaagccactgatttctattacaatagtggaaggttttgaggtggaaggtggaaggatacaaggggctaaaagactctagaagctaagcaaaggatttggaggtaggaggagaggtggggaaggagattgccaaggttccaagcccagaaccaggacgccgccgtcgttcgctgtcttgccacctgattgatcgatcctg

SEQ ID NO: 35735 - DNA, 1453 bp, Oryza sativa
agcagctgatggttttaattagtgttcatgttatttatagtagacactatagttaatatgtacgataaagaaattttatgtgaactgcgatattttattattttcgtgggtcccacaatcttcttctatctcttctctttctttcttttttccagcttctcttcctttctttaccttctctttgtttcttttgcctgcaacgaggcttggaggctggtgaccgcggcggacgcatacgatggcgggcgcaggagacggtaacagcgacggccatggcggacaaggcggacgcaaactgcgacgacggcgaactcaggcgatgacagcggccacgatagctacaacggacgaggcggatgcacgcgacgatgactgctgcggtggatgatggcggacgcaagcgacggaaacatatgcagtggaccagggtgccggccatggcggactacaatggataggcgacaacaccgatgacgacggctgcggaggatggggccgaagttcgcggcagatgccgaaaccgacgccgacgatgaggcggacgtcggcggtgacgccggctgtggcggacgctggcgatgacgccggccgccgcgaacaaggcggacgtacggtggacgacggtgatgggtgcggcggcgattgcgatggacatagtcacggaccatcgctacaagcgggccccacaaccttgggccgcgcgtggagcctcgcgctcgcgctccaccgttctttcctccatgaaatcgcaaaatcctagctggagcgtttatcgccggttattgtaccgctcttaaaattttttactccctccgtaaaaaaaagtatgggacactgttaatttataatataaaataaaaggagtatttataataagttttcgatgttttgggtaaacaacatcatataattttaagatgtagataatactttattataaaaaaaaatcggacaattttacgatggaggtagtactctattactcttcggacatagacaacgggatccgatcaccggcggctggttgcgaattcagtcgcggtgtggtgggtagcgcagagaatccaagggaggggaggtgtccacgtcgggtgatgcactccggccaagttggcatgatttgtccttgtccgctagctatgtcactccccaccaccttctcaccaaactccttttcatctttgttgccccttgtttacagcaaattaatttacctatgtttagcaaatctgtggcgacggcgcagtgcagaggccggtgtcttggccattcacaaatcacaattacttgaagcacaaagaaaccacactaaattatcgcctttaattgttcagaaacgtagtattcactccagagtaaaattcatttaccatatcccctatcagatgaaaacttttggaccgtttggtcacttacctgaattctccaggctctcaccaagtggatcatggat

SEQ ID NO: 35736 - DNA, 464 bp, Oryza sativa
ggcgaaaaagaggagctttcccttctccttcttctccttatactccctcggggatctgcctcgctggggcatctataaaagcaggcgactccgacgccaccaccaccagttcaccaccggtgaaagaatcagcagcagcagcagaggccacacgaggagatgaagaagtgcccgtccgagctgcactacgaggcgttcttccacggcgagaggggggaggacgacgccgacgccgacgccgaccagaagcccggcggcggcccgcacccggccgcgttcgccatgttctccgccgccgacctctccagcttcgggttcgcggactcggtgacggtgagtgattattttgacgatcatgcttgtgcttgaataaaagagtggagaactacttgctccctccgttacgaaatggttgacgccgttgactttttagcacatgtctaaccgttcgtcctatttaaaaa

SEQ ID NO: 35737 - DNA, 757 bp, Oryza sativa
  unsure (1)..(757): unsure at all n locations
aggcgtgaccaccacggcgcgtcgcgcttgtccgcgtgcctgctctgcacggcctcggcgtaccatgactgcagctcgtagtccgcctgcacggccttgtcgctcgggtagtaggccgccacgtacgcctcgctccaccgcgagatcgccgaccagaggcagcccatcggcggcgtacgggtattcctcgatgagcagccggagcccgtgcggctggctcgggtcctccacggccatgcctctgcacgacacaaccaaatgcccatttcactcctcgccggcgcccaacgaccaccgctgttgttttccctaaatccggccaccgccgctgccccaaaccccagatccggagtttcacgccgccgcccaaggctgctcttccgaccgccactcgcttgcacgtgggggccacttctctgagccctgcgccggttgctgcccttcaccgccggagtcgcgactggtgaccaccgttgcctcgccgcgccgagcgttgctcggcgcgagtgagaagagagcaagagagagacagaagaaagaaggagagcatgatgatgtgttcactggtagggtccacgtggatcctacgctgactcagctaccacatcagataaaatcggggtcaaacccaccaaaagacctgtggtgaacggttttataagttaaggaatgtcatatatctgtttttgtggttggggaacannnnnnnnnnnnnnnnnnnnnnnnnnnnnnnnnnnnnnnnnnnnnnnnnnnnnnn

SEQ ID NO: 35738 - DNA, 922 bp, Oryza sativa
  unsure (1)..(922): unsure at all n locations
ttttattgaatatcttaataattacaaacttgcgtacatgctcacttgatgctagctcaagatcgatcagataaccatcgagttctgatacgcattgaatcatcaatctagcacatcagcatgtaatgcaaaagtacgtgcttcaaactagggtagcccactcatggagaaggttgatgattgtgtatcgggttcgggccgctaggaacatcatgcatgattctgactcgagacgagctaggtggatgatggggaggagggtggtcattgtgtatcgggttcgggccgctaggaacatcatgcatgatcccaacacggttgccgcgagaaccggccgccgccaccaggacgttgccgtcgtcaccatctgccgtgccggagaaggaaggcggtggacgcgctgccgccacggccgccaccgccacggcgaacaccagagccatgaagagaaggcagcgccggcgctgggcgtgggtggtcgccatgagctacgaattcttgaagcttttgttatgatagtggctatatgcttgtgagaatggatgatttgctacggtggaatgccggcccgttatttataggcgggcgtggctgtgggaaggcgtactgattatttgcctacacatggtaagatattatatcgttgcatccctgtgattttgtgctcgatcgtcagctgtaaatgctgagaaatatgcatggcaccagatagcaggccggatatcacgaccttattaccatcgtttacacccgtatcagatacgagctgattaattttccatttatttggggtatgctgcccccttgattctctatagagattaaaacccctactacgtcaatgtcaattcaatgttcgtcgcaaaannnnnnnnnnnnnnnnnnnnnnnnnnnnnnnnnnnnnnnnnnnnnnnnnnnnnnn

SEQ ID NO: 35739 - DNA, 768 bp, Oryza sativa
  unsure (1)..(768): unsure at all n locations
ataggtttataatatcacggtagtacttttcgaggtaaatctatatatatacaatttcatttggttttaaactacacatttgagaaactttcgacggtttaaattttaaaactttgatcgaaccctactctaaacgtcaaatatttataaatgtgctttctccatcttaaaatatatagttcaactttgaacttaaaatggcagctatatttttttttagtgatagctatattttaaaacatagaaagttaattaagacgctgatcgggttagcggtggtggcagcggttattaattgacatgatgatgagtcatgggctcatcaagcatgtggagtggaagacatgcgtacacagatcgatgacagtaggcagttccttgtgcttgcggggggaggggactgaaggggatgccaatggccgttgagctcaccttgactcgcctgccgattgttgccaacaaccacaacctgccaagaacgcctctcgcaacctgattcccagctagccgctatctcgcaacctgattgcctgcaccgctagctgcacgtatggaaatacatattctaacttaatatcctttaactttaaaaggtttatatgtgagtcccacagattatggatccacatgccggcgatccatattacagaaccgacgtcggaggagcctctccttgaacgcacttacataggagaaaaatggcttggaaatggnnnnnnnnnnnnnnnnnnnnnnnnnnnnnnnnnnnnnnnnnnnnnnnnnnnnnnn

SEQ ID NO: 35740 - DNA, 740 bp, Oryza sativa
  unsure (1)..(740): unsure at all n locations
agatattcttacttcgggctgctgaaaccttgttgccgttctatgctatcatgcggatggtccgcatgattcagcagggccaacgacagnnnnnnnnnnnnnnnnnnnnnnnnnnnnnnnnnnnnnnnnctcaatggcttataggagcataatagtccgcagtcatgataccttctcttcctctgtttctgcaggatcaacggagaagaaacgcatcaaacttgcacagtatgagtggccaggagcagcaccagcagcttgtaattaatgttcactgaacaaatgaacttaaatgcttctacattggaaggtcacaggaatgtgcaatatgtgttgaggggaatatgttcaacatttgtaaaattttagtatatttgtagatagcatagtaaaaaccatgaatctgcagtctgatacagtttcgacttaccagtgccatggacgcctcaaatatgaatgaaggttcaaataagtgaagattgcaacaaaagaaaaagactatttttttcttttttcttttttcttaatttgtttgtcatgaccaagtattggtgtcaagatggtataaacccagcatttacagaaaactaagctaacacactaacagaactaagataaaattgagaaaataaagtacctaatcttgttcatccaatctaaaagataattttaccactggcagtnnnnnnnnnnnnnnnnnnnnnnnnnnnnnnnnnnnnnnnnnnnnnnnnnnnnnnnnn

SEQ ID NO: 35741 - DNA, 438 bp, Oryza sativa
  unsure (1)..(438): unsure at all n locations
cgagctcgggtacccatctagaaatgaaaataagattgtatagaagaaggttttggttggataaggagaagagggtcacactggtaatttgtttttttttggcaggtcagcaaaactgcgtgctgcggcacaagagtcgccggttttctcttgcacaagcagctgccgatatcctgcaggccgccggactggatagcaattagcaagaatgtacgcacgacaagacagactgacagacagagacctctctcctttgtgctcgcagcgtgacggcgaagtagaaatatctacccacaagggcgaacgtaagattttgaaagtgtgggtattcaagatttatattacaatattttaagatacatatttatgttatatatgaaaaannnnnnnnnnnnnnnnnnnnnnnnnnnnnnnnnnnnnnnnnnnnnnnnnnnnnnn

SEQ ID NO: 35742 - DNA, 696 bp, Oryza sativa
  unsure (1)..(696): unsure at all n locations
ctatagggcgaattcgagctcggtacccatgtagcggcaatttaaaattccaatcaaatttgttataaatatcaaataatatttctgaaggaagggttatttgtttttactatgctttacactggtcatctaaacattggtgtttgatgaatatgtgcccatgtaggctcacacgtggcggtaaagcgtccgggttatccgaccagcggagcagctgggcccactgtcagcctcacgagggtgttttcctctctgctaatcgtctgggctggaacaaggctgatggcctgattgattgctgctgttcgagcagcttttgactggacacaggcaaacgttgctgaagagttcaaagatgtgttgtgttttctttttaatttcctgaatagtgaatagtactgtagcatattgatattgatttctacaacccacgcaccagtgctgatttcatgtaacaacaatctgtaatttgtacgtcttttgatttgatgaataataaatttgatgcgtgtttgtttccttcaccttaatatcgacggttgagaaccggttttcttgatcgtccattcaggtcgaaaagtcgaattgatcttgtatttttgtattgcaatatgatannnnnnnnnnnnnnnnnnnnnnnnnnnnnnnnnnnnnnnnnnnnnnnnnnnnnnnnnnnnnnnnnnnnnnnnnnnnnnn

SEQ ID NO: 35743 - DNA, 539 bp, Oryza sativa
gatttgtccagatgtgaactcttacacagtgtttattaatgggcatatacgacatggtagacctgaggaggcatgtaaatacattgaagagatgatccaaaaagggatgaagactccacagatagactacaataagtttgctgcagatttctccaaggctgggaagcctgacatattgtatgaattggctcagaaggtgaagtttacaggtaaatttgatgcgtctaatgtgttccaccagtgggcagagagaatgaaaaaacgtgtcaagaggaatgtccctaatcagactgagagcaggacgttctaagattaccatttgccagcagaaatgtggatctctttgatggtggctgaaatttgaggtgttgctcctgctttttaggagaaaggtgctagttgttttctgtgttgtatagtaatggtccatgaaatattagtgtgttttcatgtgtgaacaaaatgattcagttaattatgatgtagcctatggtagttttattttagttcagtcatgtgttacgctaaatcttcattca

SEQ ID NO: 35744 - DNA, 702 bp, Oryza sativa
ttcaacatttgtaaaattttagtatatttgtagatagcatagtaaaaaccatgaatctgcagtctgatacagtttcgacttaccagtgccatggacgcctcaaatatgaatgaaggttcaaataagtgaagattgcaacaaaagaaaaagactatttttttcttttttcttttttcttaatttgtttgtcatgaccaagtattggtgtcaagatggtataaacccagcatttacagaaaactaagctaacacactaacagaactaagataaaattgagaaaataaagtacctaatcttgttcatccaatctaaaagataattttaccactggcagttggagaagcccaagatatgatcagattgaaaaggcacccacacatgacacttgaaagaaacaggttgcatcagtcatgagacaagcaggattcaattcatgcgtctttcgtaaaatctcagctagatttgagaagccagagcaatccgatatcctgaatggatgctgtcccattatcttgatataaattaatatgagaaatccattacactaatccagattatatttcagttaccaggtgtgtttattttctttaaaacaaacgtatatactgtctgtacaagggaccatcaaagaactaaaataatgcccattataccaaataagtcaatttcaacctgatgcagtttccctgaaaaaacgcata

SEQ ID NO: 35745 - DNA, 592 bp, Oryza sativa
cacttgatgctagctcaagatcgatcagataaacatcgagatctgatacgcattgaatcatcaatctagcacatcagcatgtaatgcaaaagtacgtgcttcaaactagggtagcccactcatggagaaggttgatgattgtgtatcgggttcgggccgctaggaacatcatgcatgattctgactcgagacgagctaagtggatgatggggaggagggtggtcattgtgtatcgggttcgggccgctaggaacatcatgcatgatcccaacacggttgccgcgagaaccggccgccgccaccaggacgttgccgtcgtcaccatctgccgtgccggagaaggaaggcggtggacgcgctgccgccacggccgccaccgccacggcgaacaccagagccatgaagagaaggcagcgccggcgctgggcgtgggtggtcgccatgagctacgaattcttgaagcttttgttatgatagtggctatatgcttgtgagaatggatgatttgctacggtggaatgccggcccgttatttataggcgggcgtggctgtgggaaggcgtactgattatttgcctacacatggtaagat

SEQ ID NO: 35746 - DNA, 581 bp, Oryza sativa
  unsure (1)..(581): unsure at all n locations
aatttgaaaatccatagttttaacgtttccagataggggtatgaagggatttttcagcatatataatctaaagaattttacgatccttgcattggaagtatcatcactccatctgttgggtcctaagtaattaagtanctgtatttatctgaccaatccaggcaaagaaaaggggaagcaggtggtggtggtgcagtagttccagggacacagaatgcaatccagattgtggcacaagctgctctctgctttgacaatagacaagtaagttccattctcttctcttcactttgaatttcatcatagaacatttctatggatccagagattcttactgaccaaaaactatgcagaatgaaagtgactgagtgcgtggcatgcatactgtgagatcaatgcaaaaggcactcttcagtgaaattatattagttcaaccaattgggatgtataatggccttgaaacattaatttaattagggtgtcactgtgtcactagtgcaaaataagcattgaccttcannnnnnnnnnnnnnnnnnnnnnnnnnnnnnnnnnnnnnnnnnnnnnnnnnnnnnnnnnnnnn

SEQ ID NO: 35747 - DNA, 627 bp, Oryza sativa
gtatagtttatgatctagatcagtgcatatagtttatgtgcgggtgtagtacataagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaaattgctccaggctggtatcagagccgccttgtatagtttatgatctagatcagtgcatatagttgatgtgcgggtgtagtagatgagatttattatgttgtatataaggtgatcggaacatgagatgaaccgatggtcacccatcccaaattgctccaggctagtatcagagccgccttgtatagtttatgatctagatcagtgcatatagttgatgtgcgggtgtagtagatgagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaa

SEQ ID NO: 35748 - DNA, 620 bp, Oryza sativa
ttggggctgaaggtcaatgcttattttgcactagtgacacagtgacaccctaattaaattaatgtttcaaggccattatacatcccaattggttgaactaatataatttcactgaagagtgccttttgcattgatctcacagtatgcatgccacgcactcagtcactttcattctgcatagtttttggtcagtaagaatctctggatccatagaaatgttctatgatgaaattcaaagtgaagagaagagaatggaacttacttgtctattgtcaaagcagagagcagcttgtgccacaatctggattgcatcctgtgtccctggaactactgcaccaccaccacctgctccccctcctccttgccctgcattgttcagataaatacagttacttaattacttagaaccaaacagatggagtgatgatacttccaatgcaaggatcgtaaaattccttcagattatatatgctgaaaaatccctcaatacccctatctggaaacgttaaaactatggcattttcaaatttaaagctgatcatttccaaacaagaccaaagtaatacttttgaacaaaaagacaagaagccatgcatcccatatgttaattaaaagtggat

SEQ ID NO: 35749 - DNA, 1004 bp, Oryza sativa
  unsure (1)..(1004): unsure at all n locations
acgatcgtcaacaatgctaaaatatgtaagctccaattcattcgccgggcaagctccttaattttttataagacaaaaagaaatatctaaaaaaaattaacgatcaccaacaacgctaaaatatgtaagctccttaattcattcgctgggcaagctccttaatatgtaaaacatttgcttgactcgtcatccaaaatagagtatggacctccgatagattggcaacctgtgggtagccgaatggctccgtctgcccctttgtcgaaggaaccaggaaacggccctccacctcctggtggagtgtacatacgtgaagagaatctgggcggcactcgcagactggtcggcatatgaacagataagaccaacatcgtagcaacaagcctcgacactactcaagtggtgggaggccaccgcatgtaccaatgaagtgccaaagaaggccttgtggactataatgctattagtcgcttgggagatttggaacgaaaggaaccacagagtcttctagcaccaagagctcacggtggctagtctgatagccaaaattaaggaggaggccaaaacatgggtcttggcgggcgcaaaacatctcggcaggtggcttaccttctaacatgttcgggccaaaggccttgaacctgtaaagttttctttttgcgctttgcgtatgtacagttttactccttctctgttcaataaaattggcggctcgccagttcattaaaaaaataattgatcgttgtcttgcagcaggcatcaagttagtggcggacagatgactgcactaaaattgtagcgaaaagtttaaaagtttaccaattttttgttaaaatattcttttagaaactatgacatacattctagaaaaagtgtccgtgtgttacaacgggaagaaaagacgagaaaattgaggaaagattgagaaagatttacattatcaaattaattaaaatacatattttnnnnnnnnnnnnnnnnnnnnnnnnnnnnnnnnnnnnnnn

SEQ ID NO: 35750 - DNA, 698 bp, Oryza sativa
  unsure (1)..(698): unsure at all n locations
taagatacaaaagcagtggttgttgagagtcttctctctactctatcaactataggagcaaaatcaataatcttggtcttgtggttccaagaggaagacccagataagtaaaaggtaacttaccaatagagcaaccaagcaattttgagagatgatcaactttttccaaatctacattcagaggaatcatgcatgacttactatagttaatcttaaggccagttgaagaggcaaaagtgttcaaaattgccttgagacagaaaagctctttttgggaagcagtcaaaaaaagaagagtatcatatgcatactggacaatcggaaattcattactaggtgttgggattggcattgtaagaactccctaagaacaagctttattgactatagattgtaacaagtcagctccaagaacaaataataagggtgaaagtggatcaccctgtcttacaccccttttgcaatagaaggatttgccaggaacaccatttaggataactgaagaagaggctgaagaaaaaatctgagaaatccagcttatccatttaggatcaaagcctttctgcctcatgatgtccaatataactgaatgttcaatagtatcaaaagctttctcaaaatccaattttaaaagaactannnnnnnnnnnnnnnnnnnnnnnnnnnnnnnnnnnnnnnnnnnnnnnnnnnnnnnnnnn

SEQ ID NO: 35751 - DNA, 557 bp, Oryza sativa
  unsure (1)..(557): unsure at all n locations
nnnnnnnnnnnnnnnnnnnnnnnnnnnnnnnnnnnnnnnnnnnnnnnnnnnnnnnnnnnnnnnntctaaaaaatagtaaaaagtatagatataaaacgatgaactgtatcggagtattgtattccttatattacaagcagcagaagcaccatagaagcggagaagagcatgagcatctgcagcaggctgtagcgaaggcctaggctgctggcgccggcgccgtagcagtagtctgaagcaggaagcgtactagtcgtagttgggtattcgccctcctcgctgccatagtacccaccgtattgctgctccgtcgtctgctcgtggtggctgtagtggtagtactcgtcgccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35752 - DNA, 754 bp, Oryza sativa
  unsure (1)..(754): unsure at all n locations
gcggcgggtggtgtgtggcggtggacgagagcgaggagagcatgcacgcgctgtcgtggtgcctctccaacgtggtctccgccgccgccaagtcccccgcggccgcgccgccgccggccgtggtcctggtccacgcccggccggcgcggccgctctactacccggtgatcgacggcggcggctacgtgctgacccagaaggtgatggacagcatggaccgctacatggccaccgccgccgactccgtcgtcgccaaggcccgcgacatctgcaccgccttccccaatgtaacttagctttctctcaactccaaactttgacattctcgttttccgttagcacgttttttagacggttaaattatacgtttctaacaaaaaaaaacttctgtctagaagttatttttagaaaatctaattattcgtcttttaattttataataattaaccatgtgctaacgagttttctcaatgtctatgttaataatatccattcaattgccttaaaccaacgggccttacaagcggaggattttttttgactttaccattcaattgccttaaaccaacgggccttacaagcggaggatttttttttcctaaagtcaattacatggaagacgtacacacacgaatcacacttatggtggtacgattgactgatcatctcgtctcctctgatgtgcaggtnnnnnnnnnnnnnnnnnnnnnnnnnnnnnnnnnnnnnnnnnnnnnnnnnnnnnnnnnnnnnnnnn

SEQ ID NO: 35753 - DNA, 990 bp, Oryza sativa
  unsure (1)..(990): unsure at all n locations
nnnnnnnnnnnnnnnnnnnnnnnnnnnnnnnnnnnnnnnnnnnnnnnnnnnnnnnnnnnnnntttcactcctcgccggcgcccaacgaccaccgctgttgttttccctaaatccggccaccgccgctgccccaaaccccagatccggagtttcacgccgccgcccaaggctgctcttccgaccgccactcgcttgcacgtgggggccacttctctgagccctgcgccggttgctgcccttcaccgccggagtcgcgactggtgaccaccgttgcctcgccgcgccgagcgttgctcggcgcgagtgagaagagagcaagagagagacagaagaaagaaggagagcatgatgatgtgttcactggtagggtccacgtggatcctacgctgactcagctaccacatcagataaaatcggggtcaaacccaccaaaagacctgtggtgaacggttttataagttaaggaatgtcatatatctgtttttgtggttggggaacaataccttcggtgtactttttccttttgagaatgatttatatttgtattatttttatgtggcacttaataaatatgtttatatccgtggataaatatgttctattttttttgaggaaaaagatgtggtaaatatgattaacaaggtcaactcctttcttttgcattgtactattgaagagttgtgtatcatattgcaatacaaaaatacaagatcaattcgacttttcgacctgaatggacgatcaagaaaaccggttctcaaccgtcgatattaaggtgaaggaaacaaacacgcatcaaatttattattcatcaaatcaaaagacgtacaaattacagattgttgttacatgaaatcagcactggtgcgtgggttgtagaaatcaatatcaatatgctacagtactattcactattcagaaaaaaaaaaagaaaacgcaacacatctttgannnnnnnnnnnnnnnnnnnnnnnnnnnnnnnnnnnnnnn

SEQ ID NO: 35754 - DNA, 1061 bp, Oryza sativa
  unsure (1)..(1061): unsure at all n locations
nnnnnnnnnnnnnnnnnnnnnnnnnnnnnnnnnnnnnnnnnnnnnnnnnnnnnnnnnnnnnnnnnnncttgtcgaaaactaaaagaagttaccggatcaatattcttcgctgcgagagcttggcttcactgtccgcaacaacacttgaaagattacttgtcagggactatgacattatggtgtctatgattcctcttccatattcatcagtacttctacccagcactgccggcctagtacattttggtccaccttcttactcttccatgacaccttggatgaagcttgcactgtatacatctgggagttgtggcccagtatctgctgtgtttatgaaaggacaccgtttgaggatgctgcctgaaccattagccagctgcgaaaaggcgttgatatggtcttgggatcaatctgtggtgggtggattaggaggaaagttcgaagggaatttagtaaagggaagccttctgctgcattacctgaactcaatgacaaagcattctgctgttatagtgcagccattgagcttaaatgatcttgatgaaactggaaaccttgtcaccgttgatgtcccgttacccctgaaaaatgctgatgggtcaattgcatccacagtagccagcatggatttacctgaggagaaaatattaaatttgtcttcgctattatataatctgtccagtagagtcgagttgggcacagttggttatcttagtttagttaggcttcacaggataagcaaatccaatgaaattttctcaaaggatgaaaattatgagtggatacctttgagcctggaatttggaattccactgttcaatccaaagttatgtgaaaaaatatgcgaaagggtcatcgagtcacacatgcttcaaaaagatgacctcactgaacattacgaggcaatgcagaatgtgagaaagaggctgagagaactttgtgctgagtaccaagcaactggtccaacagcaaggctttttcaatcaaaggggcagttcaaagaactcgccgcgccaactaatcaacattgtcagtggcagatggagttcatttcatgacac

SEQ ID NO: 35755 - DNA, 686 bp, Oryza sativa
cattaataaatggctacacagatcatctcatcaaccactggttgttagtatgctaatcctgtctctcattgcatgattggttggttccttggttgaaaacagagtgttacctactgatttaagactccgtttaagggcatgtacagtgctacattactggtgttgacagttcacagttgcatgatactactagccagataggcttagattagaaacaccttatcctaagagcattatcttaatgatcttttcctatcagaaattgacaatgcaagagatggaggaggtacctgacagtgactgccgtttcaacaacctgcactttcttgggagggatggtgtaatctgactcaaaattctgtcaagaaaagcatcttgtattattaaaaaaacaggattatgcatgaaaaatctttcagaatgtcttatttaggcggctagtgtaatagtttatgaaaggttggcaaaagtttacattttgcacaagaaaagtgcactttgcttatgattagaagcattagctaactttcttttaaccccaaaaaaatctgtaactttatcctctaaacataatgttgcaaagctacacataattcctactcatatatatacaagaaaaaaggagctagctgtttggcacctttcctgcacaaatttcacctttctagctaaccccaataaaagtg

SEQ ID NO: 35756 - DNA, 727 bp, Oryza sativa
  unsure (1)..(727): unsure at all n locations
nnnnnnnnnnnnnnnnnnnnnnnnnnnnnnnnnnnnnnntcttaggatttattttgttttcggaaatcaattcaaatgtcctcgctgttatgttgaaattgaatcctgttgccttgtttccgcgttcttacctgggttctttgtaaattgcttttatagatggacccaaagttcctcaggaaccagaggtactcgaggaagcacaacaagaagagtggtgaggctgaatccgaggagtaaggtggaggagccttttggttatgaatgtttcttgtatctctggatctacagttttgaacctatttcactgttctgtaagggcaaaggagattactatggtacttaagttttatcatgcgtagtttggctctgtgcaacccagttccatgctgttggattgcacctgaaatattatcttctataagaattggttatccatttttaaggttgtcttgtttgcattagcacatctcaatattttgttgtgatgcctggatgactggaagtgcttcttgactgcttacagctcgtgattcgtcagaatgtgttatcttttttgtctttctgagtgtatggtattcgtggatttacatgcttatttgaattatcatccccaatccacccgtgtagttaccttggatgtgatttgtcattcactctggttgctgattagcctttaagaacagattcaactagatggatcccaaagcttctgctgggtataaac

SEQ ID NO: 35757 - DNA, 674 bp, Oryza sativa
  unsure (1)..(674): unsure at all n locations
nnnnnnnnnnnnnnnnnnnnnnnnnnnnnnnnnnnnnnnnnnnnnnnnnnnnnnnnnnnnnnnntgagtcatgcaaagctacaaaaatgcatcgatctattcccaactaatggtacacgcacttgcacttggaaagtgagttgggaatgcattatttttactgtaggaatgactgtagaaggggataacgattcttttgtaagacacgcggcacgatcagatttgttatggtaacgagacagatctggtttgttttttttttttaatcttgaatcttgacgagctactaaaagattagcttggcttgcctggctcggcgagccaatgtgagctatattgctagtgttttttttaaagggaaaattacaaaaaccaccccaaatatcactctgagtttaagatgcctccccataagaagatttgttgcaaatccccacctcctaattcatcttgatttgatttaagcacattctctccacatatgcgtgattcccgattcatcggcggcaatttcggattttaggatgacgaaacgacacgggtcggcctcgatcttcgtctttccggtctcgcaagtcgtagtcgcgggcagacaaagcgacgcgcaaatgtgcacgcgcctttgccgctgatcggtgattgcattatcgcacgcgattgaacttttgttggct

SEQ ID NO: 35758 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnnctaatcagctacataaaaataatttgtttatgtttgtgagaaaaaaaatacaaattcgtttttggaaagcttgcaaccgattctggtttccaacgaatattagccttactatattcgttttcgtttttgagaaaaaaaaatctaaatgcatttctgtttccgagaaaaaaaatccagattttggaaagtatctaaccaattccagcttttgacgggcagtagtcttcctgtattcgtttttgttttcaagaaaaaaaagaatttctaaatcgttgttgttttcaaagctttaaaagaaattccaacacttttcgttcgaaaaacactagttgaagccgaaaacttttcgaaccgtttgcaccctacgtgcgtacacgctcgatcgagagcattgcgtcgccaccaaaccatcggacttgggtccgtcagaactcagatcgatcgatcgatgcccgcagctaagctcccaaattaacctacctaggtcgggtacgttcgtgctacctgcctgtacgacgctaccaatcaaattggctactgatcatcaatagaatctactacatgcgtagtgacgcctagcttttctccaaacctcacacgagcctgcatgcaggagctacctacaaacacgaccagagcagagagtgcacaccaatgaatgccgacgcg

SEQ ID NO: 35759 - DNA, 717 bp, Oryza sativa
  unsure (1)..(717): unsure at all n locations
nnnnnnnnnnnnnnnnnnnnnnnnnnnnnnnnnnnnnnnnnnnnnnnnnnnnnnnaaaacgatttttataaatttattctagtataaaattacacattttggagtttaaaatgttttataaatcctgtctagaatgccaaatgcttgcatatctatcagacaatatattatcttgagttggggcctcatcgactacccaaaagtttattataaacaccgtaaaggcttattggcgattaaaaaaatatttttttataaaatttttatatgtattcttactatttaatagccaatactaaaaaaagtggtgaaaacatattaaaattaacttcaaattaagttaagtcaccaactacccaaaaatttattataaacaccgtaacatcttattggcgattaaaaaataatttgttttaatttttttatatgtattcttactatttaaaagctaatactgaaaaaaaagtggtgaaaacatattaaaattacttcaaattaagttaagtttcaaacttaaattttactttgacttattatttttttatcctttaagaccaccaacggggctcttgattttttttattacccatatatacgtgcagggacgtttgagattagggagcgtaagcagtgcggcgacaagtactaccactacagccaccaccagcagacgaccgagcaacaatacggtgggtactatggcagcgaggaaggcga

SEQ ID NO: 35760 - DNA, 972 bp, Oryza sativa
gcaatacatcctagccatttcatccgatgaacaaagatagaggcatataggaaactgtgtctcgagtgaatccatcttccattgcagcagatactttcatgatgacatgtacaaacaacaaacatgtctaaaagatgactctgacaatgtggatgcatattaccaggtattccatcaattttgtttccttcttggcccgaacctctgcaatatcccagcaccctttctcagccagcttcttcagtacactgcaaatacaatataattcagagatctataagattagtaaacattatagtagaaatattttgcaatttgcattgagcaaaacaaaagttacctctctttatacaaatagttaacatctgggaacttttctgtaaggtcatgttgttttaccaactcatttgccctctttagcatttttatatccagatacgtttggatgatcaaacatatcatttcattccccatgaaaactgcccacttctctgctgcctccaagtgattattttcaatcagttttgtaagaaaggactcatcataacattgaatagaaaatcgtgttatcaggttcacagcggtcacataagattctgattccattaagcattgtacatactgtttgagatgttcttttgctttcactagatcttcatcacccaactctgaaccatataatgcatcagccatatctctcaactcgatatcatatgcctcgagaagctttatcagtatgcgttcctcatggggcacaatagaagcaacaatatcaagaataagtcgcgcagcaagatgctttgcatctaagaaatctttctgtacagattccacagatttcaaatgccttagagaagagatcaacatatggctgaagccttcagcatgggttttccccagcagtggcacaatatacatgcattgaacaacatacgtgaatgggccaggatgaggatcattatttaataccct

SEQ ID NO: 35761 - DNA, 705 bp, Oryza sativa
  unsure (1)..(705): unsure at all n locations
nnnnnnnnnnnnnnnnnnnnnnnnnnnnnnnnnnnnnnnnnnnnnnnnnnnnnnnnnnnnnnnnnnttttataataattaaccatgtgctaacgagttttctcaatgtctatgttaataatatccattcaattgccttaaaccaacgggccttacaagcggaggattttttttgactttaccattcaattgccttaaaccaacgggccttacaagcggaggatttttttttcctaaagtcaattacatggaagacgtacacacacgaatcacacttatggtggtacgattgactgatcatctcgtctcctctgatgtgcaggtgaaggtggagacgcgggtggagaaaggggacccgagggatgtgatctgcggggcggtggagaaggccggcgcggacatggtggtgatggggagccatggttacggtttcctgcagaggacgctgctggggagcgtcagcaaccactgcgtccagcactgcaagtgccccgtcgtcgtcgtcaagaggcccggcaccaacgccaaggcctcttgatgcgccaactccgcggtccaggatgcaatctgtggaatgttgtgataatatgggtgtatgtatatagtggcctttgtgcagagttgtgtatgtgtagtagtacatgttttccttgtagtaacaagtaacaacattattgcactctctaatgtatatatgccaatgcta

SEQ ID NO: 35762 - DNA, 453 bp, Oryza sativa
gaggcaaagagacgccgccgccggccaccgcggctgctgctcacgcacggggcaagaccacggcggcgcagcacgtggcagcacggcacctggaccacaccttcgagaagctcacgtcggtgtatctcccgctcgtggcggcgacgccgctggtggacgcgctgcgcgcgttgcccgccgagctgctcgcgctccccgacctcgccctagagggattgtaattttgtttgggaccctggcttaagtggggcccatgtggggtgcatcctaaccaggtagagcgcgagtgcacgaccctagggacccctaaatcggtcttcccacctttataaaatagctaggtacctctccaggatttcttgggtttgttagattaaagtttagccattgctatttgcttgcaagcacgtgttggctagaccacccatctacttgttatttggaaccccaact

SEQ ID NO: 35763 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnccatagctccagagcgttatcaatcgccatacaataaattacgataacacaaggctgtgtcgatgagcatgcagcttctcaatatacaccatctgctctcgtaattatggaaacggtcagaatcggtagcactcgacggtagcacttgacgctcagtcgatctataattgactatatttatagtttagtttcaatatcaatatgacgttgaaataaattagaaaaatcaaattttatatatagctaaaatggtaatggctgaaaacaatacaacttgtaaggaaacaacgatcaggcggtcatgaaattccgtgaccattttcattttagagtgaattgtatattggaccatatctttttaccaaagttgcaacttggactagaattaactaaccattttcaatttgtgccagatatctttgcaacatatttcactttcaacccgctcttcttctctagcttctctctcttgctgctctctcctccaagaaccactgtgaaccactgaatctgagcaaggcagatcgagctcaacatttgccatgcccatacggagctcttctcgctgatacttggcaagaaagaataatgagaaaggtgaaaatctccatgatctgcacactcactaactggtcttgcaggtttcgatcttcatcctccccgatatcaagctttgcatccttcattg

SEQ ID NO: 35764 - DNA, 1157 bp, Oryza sativa
tttgttactaattttctacttctaggcagggaactgttcaatgtcattgattggtaataattttctcacatacgtatcacaggtctgaagtctcatgctgtgacactatacgaggccggaaagcttggtgattcttgcattgctgatctatgcaaggaccttgctagtttagaaggaaagaggtttgaaggtgtgctccaggaatttgcaaatcatgcttttagcctcagatgcttccttgagtgtttgctgtctggagggacatcaccagatgaagctattgaaccgaacagccaggaattctgcctgcaggagaatttctccaaaactttatccaaggaaagcattgatgagggcattagtaatgttgttaagagtaatggaggttcacttgaaaccgtcgacactgcagatactgatcatcataatgaactgtcacaagcagaccacccaatggttgactcagatgttgcagatgcgagtacatcatcaccctcaagtattgtctctgaaagtaaggaaagcacagacaaaaatgattctgatacgagcaaaacccctctaccagatggatcaactgacagtagttccttgtcgaaaactaaaagaagttaccggatcaatattcttcgctgcgagagcttggcttcactgtccgcaacaacacttgaaagattacttgtcagggactatgacattatggtgtctatgattcctcttccatattcatcagtacttctacccagcactgccggcctagtacattttggtccaccttcttactcttccatgacaccttggatgaagcttgcactgtatacatctgggagttgtggcccagtatctgctgtgtttatgaaaggacaccgtttgaggatgctgcctgaaccattagccagctgcgaaaaggcgttgatatggtcttgggatcaatctgtggtgggtggattaggaggaaagttccaagggaatttagtaaagggaagccttttgctgcattacctgaactcaatgacaaagtattttggttgtatagtgcagccattgagcttaaatgatcttgatgaaactggaaacctttgtacccgtgatgtcccgttacccctgaaaaatgctgatgggtcaattgcattcacaagagccagcatgggatttac

SEQ ID NO: 35765 - DNA, 7030 bp, Oryza sativa
  unsure (1)..(7030): unsure at all n locations
nnnnnnnnnnnnnnnnnnnnnnnnnnnnnnnnnnnnnnnnnnnnnnnnnnnnnnnnatttacctgaggagaaaatattaaatttgtcttcgctattatataatctgtccagtagagtcgagttgggcacagttggttatcttagtttagttaggcttcacaggataagcaaatccaatgaaattttctcaaaggatgaaaattatgagtggatacctttgagcctggaatttggaattccactgttcaatccaaagttatgtgaaaaaatatgcgaaagggtcatcgagtcacacatgcttcaaaaagatgacctcactgaacattacgaggcaatgcagaatgtgagaaagaggctgagagaactttgtgctgagtaccaagcaactggtccaacagcaaggctattcaatcaaaggggcagttcaaagaactcgccgcgccaactaatcaacattgtcagtggcagatggagtccatttcatgacacagtggcgccaaccactggaggatccccccgtgagaatgacagactgaaagttgcaagacggcagaaatgcttcactgaagttctaagcttcgacgggagcatcctcaggtatgttctatacataaaaagaactgcaccgcatagtgtagcggtaaagtgaattaaccgtccttcctcatcggtttaaacttttgggttgaactggcaggtgtatcagtatgcaactcaatacattgttcttgtgatgtataggttaatatgattcttgtaatgttaattttgccactggatcattccattctaaatttaaaactctaataggtcatacgctctcgcccctgtgtatgaagctgccacaagatctgtcactgaggaccaacccaccacacctgtagcaaaaccagaaccggatgatgcagacaccaaagatgtggtcttacctggagtcaatcttatatttgatggagctgagattcacccttttgacatcggcgcctgcctccaagctcgtcagcctctctcgttgatagctgaggcgtcagcggcatcattggccatgaaatgagagatccatccctggctgcaactttgtcttgttcatatgtttatttatacagaattgggtcttggataggacgcttctcaaaagcaggcagtttttaaagcttgatgggaagattttgtcatgccaaagtggttttttttttctcctccaaacaagaagttttctggattatttgtgatgaatgccaggtgaggttttcttacacaaatgaatcagctaatttgctgcgacatgacatgctctgttgaggtctacttgcattaggcaatagcacgttttgatgctttctggttgcatcctttgctagtttcaaaagttgttttttcttattcaaattggtatttgtgaataactcaacttttttctgatttgcagactaatgtttggagggatcactttagatgtttttctgtacttaattttccaacgtaggatcctaattaactgtatagttcatggtaacaggaattgtgcacattatcatttgatattggtacgatagaatacagatataatttgcacaaaaaagcaatcatgtatggtcaatatgtaattcttgaaatctgactgccgtgatccatttttttttatctgctcaatcctgccacgtccattttgctctctttaattttaaaacaaataacgagatgactgcttgctaaaatctctcaattgacggtttccatcaatgcttgagagtgtttttaattacatgttcctaatttatactccctcatttttttttcacgtgcccgcttaccaaactactcaaaaatactttttttcgaaaaaaaaatctaatagaaaagttgctttagaaatcatattaatctaaattttaagtttttatagctaatatttaattgttaatgcactaataagccaacctattttacatgcgtgagatagaagttcataaccttctctccctcccgaacaccactataaaaagtagacatccaagcctacatgagtttatgaaatggagttgtacttttttttttttagaaacagtacaaatatagacgctatgctcacttcgccagtagtaccatttctttgggtgaaagcttaatgtatgcttaccagcacaatgtatacctggttaccctgttactttgtgcttgccacctggttatgtaaaattggaatgtaattttataaggttgatttgagtaaagcgacctttatttggtctcctttgaaacacgggaatcttataaaaaataaaaataaaaaatagcaaaaatcttccattttagttggacgtatagataccgagttggcctgcatttgacaaacgataaaaaagattacacccatagctttgatcccatcccgtgcaattaaaatgtaggaaaaaaacataattgctaatcttctttgatagaaatttagagtgaatttccttcaaattttgtcacatgtttgctctatctggttagattttttttaaaaaaaaaacagcttgggcaagtgggccttctatttatctcagaagaaacaaagtacaagttgccaaatggtatatatgatttgtataggtacatactcttataacggtaaataggcttactgccatgtcaagatattctcgctaaataggcttcaaaatttcagcaagcgcggaatatgttgcatacttgttatatgaaacaaccattctactccctccgtttaaagttacaagacgttttgtcaaagtcaaactacttttaagtttaaacaagtttatagaaaaaagtagtaatatttttaacctaagacaaatttattatgaaaatatattcaattattaatttgatgaaactaatttagtattataaatattactatatttgtctataaacttagtcaaacttaaaatagtttaactttgacaaaagtcaaaacgtcttataaactgaaacggagggagtaactagtcaagaaggctgctatggtcttaggtgttgttcatttgatgatgcaactttgtgaaggtttcattccatacatcacagtgaccgagcactccaaaatcagatgtttagcgattttcaaattcttcatgcacagctaataggaatagttatttggccactggcccctcacatgcttgggtttcgtgggccgtcagaacaaagtcatctcaatcgggcctaaattaacattgttatagatgtactcgtacatacataatcgaggtgtatatacctataacctgtcaccgatgacactcatctgtgacgggcacactgttagatccgattgaaattacctcctatatctcaatcgggcccaactactaagcccgtcagcgatgaagaacattggtgataggctccaaataaggcccgattgagatgaggttaacgcccgtcaccgatgattcatatcggtgacaggcttttatttatgcccgttagaaatctcgtttctttggaccgattgagatatattttgcacactataaatactccacctgtctgttgtctgactcccacagttcactatttttgtgggagattgaagggagcgaatttttatcattttttttccaaagaaaagcaggaaaatcatgaaaataagtaaaaagttactaataatttcttattaatttagtagtacttattttataagatgttaactaatattttgttcatttttgcagcggtggatcgaagttagatgtatgcgactactttgaagcgtcattgcaagtagtatagaaatggcgcattaagttttatgaacgctgcggaggaggataggaaaagaagaaacaacaaatgcatgtgttatccatgtagagattgcaagaatgagaatatgtttgaaagcagaatggacgtacactctcacttcatacaacgggggaattcatgaagggatacacatgttgggtgaagtatggagagtaaaaatcgggaagtggtgtagttgcagacaagtggtgcagacaatcatgaagaaggagatgaagatgagcatggcatgtttataccatctccattgggcggtgaaatggttaatgtagaccctgatctgctgcaagacatgttacgtgacgtcgaggacccaacttacaacgagagagattccacgaagttcagcaggttggttagtgactcggagacacctctatacaccagatgcaagccaaaaacataccaaattgtcagctaccttgaacctaatgaagctgaaggcaagtagtggatgggcatacaagagttttacagaacttttgggaatattgaaggccatgcttcttgaagagatcacattgcccgagacgacatatgaagcaaagcaagttcgtgtcccctgaggttagaggtccgtagaattcacgcttgtccatacgactacatattgtaccacaaacaatatgcggacttagatgtttgtcttgtctacaaggcttcttgatacaagctaaagaaaagtgtgggggagggaaagaagtcgaagcgaggtggtccggcgaaggttgtgttgtatcttctcatcattgatcgtttcaagagaatatttgccaaccccaaggaagcaaagttagtatgttggcatgccacagagagaaggaacaacggtttgctaagacaccctgcggattcgattcaatggaggaatatcgatcaaaagcacaaagactttgctgccgacctcagaaacatgaggatatgtttgtgtacggatggcatgaatccttttagagacatgagcagttctcacaatacttggccagttcttattgcgaactataacctcccgccatggttgtgcttcaaaaggaaatatattatgttgtgcttattaatccaaggtccgaggcaacccggcaatgatatcgatgtgttcttggagcctgttatcaatgatcttgagattctctagaaagaaggtgtggaaacttgggatgcatatggtcaggagaacttcaagctacaagttctattgttatgcaccattaatgattatcccgcactgggtaatctttctggataaaccgtgaaaggaaagaaggcttgctatgactgtatggaacatacacgcagtacatgttgacataatcatccatgacgggcagttttaaaatgcccgaaagagatatagtcatctgtgggctctaaataaagattgatagagatatagtcatctgtgggctctaaataaagattgatagagatatagtcatctgtgacgggctcttggtgtaagcccgatagagataagtcatccaaaccgggactattttgactcaacaggtaggtcaaaactatcggtgacgggctgttccttaaggcctgattgagatgattagtcatccatgacgggctcctacctaacctggtttgactcgtattgcttggtcaatcttatctgtgacgggctttgttgttggcccgattgagataacatccatccgtgatggcctggtgcccgattgagatattttctcacaccagtgacatttgcttagtggcgggggccttacccgaaagagatgaggcttgaagcccgttagagataaccgatcccgtgctagtgaacaatgttcacctaagccatagtctagacagtctagaccgtgtctagatgctagacaaacggttctcgtccattttagaagttaaattgcgaattagactatttaaccatctagtcagtcaaaaacggtcctatactaactagaccacacaattagaaaacattgggatcagtgtaaactgtaaaactatcatttagactatggtttaggaaatggaccaatgcattttttgtgtggcacgagatgaaactttgtaccctgctcaacgcccatgtggcttagggttttgacccattccaaacgtttctcctctgctctaaggtactcactgccatagatagtttcatcgtctcctttgctgataatttgtcactgccataggtagtttcatcgtctcctttgctgataatttgtcaccgtcgactttgctccaacctagaccatgggtcattgttcatctggcatctagcatctacgtgaataccgaatataaaccaaacaaatatcttgcacttggtaggtattcatgttctctaagtttgactgcatgatgccacctcaattattctactaaattgtatttcatatgctgactttgcactatattctcatggttgtccacttccatcttattgtgtctttagtttctttcgacggctgtaagttgggcgtgccaacacgccatgtaacaaagtattcctcgagaagggcagacgtcatattgtgtcatatgtcttcaacccattgctaattgcataaggcctcaactattctcttctttcggtgagagtggttgtatgggttcggctcaatatttgtcctttcggtgagagtggttgtatgggttcggctcaatatttgtcctttaattcatcttgactaaaaaacttgccaccgattagattcatatactccctccgggctgataatacttgtcgttttaaataagggtgaggtcaaactttaaaatctttgattatgaatcatttttaaaatatttgtctttagttacattttagtagtactagattcgtagtactaggtggtatcacgtcccatactaagtagctacattttaggatggaggaagtatatgataaatatcatgcctgcaattcttttataaacttctgttggagggatccatctcttctatttgatagaatgtatatgttttgattcaacaagttacaagtcatataagtattttttagagtatggagctgtaaaatggcatgaagtattggcaagaagcaacagctagaacagcggttggaaagcaatgaccagctcccttttataattgtttttttgtcagaaacactgtagtttaactcttctttattgattgtacctgtgtaattaggttctacttcttccgtttnnnnnnnnnnnnnnnnnnnnnnnnnnnnnnnnnnnnnnnnnnnnnnnnnnnnnnn

SEQ ID NO: 35766 - DNA, 53010 bp, Oryza sativa
  unsure (1)..(53010): unsure at all n locations
nnnnnnnnnnnnnnnnnnnnnnnnnnnnnnnnnnnnnnnnnnnnnnnnnnnnnnnnacggctgtaagttgggcgtgccaacacgccatgtaacaaagtattcctcgagaagggcagacgtcatattgtgtcatatgtcttcaacccattgctaattgcataaggcctcaactattctcttctttcggtgagagtggttgtatgggttcggctcaatatttgtcctttcggtgagagtggttgtatgggttcggctcaatatttgtcctttaattcatcttgactaaaaaacttgccaccgattagattcatatactccctccgggctgataatacttgtcgttttaaataagggtgaggtcaaactttaaaatctttgattatgaatcatttttaaaatatttgtctttagttacattttagtagtactagattcgtagtactaggtggtatcacgtcccatactaagtagctacattttaggatggaggaagtatatgataaatatcatgcctgcaattcttttataaacttctgttggagggatccatctcttctatttgatagaatgtatatgttttgattcaacaagttacaagtcatataagtattttttagagtatggagctgtaaaatggcatgaagtattggcaagaagcaacagctagaacagcggttggaaagcaatgaccagctcccttttataattgtttttttgtcagaaacactgtagtttaactcttctttattgattgtacctgtgtaattaggttctacttcttccgtttcacaatgtaagtcattctaacattttccacattcatattaatgaatctagatgacattactatgaatgtggaaaatgctgaataacttatattgtgaaacgaaggaagtaactacttatgactcttagagcaaggataataatagagctcacttcctactattagccaatcttaaagccaacatatataatagattagctataaggttggctataattttcttctcctctctatatctcttacttatacattaattgtatttgttttgaagcttgtgttaagctagctctggtatgaaagccaacacccttaactttttgtcacatctcttctccacataaacttatagtaggcatatagctcattatacttgctcttactgtattgttatcgggttaaaagaaaaaagagtatctaatgctacttatacccgctaaacacaacattgcggatgccttaggtatttacagcaaagcaccgaaaaaggattttacatttttacagcggaacagtggaagacgggagggaggaaggggaacaccaaaattccaccgacgcagtggcaggatccccgtccatggccgttaagcccaaacccaccacctacctcctcctcctcccctcctcctcctcctccgccgccgccgccgtccatggagacctccaagtcgccgccgccgccgcccttctccccgccgcggcaacccgggccggcgacggtgctcctgtgcccgtgcgcgacgctcctcctcctcgccctcatcgcctcctccatcgccctcaccgtctacttccgcctctactgccactcccccatcgcccacctcctcgcccctcaccgctgcccccaccgcatctgacctccgccgccgccgccgcctcgctccctctgctctcgccgctggcatgtggggcgaggtgcgtttccacctgctcggcatccgacggcgacaaggtggagggggagggggaggggggctcgccggcgcatgcggactcgagccacccggagcacgtggggcgggtgtgcgcggccatcacgaacgtcgtcccggcgggcgcgggcgcgggcgctaacgcgagcctcgaggcggcgctcaccgcgctctcgccgccgctctccgagacgctcgtcctggcggtgctcgaccgcttcaagcacgcgcacaggccgtcccaccgcttcttccggtgggccgccgccgccgccgccgcctccggcggcttcgcgcacaccaccatcacgtactgcaagatggtccacatcctcggcaaggcgaggcagttccagtcgatggtggcgttgatccaagagatggggaaggagggcgccctctgcatggacgcgttcaagatcgccatcaagtcgtttgctgctgccggtgagatcaagaatgcggtcggcgtgtttgagatgatgaggacgcacggcttcgacgatggggtggagtccttcaattgcttgctagttgctttggcgcaggaggggctggggagggaggctaatcaggtgttcgacagaatgcgtgaccgctacgctccagacctacggtcgtataccgcgctgatgctggcatggtgcaacgcgaggaatctggtggaggctgggcgggtttggaatgagatgctggagaatgggttgaagcctgatgttgtcgtgcacaatacgatgattgaggggttgctacgcgggcagaggcggcccgaggctgtgaagatgtttgagctcatgaaggcaaaggggcctgctccaaatgtgtggacgtatacaatgttgattcgggaccactgtaagcgaggaaagatggacatggcaatgcggtgcttcgaggagatgcaggatgttgggtgccagccggatgtcgccacctatacatgcttgcttgtgggatatgggaatgcaaagaggatggatagagtgacagccctattggaggaaatgactcaaaaggggtgccctcctgatggacggacatacaatgctctcattaagctacttacgaataggaatatgccagatgatgcggcaagaatatataaaaagatgataaagaagggacttgagcctacgatccatacatacaacatgatgatgaagtcatatttccttggcgggaggaactacatgatgggttgtgcggtgtgggaggagatgcaccggaaggggatttgtccagatgtgaactcttacacagtgtttattaatgggcatatacgacatggtagacctgaggaggcatgtaaatacattgaagagatgatccaaaaagggatgaagactccacagatagactacaataagtttgctgcagatttctccaaggctgggaagcctgacatattgtatgaattggctcagaaggtgaagtttacaggtaaatttgatgcgtctaatgtgttccaccagtgggcagagagaatgaaaaaacgtgtcaagaggaatgtccctaatcagactgagagcaggacgttctaagattaccatttgccagcagaaatgtggatctctttgatggtggctgaaatttgaggtgttgctcctgctttttaggagaaaggtgctagttgttttctgtgttgtatagtaatggtccatgaaatattagtgtgttttcatgtgtgaacaaaatgattcagttaattatgatgtagcctatggtagttttattttagttcagtcatgtgttacgctaaatcttcattcaggagtgcctcttccatttctctcttgttccgttagtatatctcaataactcattatgctggattatgcatcgtaccatggcttagtctgtcagccatatcgttgaattcaagtatgttgaggtgcttatgattaagcaatgctgatgtgtactccctctatcctaaaataaaccaacctagattgggatgggacataacctagtacaacgaatctggatagagacatgtctagatttgttgtactagattatattccatcccaacctaggttagtttattttgggacggacggagtaggttctaaggatgaagatagccggaacttacgagccgcaactctgtggttccatccagcaatttatactgcctttagtttgtagttagcaaatctcaattgcgtccaaatattttgtgttcttaattctgaaagaaagctgtatattaagatttattttgtttctcaaaattgaccaatttccctgctttgggatcctaattcattggtaattctgcagagtagagcaagtgcaggaccaggtttttttgtggtcaatggcactatacccgtatgaggcatcttgcttttttttctcttttttgactagcagcagagctatctatattgtagaaataggaatggcattgttctgcagttgttagttttggtcttgactgcaatttgagatgtggtcgtagcaaagttgctaaggtttattttgcctatgctatctcgcagcagctatgagcctatgcagatttattccatgtggtccatgtttgttgatctctattctagtttaaaggtgatttgagctctgttgcagtttactaatatgatcattcctcttactcctgtgagctgaatcttgtgatcttgtctacttcattgtctgtcacttgtcagaaattcctatcaaaatactgtagaatggcattctttagtatatgtctatatacaaagcgaatcaccccacaacaaacctagtctggttagatgagagctattgcaccagtcttcactgtcaattgttaagatgtcacatgtttggtcctgtttatagctcatgcctttcttgagattcttaaaaacaataaatgtttgttccataccacacttcaacttctaagtacttttgcatcattactcacttgtttgagaggtaggcatgttctgtgtcttattcaaaaggctacttgttttagtgttatgtagtatgactaagttccttgtttggtatctttatgttcaatagatcaattatctggctgtttgttcgcttcgttgctatgccattgcataaacaaaggacccaacattgccatatgtttacaattggggatagatttgtcaattttactaaaaatgttgtgtgtattacagtttgctgatctgttcacatgtgatcaaagatttagctctgtttctgtggttctttaacatggagttgccttgttgtgcctttcaacattagatgtgcactggttccgtcctttactaaatgctattacaaatatgatttgcgtgtctaattgtagatatttcactgcttatgaaaactgcaagctcagtacgttgtaattatttgccacatttgttttataaatctgttccgttgtattattgtgttccttatctggctttatatgtctcagacttttctactgtcccacagcacatgggagacctttctgtctatcatgtggtgcttgattctaacttggcacttggttggtaagagtcaaggtaatgtacagtattcagttagctagctcctcttagtactgttacaccaaacatgagcaatgctctttgattctattgtacttttctgtttggtgaatttaatttattctgattcctactgtcctgatttaaatttaaacctgacagatataacatgctcacatttcaacttttgtgatgcatgtgttagtattttttttttagcttttactctttgattaatctttcaaggacatttggtatgcaggatagaaagaaaataaaatagtaataatgccatgaatctagcctttagatttattcagcttaaaactgaatgctcttgtcctaatatttcctgaattaaatttacgtatgcgttttttcaaggaaaactgcatcaggttgaaattgacttatttggtataatgggcattattttagttctttgatggtcccttgtacagacagtatatacgtttgttttaaagaaaataaacacacctggtaactgaaatataatctggattagtgtaatggatttctcatattaatttatatcaagataatgggacagcatccattcaggatatcggattgctctggcttctcaaatctagctgagattttacgaaagacgcatgaattgaatcctgcttgtctcatgactgatgcaacctgtttctttcaagtgtcatgtgtgggtgccttttcaatctgatcatatcttgggcttctccaactgccagtggtaaaattatcttttagattggatgaacaagattaggtactttattttctcaattttatcttagttctgttagtgtgttagcttagttttctgtaaatgctgggtttataccatcttgacaccaatacttggtcatgacaaacaaattaagaaaaaagaaaaaagaaaaaaatagtctttttcttttgttgcaatcttcacttatttgaaccttcattcatatttgaggcgtccatggcactggtaagtcgaaactgtatcagactgcagattcatggtttttactatgctatctacaaatatactaaaattttacaaatgttgaacatattcccctcaacacatattgcacattcctgtgaccttccaatgtagaagcatttaagttcatttgttcagtgaacattaattacaagctgctggtgctgctcctggccactcatactgtgcaagtttgatgcgtttcttctccgttgatcctgcagaaacagaggaagagaaggtatcatgactgcggactattatgctcctataagccattgagcagaagtcagtcaagactaacctgaagcagctgcaaccgaaactgtcgttggccctgctgaatcatgcggaccatccgcatgatagcatagaacggcaacaagattccagcagcccgaagtaagaatatctgcaatgcaacattccccagttagttaatttcaattgattagtttactcctctgttgagatagtgaactcactgtgacaaggctgaatgcacagtgatccgccgcttcaattgtcaccactgcaatgagatgccacaccagcagcataatggtgaactgcacaagaatcacagatgatatcagaatccaggagacaccctgaacggcctgccagacaatggacaatttcgcttcagctgtctcataccgttatcgtcaatgatcggcaccatgaggagcagtctccattacccgtctgcgcctcggatcctgcatactgctcctgatcctcctgagagagttcctcagggagcatctcctcgtctctgcaaaagaaggctctgcatcaggcagtgtaccgagttggcacatgtgtcccccatctaatccgatctggtggttgcaactgctgaaaccttgcagcaagatgcaaccccgggtgatgatgtgagtgtgactaaggtggccacgttagctggaatgctggatggccgggaaggtggatttgtgcattgacaccgtgtgatttggacgcacgctcttgacaggacgcctcaccgatgcatccacagctcatacttcacggtttgatttggctgtctatctggtcatttttggcatgatgccctattgtacatttttgttcagataatggcatttcacacagcctaacgcaattggtcagtgtagttctgtgtggaaatgttgccagctgaagcttcttttttttttctctctttttatattttgttgtgatggttctgtgtgaaaactgagctgcagctttatctctgtaatctcattggagaaccactaatcaggccaatgtaatatgccaagatgcattactgcatttcttgtcttgtattattgatagatcttaacatcttaagagctgtcaccgtgtcattgtggtccctagtttggaaggtatacttgccttgttggttgggtcctgtggcttatctaggacatcttgggggatctacctgagtggccatcttaacattaataaatggctacacagatcatctcatcaaccactggttgttagtatgctaatcctgtctctcattgcatgattggttggttccttggttgaaaacagagtgttacctactgatttaagactccgtttaagggcatgtacagtgctacattactggtgttgacagttcacagttgcatgatactactagccagataggcttagattagaaacaccttatcctaagagcattatcttaatgatcttttcctatcagaaattgacaatgcaagagatggaggaggtacctgacagtgactgccgtttcaacaacctgcactttcttgggagggatggtgtaatctgactcaaaattctgtcaagaaaagcatcttgtattattaaaaaaacaggattatgcatgaaaaatctttcagaatgtcttatttaggcggctagtgtaatagtttatgaaaggttggcagaagtttacattttgcacaagaaaagtgcactttgcttatgattagaagcattagctaactttcttttaaccccaaagaaatctgttactttatcctctaaacataatgttgcacagctacacataattacaaatcataaataaacaagaaaaaaggagctagctgtttggcacctttcctgcacaaatttcacctttctagctaaccccaataaaagtggctagctgtttcacattatacacgaataggtcatatggtacactaatgatcaaacacaaactttcacaaagaagagtctacctggaggcaaatctcacagagtgtgctccccttctcatcacaccacctctgcacacatcccctgtgagcatactgcacatgcacaaattaacaaacacaaaccataaacacatcattttagccactaacaaactagtaaattaatcatcacaagaaccatatcatgcatgtaacaactacaagaaatgcagggaaggatcatggatggatgatcacttgatcagcttgtaactttgtacctaccttgagagagccagagcatccacagggggactcaattgcagcgcaccactcatcctcctcctcatggcaaatcctgcactgcctcagcagcgaggacgaggacgatgacgaagacgaagaagaaaacgaaggagaagagggttcagaagaggaagaggaagaagaaagctcatgctgttccatcacttcctctcctcctcaattccttccaataccttgctttcttggctgctcaataagatatgctctgctgctgctttctctcaccctctccctcttttctccatggcgaccaatggtggtgtttatatatggcagagaataacaccaaatgcaagcagtcacctcatggaaagaggaaaatccaagtgactgtgtcatggggcccaccagctactagtctatcggcctgtttgggggagctttagattctgagaagcagctgtttgatagtcagcttctgagaatctaaaaaaactctgaaacccagcttctccagcttctggcttcttagttcatttttcagaatttgtaactacagattcttagaagtgtggactgtttagggcagcttctagcagaagcatcttttgggaaaaactgcaactgggacaagctcccccaaatagggcctattactactaccaaccatttgttaaagaaaaagataaaacctttcattttgttcctaactactgtcaccttttgtcatctggtattctcatctgccatttatcatgagcctaactaatgcacgttcgccttgctcgttaggcgcgtaatctttggctttcaggataaatattttgtatttatatatatatttccagctggtggataactattttatctttaatttctttttttgtttacttgagacgcctcaatacctaactaataaaaaaggagtcaatgaaagaagacaatgaaagagccagtaacggtcgcaataatcactagaatgccacctcatgacatgatgaaacggcagagataagataatccactcatccttttgagcacaagcattccccttttgcaaatgcttttgtttccctttttcctttcccacttacatggaattgcaaatattcttttaggacttttcctaatgtgttctttccctcagtgtctataaaccgacaaaaggtgtaatatatatactcccgtagtcctaaatatacttttatcgttaattttttcccttaaaatatagttatttcttcacagatttattatgacagcaaaagtatgtatttgtcaacaattctgcgaagtgagttgcaaaatactctatgataatgcattagctggaattttgttcatatcttttaaggtaatttgggttaattgatttttcaggtggtctttgttaaatgcgattccctaaatctagtggaattgttgtaaatggtccatctgggtcatcgctcagaaaatagaagtggtcctgggacaaattgaggagattgggtaggaatttgcatagctgtaaactttcattcgttcctgttcttgtaatgagacggctctcatttatttgcaaagcaagcctagagcgatggacaatggtctagttggttaattaaaccagagcagagttcacagaaccgatgaaaaccgcttgatattcgttagtttccagatgattcactccggctcaaatctagaaagcgccaggtaaaccggtctgttcaaaaaatttcaaaacttttggtgaaatgtgttcaaatttcactggatttcgccagttttccagtggtataatctcatcaaacaattgtgaagccatgcccatatggataagacagacaatgaagagctcccttatttattccgcaacagaaaaaaaaaagagggcaaattccagaaaacctcatgttttacactactttacatttgaaagtttttcacccaaaaaacttgcaaacgtttattagatagtctcttttctgaaatttactttaaaaaaacaaggagaagaagaagaacgggccggacatgggctgcgaagaccagctccaaatcggtgctgcttctgggcctagccaggccgacggtctctgatatgatcagctttggatcggaagttgctaggttgggccaagttgatcgagggtgctttctagacctcttccatggaccttttctatttcacggtgaaattgaaccatttttcatagttctttcttctttcttttttaagtcgtggcaaaatttcgaagtgcaacttaaaagttcacagtaaacaagtacaatcatctaggggtgactcaaaactttctattcgctcaaactcgaggtctttttttaattttttggacgaatgcactcgggttctaaacaagccgaattgagctgtctataactaactacgtgctatgatatataagagatttaacttatataactaaataaacaaaatctcttatattataagacaacactctttagcttaatgaaccaagttgtaagctacgtactcatcatcatgcattaagcttgtcagtatatatatatatatatgttaacaccattctttatctattttacctattatctttttctttaaacttactttatttgatttgtgcttacttaatataccctttaccactccctacttcccattttgctaatatataatgaatatttaaatattcaaaatatttttttgtttggccttattttgttctagtgatctaaactgaggtgctgcaaacttgtaataatccggctctagcttcctatcaaataaaggccgaaaactctttttcatcattaaaaaaagggaaaattgtaataaccatcccaaatatcactctaagtttgagatgccctcttataagaagatttgttgcaaatccccacctcctaattcacattggtttgatttaggcaacttctctctatacatgcgtgaatcctggagtatctcgtggtgaaattagccaagtcccgttcatcgtgatgatttgtcaacaggtctcttgtttagattgtgtggccttaattttttattaaactgtattgaaacctactattttgggtcatctgaccaattgcaacagatgaaatcatgcagttctaatctagctatatgattactgcttcgtgttcaaatgtttatgtatgctcattacgtccgtgaaaaaaaaaatggatttgttattcagtacacatgatatcggtttcgaatttatataactagtataccatgaaaaacacagtgaaaatatccatgataacacaatgaaatgatcatcttatacagaacaaacaacataatctcttgctcccgcctagtgggactcagttgatttcgctacaagattcttcgggaacagggccggcccagggcataggccggttgtgcgaccgcctagggcccagggcagagggggccccatcacttaccacccccctctctctctcccagcccagccgcagcccaacagaagttcaatcgcgtgcgatgatgcaatcaccgatcagcggcaaaggcgcgtgcgcgattgcgcgtcgcttcgtctgcccgcgactgcgacttgcgagaccggagaggcggagatcgaggccgagccgtgtcgcttcgtcatcctgaaatcccgaattgccgccgatgaatcgggaatcacgcatatgtggagagaatgtgcctaaatcaaatcaagatgaattaggaggtggggatttgcaacaaatcttcttatggggaggcatcttaaactcagagtgatatttggggtggtttttgtaattttccctttaaaaaaaacactagcaatatagctcacattggctcgccgagccaggcaagccaagctaatcttttagtagctcgtcaagattcaagattaaaaaaaaaaaacaaaccagatctgtctcgttaccataacaaatctgatcgtgccgcgtgtcttacaaaagaatcgttatccccttctacagtcattcctacagtaaaaataatgcattcccaactcactttccaagtgcaagtgcgtgtaccattagttgggaatagatcgatgcatttttgtagctttgcatgactcacccctttcactcatcacactcatgtattttcactttgcaagctgccaagctattcaggggaccaaaacggccggtttgatcgacgagtcgatagctcccccgctggatgtatctaatccatttggtttggagtttggataagatcatgagaccccggccggccaccttcttctgctggtacttgcatatcctatacaccggggcttacaatctcaattggctaacggattttatcattttaaatcctgtccaaggcttcgattatcgttttaattaattcgaatggaattttgataaatttcaaataaacagttcgcgatgcacgtttggagccacggtttgagatgctcaaaatttattgaactgctctgcacctggataactgggtactagaattgggtagatgggtagacagagagacgagcacaaaagggatcataggtattcatacgaatacccaatgttttttaaaagtagctatccatctatgcaaaagaataataataattactcaattggttagtacatttaatgggcgttgggttcaatccccattcttcctgtgtctttttttttctgattattacttttcaatagatacatcctctttttcatatataacataaatatgtatcttaaaatattgtaatataaatcttgaatacccacactttcaaaatcttacgttcgcccttgtgggtagatatttctacttcgccgtcacgctgcgagcacaaaggagagaggtctctgtctgtctgtctgtcttgtcgtgcgtacattcttgctaattgctatccagtccggcggcctgcaggatatcggcagctgcttgtgcaagagaaaaccggcgactcttgtgccgcagcacgcagttttgctgacctgccaaaaaaaaacaaattaccagtgtgaccctcttctccttatccaaccaaaaccttcttctatacaatcttattttcatttctagatggatgtgaatgtgcaaccactgaaagatcgatcaacgtcaaaatacatatagtccgtttattcgggattaaaagaaacatattactagaatttaaacaaaatattgctaagatggtgtttgaatctcctgaagatatcagattaagtgtttcacgcaaaacgaggtggtaataacgtgcgattaattgagttttaattattacaaacttagaaaacggattaatctgatattttaaaacaactttcatatagaaagttttcgcacaaaacacaccatttaatagtttgaaaaacgtgccataaaaatctttatcttcgtccaactcttgttggagaaacgaacgggacctaagtgagttctactactgtaatcacttcatgcttcctaagcttctatttattaagaaaaactatatgtatgagtttttttataatacttttaatagaaaaatagccgtgtgttccaacgggtgaagactattttaatcttattattgttatacgatttaactaggataaaattcgctatatgaattcgctaggatatatattttttagaaaattataagctgcaattagtagttcgactttcgtatcaagttagcatgcgagtttttttaaaaagaaatttcttatacgatttattttgtatttccaaaaatagataaatttaaaaaccgacccaaacaaaaattacgtaccaaagtaccggtaaaaaacatcttcaatttttataatagtagagagaaatcttctatttttcgttttgtaccctcgaatctctactattataaaaattaaagatgtttttactggtactttggtatgtcatcttgtttgagtcggtttttaaattcactcgcttttagaaatatagatcattgtttgagtcggttttaagttcattcgcttttggaaataaaaaagagtcgtataggaaatctctttaaaaaaaaacttgcatgctgattacttgagacgatcaaactcttaattgcaactcatgattttataaaagaaacaaattcaagcggattcttatagtgaatttcacattaactaaaccgtataataataagatgattaaaataatttttctattataacgcacggatattttttctaatattattagaattagatcatgcatcatctatttagaacaaaaatgaactcgtcagttgcgcgaaaattggtcctcatgtcgacatgtccctagcgccaaactacctaccctgtagaaacttcctaccaacatgaaaatcgccccctagaaaatcataaatttcaactcatacttatcccaaagatattccgcaactgaagggcaaaaccgtcaagcagcaatgttcgaaagcatcaccgaagctagcttactcctgccgccagcccgccatcagctaagcatccatccatgttctatatagaaagctctccggcttgctcaatcatcagcaattcagcattagcaatacacagtgtcagattgtcaccatatatagtagccatcaattgaaaccacataagagatcagagagttaattaatccggcagccatggagaacgtcaccggaggaggaggaggaggatcgccgcggcgggtggtggtggcggtggacgagagcgaggagagcatgcacgcgctgtcgtggtgcctctccaacgtggtctccgccgccgccaagtcccccgcggccgcgccgccgccggccgtggtcctggtccacgcccggccggcgcggccgctctactacccggtgatcgacggcggcggctacgtgctgacccaggaggtgatggacagcatggaccgctacatggccaccgccgccgactccgtcgtcgccaaggcccgcgacatctgcaccgccttccccaatgtaacttagctttctctcaactccaaactttgacattctcgttttccgttagcacgttttttagacggttaaattatacgtttctaacaaaaaaaaacttctgtctagaagttatttttagaaaatctaattattcgtcttttaattttataataattaaccatgtgctaacgagttttctcaatgtctatgttaataatatccattcaattgccttaaaccaacgggccttacaagcggaggattttttttgactttaccattcaattgccttaaaccaacgggccttacaagcggaggatttttttttcctaaagtcaattacatggaagacgtacacacacgaatcacacttatggtggtacgattgactgatcatctcgtctcctctgatgtgcaggtgaaggtggagacgcgggtggagaaaggggacccgagggatgtgatctgcggggcggtggagaaggccggcgcggacatggtggtgatggggagccatggttacggtttcctgcagaggacgctgctggggagcgtcagcaaccactgcgtccagcactgcaagtgccccgtcgtcgtcgtcaagaggcccggcaccaacgccaaggcctcttgatgcgccaactccgcggtccaggatgcaatctgtggaatgttgtgataatatgggtgtatgtatatagtggccttggtgcagagtttgtgtatgtgtagtagtacatgttttccttgtagtaacaagtaacaacattattgcactctctaatgtatatatgcaaatgctaggcttgcttcagttactgtgcaacatcagagcattactatctaagattgactcggttattctagttccccaaatcgctcacgttgaaaaagaaaagattgggctccatttcctaacaatgcccataggaacaaagaaattccacaaggaacccagctacattcctagacccaaatatgacaccattcctattttagccccaagaatgtgaaatgtaatcctacaagctacaagcgagcgtcttcacataagatatacagtacaatcctacaagctacaagtttatacaccagcagaagctttgggatccatctagttgaatctgttcttaaaggctaatcagcaaccagagtgaatgacaaatcacatccaaggtaactacacgggtggattggggatgataattcaaataagcatgtaaatccacgaataccatacactcagaaagacaaaaaagataacacattctgacgaatcacgagctgtaagcagtcaagaagcacttccagtcatccaggcatcacaacaaaatattgagatgtgctaatgcaaacaagacaaccttaaaaatggataaccaattcttatagaagataatatttcaggtgcaatccaacagcatggaactgggttgcacagagccaaactacgcatgataaaacttaagtaccatagtaatctcctttgcccttacagaacagtgaaataggttcaaaactgtagatccagagatacaagaaacattcataaccaaaaggctcctccaccttactcctcggattcagcctcaccactcttcttgttgtgcttcctcgagtacctctggttcctgaggaactttgggtccatctataaaagcaatttacaaagaacccaggtaagaacgcggaaacaaggcaacaggattcaatttcaacataacagcgaggacatttgaattgatttccgaaaacaaaataaatcctaagaacaaaataggatgcaagaataagcaacaaaatagattcctacacaccacaagactatatagacaaattcaaagtcgcttcgacttgtgattaaattgtttatactgtccagaaaagtatattgacatacacagacgattgcccaaactacctgagcactgggtccaatgaacgttggacttaatctttggctaataatcatcaaacggcagggctaaaaccaagcaaaatatccaattccacaaggctaagtgacacaggagtagaaagccattttgagaacttaagcagtgaaattgacacagttaatcgcaggaaaactcagataggcacctaacaaattcctgtctaatatcgatgcaactcgtacggtttcatataaccacattacaactgcatataatgcctaactcaatagtaaggagattttaataacagtctaaccgacactgtcattcgaacatggaaaacctagaactgtcattcgaacatttccaaaagcctctagccacatatacacattattcgaactgtaattcaaacaaaaggcaacacagtatgaacaaattttttgcagtgaattactatgtccacatgaagaaaacatcatttttgcaagaaaccaaggcaaggctacaggattgcagggaatctggatctgagagtgagagagagggaaggagcaaagagacgcacccccttggtggaggtctggcggtggcgcttgggcttcttgatgccgttcttgtgcgccttgtacgactggttgtgcgccgtgtggttcttcgacttggccatctccgatctctctctctctctctcactccacctagaacaggaatagcagatgagggtcaaacgaatcagaggagaaacaggaggaggaagaggagattttgggcggatgcgcgaggagacgagatggtacggttctcttaccggcgtcgagagaagtcgcgagcacgggaggaggtcggcggcggcgtctagggtttcggggatggcttggactcgagggcgagtttatataggggaggccaggagggggatggcttccctaagcccgtggttggatgggccgaaattcggcccattgtttgggccctgatcgagctgttttaacgggctaattagcaataggaaaaagtgcaccgaaggtccctcaacttatagtcgggataaaaaacatcctcgaaccgcaaaatcagatacgcagggtcccttactatacaaaactagtcacccgaggtccttcggtggttttgaccccagttttggtctacggatgagtcagcgtgggacccatatggggtcccacatgtcaggtgtccacgtcaccctctctctttcccctcttctctccattcctcatctctatctcttcacttctgtgcaagctgtccggggtgaggcgggagagcggcgccgtgaccgccgccggcggaggcggcgtgcgagcgtggtgtggctggtgtggcgactgtggccggccggaaggatggagacggtggtggtggtggaggagggggaagcagcggggggagttcttggagctatggatgggggtggggctggggcactgacggcggcggtggcgggagcagtggcgtcgggggaggcggcgaaggaggacggggaggcggtggcggtggcggtagtggaggcggaggtggcggtggcggcagtagcggcggaagaaggtgctggtggggatgcggcaatggtagacggcgctacaaaggtggcaaaaaaggcggtggcggcggcgaggccggcaagggcatcagggcggagagggaaaaggccggccatgtcggcggtggcgtgggtatgaggagcgcgcggcgggggaggaggcacgggcggcggccgagctacaactcgagtctgtaccgggtgggggagtacgcgcggtgcatggcagcgatgaggcggtgccgaggggcgctgctggtgtgccagatgcagtgcgagggcccctgcttctacgactgcgacgccaactgcaaggcgcactaccacttctaatagcggcgccgctgccgacgtcatttgccggccgctcgggaatatatatatgtgccaccggctgcttgcatttgcttgctcattgtgtgtgtctagctagctcgattggctgcttaatttatcggtgagaatatgggcgcgccgtgctggaccacgagccggtgaggctgcaccccaccgccgcgtcccactgcgcgtactcgtcgccggcgccgctgacagggccgacgcgttcgccggcgcacgcgacgacaagagcgcgccccacgtcggccgagcggggcgaggaggcggagaaagcggagaagccgccgcgctcgcacgccgcctctgccggtggccgtcgcggggccgccctcccgcctcaccccggccagctcgcacagaagtgagagagagagagagagatgagaaagggagagaagaagggaaagagagaaggtggcgtggacatctgacatgtggggctcacgtgggtcccacgctaactcatccgccacgtagaccaaaacagaggtccaaaccactgaaggacctcgggtgaccggttttgtatagttaagggactccgcatatctggttttgcggttcgaggacgtttttgtatcccgatgacaagtgaagggaccttcaatgcactttttccttagcaatatggccttaagtgactcctttctgatacctggtataggctggtacctggtaccttgtacccagtacctgagtaccagttggtacctggtatccgataccctggtatcgagctggtacctaggtatcagaccatagtacctgggtactaggcgtgatacctcaagagagagtaaacgagacgccgccattggccatctagtacctgggcatcctgacttcgcttgaggcaaagagacgccgccgccggccaccgcggctgctgctcacgcacggggcaagaccacggcggcgcagcacgtggcagcacggcacctggaccacaccttcgagaagctcacgtcggtgtatctcccgctcgtggcggcgacgccgctggtggacgcgctgcgcgcgttgcccgccgagctgctcgcgctccccgacctcgccctagagggattgtaattttgtttgggaccctggcttaagtggggcccatgtggggtgcatcctaaccaggtagagcgcgagtgcacgaccctagggacccctaaatcgttcttcccacctttataaaatagctaggtacctctccaggatttcttgggtttgttagattaaagtttagccattgctatttgcttgcaggcacgtgttggctagaccacccatctacttgttatttggaaccccaacttatcatttgtattcaattcctatttgctatattagattggttttatcttgttcttgcttatttctttgatttgcttgtaggaatagggttgattcaccggcagcgtgcgtctcaacttatcatttgttatacgttgcagcacgcgttgttatttagagctccaacttactatttgtaacgtgttggttttatcagattggttttatctcgttcttgttcttggttgttttttcgatctgctcgcttatggccagtgaccacatatatgcatcctagtatattaccaacgcgtgctgcctcgtgcctcagtgaacaatttaaagcttgcacataggagtatatgtaaaacgctagctagctcgatcgatcgatggttaggtgagagatcagccgggaattgagagcaaaacccttctagaatgctaagcccgatcgatcgatccaaggacctacctaccgcgtcgcattcattcgtgtgcactctctgctctggtcgtgtttgtaggtagctcctgcatgcaggctcgtgtgaggtttggagagaagctaggcgtcactacgcatgtagtagattctattgatgatcagtagccaatttgattggtagcgtcgtacaggcaggtagcacgaacgtacccgacctaggtaggttaatttgggagcttagctgcgggcatcgatcgatcgatctgagttctgacggacccaagtccgatggtttggtggcgacgcaatgctctcgatcgagcgtgtacgcacgtagggtgcaaacggttcgaaaagttttcggcttcaactagtgtttttcgaacgaaaagtgttggaatttcttttaaagctttgaaaacaacaacgatttagaaattcttttttttcttgaaaacaaaaacgaatacaggaagactactgcccgtcaaaagctggaattggttagatactttccaaaatctggattttttttctcggaaacagaaatgcatttagatttttttttctcaaaaacgaaaacgaatatagtaaggctaatattcgttggaaaccagaatcggttgcaagctttccaaaaacgaatttgtattttttttctcacaaacataaacaaattatttttatgtagctgattagcttgatcattctctactttagatgctcagatttgtacacagtactgaggtggttagttgaatggatttttttttctaccaatgctttagatatgcttttctcttgtctaataactattttttattagaccatgccgtactgactaatatatagttcttgcttattgtaattttcatgaaaagtaaagtgtaaaactagttatatattattaattgataaaaaataggaattttaatttattgttttagaaaaaaatagtgaggcacatctcttcgctaaagaagaagcaacaacctctattttcatattccgataaatattagttacaatattcgctccgtatctatattcatcagtatcatattatgttttttatctacggtttttatttcaattccgattccaaaaagatataaaaacagatatggcagagttggtgttagtccatttccaagccatttttctcctatgtaagtgcgttcaaggagaggctcctccgacgtcggttctgtaatatggatcgccggcatgtggatccataatctgtgggactcacatataaaccttttaaagttaaaggatattaagttagaatatgtatttccatacgtgcagctagcggtgcaggcaatcaggttgcgagatagcggctagctgggaatcaggttgcgagaggcgttcttggcaggttgtggttgttggcaacaatcggcaggcgagtcaaggtgagctcaacggccattggcatccccttcagtcccctccccccgcaagcacaaggaactgcctactgtcatcgatctgtgtacgcatgtcttccactccacatgcttgatgagcccatgactcatcatcatgtcaattaataaccgctgccaccaccgctaacccgatcagcgtcttaattaactttctatgttttaaaatatagctatcactaaaaaaaaatatagctgccattttaagttcaaagttgaactatatattttaagatggagaaagcacatttataaatatttgacgtttagagtagggttcgatcaaagttttaaaatttaaaccgtcgaaagtttctcaaatgtgtagtttaaaaccaaatgaaattgtatatatatagatttacctcgaaaagtactaccgtgatattataaacctattgaatcttataattaaactgattctaatatgaaattgatagaagtgaattttaaagtttgaccaaaacttactgtaaacgtcaattattcattgccggagggtgtatttcaatttcttgttcattttcactagctatatatactatgtcgttgcttggtaatttggaagaaatcaaatcaataaaaatttcagtatagtccgttttagcgatatttcaataattcaattctgcatataacctaagccatacgtcacaattaccagaaccagacagaactcgtctaccatggtagaaaaacaagcacttaatttgatacgaatcattctcatgcgagctcaaagctcactggaagcaactgagacatccaaagtacatcaaggtccagcatagtcaacaaaactaggctggaaacttaagaacttaaccaattaatcgatgtccagtttaggtgtgatttgtgcacactccaacacaggaccaagtctaggaaactagtgaggggtagttggttcttgtgtaccaaacacctgcacagaatggccattacccatgtcatgcatggtttttatagcaattgggactagcttgcaatcatctcccagtgatccatatgcctctgcctgaatattaactcaccaaatggttcaagggatcacattttgcttcatattcagtagccatccagagttccccaagaagcaaggctgccatgcttctttaatccagtgctgcattttataagcagctttgttgccaattcagttgcataacctgcacatataaagagggactgcaggctaggtgtgctagaagcagaatctcaagctgtgagggagtagtaactgaattttgatcagttcattcagttgcatgtccttgcatgccatggcctgtctcaagctcagacatgtgtgcctcactgtggtgctcttctccattggtatctccagctgtagaggtaattaatctatcttagatccacttttaattaacatatgggatgcatggcttcttgtctttttgttcaaaagtaggactttggtcttgtttggaaatgatcagctttaaatttgaaaatgccatagttttaacgtttccagataggggtattgagggatttttcagcatatataatctgaaggaattttacgatccttgcattggaagtatcatcactccatctgtttggttctaagtaattaagtaactgtatttatctgaacaatgcagggcaaggaggagggggagcaggtggtggtggtgcagtagttccagggacacaggatgcaatccagattgtggcacaagctgctctctgctttgacaatagacaagtaagttccattctcttctcttcactttgaatttcatcatagaacatttctatggatccagagattcttactgaccaaaaactatgcagaatgaaagtgactgagtgcgtggcatgcatactgtgagatcaatgcaaaaggcactcttcagtgaaattatattagttcaaccaattgggatgtataatggccttgaaacattaatttaattagggtgtcactgtgtcactagtgcaaaataagcattgaccttcagccccaaaagcaactcctagtgtgtacacttcaacttggaaaaaattaaggtcgatgtagctatattaaaggatggagatgtttacattgttttgtttaaattaggctggtacaccatgtgcaatcattttgtacacgacagtcaaatacctgaaaattattactttcttcgtttttaaacaactggcaatcctaactttactatatgaaattcggctgcgaattattcttagatggttagactaaagtgaacaaaagctccatacatatacttaggacgttatacactttaataacaaatcatctttttttattgtttgcaaatatttacaaagtgacgtatccataaataaatagtgcttgctttcaattattaagaaaatggagggaagtatatagttcaaaaacaaactagcacttctcttagtttttgaaccaatttttaatataattatggaaatagacacactattaactttttttgaaaacaaacaatgctcatagccaaaaaggtttattttttttataataagttatcagatgttcaattcgctttttccataattacagcgtggacaattgttctacaatttggtcagcttaggataaaattaacataatagtaatactgcattttttttcttatatttaacattattattacaaattatgcatggccggtgatctcctctgtctgtatattaccagtgtcagtgacttttgagtgtcgtacgttcgctcatcacccaactaaatgaagaaaaaaaacgtttaattatattaattaatcttgtggcaggtgatcaacgggtgcctgcaatcgatgggcatcaacgtcaccaccacaaccggtggcagcggcgccaccacgtcggctccggcggcggcgaacgggtcggcggcggcgaccatgtgcagcgcgccgtgcttcgggcagatgaccatgatgatggggtgcgtgaacggcatcttcggcaacttcgccggctacagcccgggcctcatgcagggagtccaggccgtcttccagatggcctgcggcaacgtcaatggccagggcggcgccggcgccgccgccggtggcggtggcggtggcagtgcaggagcctccggcggtagtggtggtggtggcggcggcgccggcggtgctactggtggtggcgctggatcggggaatgcttctcctaattcaggtaaaaatgttgggctagcagattaccagctaattagttactcttaactctccatttagaaatatattcgatgtttgataagatttgattaaatctttaaaattttgacctgtttaagacaagaaataaaaagagtaaaatcggcttgaaaatcactatcattactccatccgtcccaatatgtcacgtctggagatgtagcggcaatttaaaattccaatcaaatttgttataaatatcaaataatatttctgaaggaagggttatttgtttttactatgctttacactggtcatctaaacattggtgtttgatgaatatgtgcccatgtaggctcacacgtggcggtaaagcgtccgggttatccgaccagcggagcagctgggcccactgtcagcctcacgagggtgttttcctctctgctaatcgtctgggctggaacaaggctgatggcctgattgattgctgctgttcgagcagcttttgactggacacaggcaaacgttgctgaagagttcaaagatgtgttgtgttttctttttaatttcctgaatagtgaatagtactgtagcatattgatattgatttctacaacccacgcaccagtgctgatttcatgtaacaacaatctgtaatttgtacgtcttttgatttgatgaataataaatttgatgcgtgtttgtttccttcaccttaatatcgacggttgagaaccggttttcttgatcgtccattcaggtcgaaaagtcgaattgatcttgtatttttgtattgcaatatgatacacaactctccaatagtacaatgcaaaagaaaggagttgaccttgttaatcatatttaccacatctttttcctcaaaaaaaatagaacatatttatccacggatataaacatatttattaagtgccacataaaaataatacaaatataaatcattctcaaaaggaaaaagtacaccgaaggtattgttccccaaccacaaaaacagatatatgacattccttaacttataaaaccgttcaccacaggtcttttggtgggtttgaccccgattttatctgatgtggtagctgagtcagcgtaggatccacgtggaccctaccagtgaacacatcatcatgctctccttctttcttctgtctctctcttgctctcttctcactcgcgccgagcaacgctcggcgcggcgaggcaacggtggtcaccagtcgcgactccggcggtgaagggcagcaaccggcgcagggctcagagaagtggcccccacgtgcaagcgagtggcggtcggaagagcagccttgggcggcggcgtgaaactccggatctggggtttggggcagcggcggtggccggatttagggaaaacaacagcggtggtcgttgggcgccggcgaggagtgaaatgggcatttggttgtgtcgtgcagaggcatggccgtggaggacccgagccagccgcacgggctccggctgctcatcgaggaatacccgtacgccgccgatgggctgcctctggtcggcgatctcgcggtggagcgaggcgtacgtggcggcctactacccgagcgacaaggccgtgcaggcggactacgagctgcagtcatggtacgccgaggccgtgcagagcaggcacgcggacaagcgcgacgcgccgtggtggtcacgcctctccatgcccggcgctcgccgagggcgacctggagtacgcgcacctcgtcgccgacccgcaccgcttcttcctctcggcgctgcccagcctgacgcagaccacgacgacatgactgtcatcgacacgctgtccacgcactccgctgctccgccgccggattccccatcgacggccgcacctccttccttgccgtcggctgcgtgttggtgtagtccggctgtccagaccaccgcgcctccttcctgcctccgccacaactcccatcgcgagcggaacctcgccacgccggcagacgacgcagacgtcgcggcgcacggccaagccgttggcgccagcctcaccgaggaagtcctcccgatgctggaggaggtgtgatttatggcgggggtgctccgccagctgctccggccgccgccactctacctgccgcccgcccgctccgccactccatcctatttcaggcgtgcacgggagggagagaatagagaaaagaggggaaaaagtcgagggttcactgacatgtgggacccacgtgggtcccacgctaactcagctgctacatcggacaaaaccagtgtcaaaaccaccgagagacctaaagtgaacggttctataaattgagggatgtcatatatctggtttttcggttgagggatgattttgtaactcgattacaagttgagggaccttcggtgtactttttccttctcaaaaacaaaatttaaaatgtgaatatcatttaggaataagttcacttcgtgaccctcaaaagtgatcgaaatctaatccgtgaccctaaattacaaaaccggatatctcgaccccctaactctcgaaaccggtgcaatttgactcccttgttttggaggacggtttcgctgacgtggcgcctacgtggcggtattgactcggtcttctttccacgtggcgcttaggtgatgttagaaataaaaaatatatgtgggactcatttgtcattcaccaaaagtatgggtgggacccactgacatgtggggcccacgtaaatcattctctcctcatcctccccctctctctttctcttccgttggcgagcggcggccgtgggatgggggccagcggcggagatgttccggcgaaacagaaacgacgaggaggagcggtgtggcgacgaggagcagccgcggagcatgattccggcggcggcaggcgggtgcctttctctgagccgtggcatagagactggagaaattctatatcagttcttgattcatctcaccggtgattgtcatgcaggcatcaccgctgtatatctcggagatagccaagatccgctgtacatctggctgattatcaaatataatcaagcttagttactaactaatggcagatttagtttaattgtatagtaagagctgtacctggatgctggattggagttatggcaggctgtggtggcgcgagtcagaaaagcagtagccgatatcggcgtggacgaacacccaaagcagctcgtcgtgataattgatgccggtcgcttcctcctcgcccccacatgcgttccacctcttcctccacccggtccaccgcgtcctccacgcctgcctcaccccgtgggccgccacgacgcgctacctcgaggccgatcggcctccactgcgccatcgccatctccgccgcaggaatcatgctccgcggctgctcctcgtcgccacaccgcttgaagaaggaaggagagcaagagagaaggggtcgtcgtcgccgctgctccagcgcccgccctcccgcctgccgccgggtgcgctggcaacgtctccgcggggaggggtgggggaggccgacgacaacccgcgggagaggggtgttggtgatgccgtctgtggcggcggccaaggcggtggccggcggcaagtcggcgcagactccatcgtccgtggagaggagagaagggaggaggaagatggggaggagaggattatgtgggctccacatgacaggggctcccacatttttttccgtgtgtatgacaaatgggtcctacacatatttttttatttctaataccacgtaagcgccacgtcaacgtcacgtggaaagaagaccgagttaaaaccgtcacgtaggcgccacgtcagcgaaaccgccatccaaaaccacccagggagtcaaattgcaccggtttcgagagttaggggttgagatatccggttctgtggtttggggtcacggattaaatttcgatcattttgagggtcacaaagtgaacttattcctatcatttacagccagaccggcccaacctagctaggagagcaggctttgcatggcccagttctggcccatgtttagattcttgaaataatctattggcagcggttggctggagaatttgcatagacagatcttcctcctttcgtgcaagacatcgattgttaattagcccgatggaattgacaaagatttgggcaagaaaagttgcgatccttgcaaggtgttggattcgacttgtataacttgaactgcacttctttcatattccttcgttaacagttggttactagtcctaattaattcagtagcaattgcccaaactaaactttacgacaaatctccagctagacacaaaatgttcttttgaatgaagcggtccataattactgctagatagcattgctcaaagctagacggcagtgatttcttttgaatgaagttttgcaaaatgaaagagtggacaattgggcatccttgggaatgttggtaggactaggaatgcagctggtaaatcttgatagaaaacaagcacatgttttgtcaaagaaagaaagaaagaaagcatgctctgacgaaaaacaatcaagcagagaaaaccatatataacaagatatagagctagcctcatcgccgaaatgcagcggcactagcctaaattacatctctgctcaactacaacgatcaccttctcccgaattaactcagcaatatggcagtattgctccatccctctccaagaagtgtctgcttggcctttgcaattgcagtgtgtcttttgctcccatgctgctttggtagtgagtgcctcaataattctagttcttcttggttttctgcatgataatcttcatgctgctagctagctagttggtgccattgcataactacattaggatacagcatgcatgtcagcaacaaactctgaagttagccacagctttctctaacattaacacgatcgttattaatttcatcgtcgcatatgcaggcaaagctgccgtggaaatgttcgagaaggcttgccattgcttcgacgatcacaacgtaagcacatatatatagctataaacagaatcaagttaattaattaactgttaactgtttataatcaagtgtgtttcttcatgcatgcatgtcgcaattgatcattgaaccgaattaataattttgaatttgcaggtgtacagcgagtgcaaggaggagcttcggctgggggtggagggggcgttccatgtggggaaggagagcgtggacgagtactgcggtgggccgtgcctgatggagacgaagatggcgctgcagtgcgtggaggaggtcgcccacgacggcttcaggttctacagcggcgcctcgctgcccgcggtcaaggccgcgctcgacaccggctgcagctacactcctgacagaggtaaattatagtatattaatttagtccaacaaattatatattctcctttcctgaaaatatttttttttaaaaaaaactctcaagatcacgtgcaaaaaaaaaaagtttggacaacaaaaactataataggatatctctctgtgtaaacatgagtgtttaaattgtttaaattctattgacgcgcacaaattaagaaaatatatagaccgcagcatgaaatttctcaaatgtatatggaaaaaaacgatttttataaatttattctagtataaaattacacattttggagtttaaaatgttttataaatcctgtctagaatgccaaatgcttgcatatctatcagacaatatattatcttgagttggggcctcatcgactacccaaaagtttattataaacaccgtaaaggcttattggcgattaaaaaaatatttttttataaaatttttatatgtattcttactatttaatagccaatactaaaaaaagtggtgaaaacatattaaaattaacttcaaattaagttaagtcaccaactacccaaaaatttattataaacaccgtaacatcttattggcgattaaaaaataatttgttttaatttttttatatgtattcttactatttaaaagctaatactgaaaaaaaagtggtgaaaacatattaaaattaacttcaaattaagttaagtttcaaacttaaattttactttgacttattatttttttatccttttaagaccaccaacggggctcttgattttttttattacccatatatacgtgcagggacgtttgagattagggagcgtaagcagtgcggcgacgagtactaccactacagccaccacgagcagacgacggagcagcaatacggtgggtactatggcagcgaggagggcgaatacccaactacgactagtacgcttcctgcttcagactactgctacggcgccggcgccagcagcctaggccttcgctacagcctgctgcagatgctcatgctcttctccgcttctatggtgcttctgctgcttgtaatataaggaatacaatactccgatacagttcatcgttttatatctatactttttactattttttagaatatgtaaaaggattacgcacttttgtattaagaggtataaaatttatacaaacagcaagcaaagaagagagacgggaaagaaaaggggaaaaaggaaaatatatgaacttaagcctactctcgctattacaatgtgacgactgaatgaccaaacaccctaactaggaaactttggcgataggggacaggcgagatgccaaagggtggcctcttgcaccatggccgtgacaaccttaggccagaaccgagaacggttgttgaacacacgactgttcctttccttccaaatagaccaagcaccaagagtcacaatcgtatcgaacccatgacgacgctccctcgaaactttgagccggcaagagtagtgccactcatggaaggaatcagcgccagaggggaaacactgagggaggccgaggctcgaaaggacagtccaccatagctggagggattcagggcacccaatcagaatgtgatcgattgtctcttccagttggtcgcagaagacaataggttgggttcggcagcccacgcttctccaatcggtcagtcgtccagcagcgtcggtgagcgaccagccataggaagtagcgatattaaatccaataaggcaatccagcgaaagagaaaaagaacgggaagaaaaacaaaaacatcaccgggaagccgccgccgacgtcgccgttggatccgccgcgggaagccaccgccaccagatccgcccgtaggaagccaccgacgctgacatcgctgccgttgctcatggtgggggagggcgctgtcgccgacagaaacaaagaggccgagagggagggacggccgtcgaggagagggagaggggaagggacggccgtcattgtcgtctctgctgctgtacctctctacggccgcaccgtgttggcaagacggaagggagagggagaggcgccgccagtagggaaaagagaggggaggggaggggagggggagaagcgccgccggtagggagtgggaatgatctagggttagggtttttttttttgcatggggggttttgattgatttggaaccgatctgagtcgtttatcaaaatgaacggctcagattgatcgagcgttgggccgacctccattgtcgaatcgcagcattgctgggccgcacgcgggccagcagtccaacacaaaacatggttagattttcggttacggcccacacggcaagtttgaggaggagtagggggatatcaattagactttagttgcttcctgggctgaacgcttgctcgcggcctgaggaaagcggaccggctcggttgcgggttgaaaaagaaaatgggctaaaaatggctcttataaaaaggaggatttttatttaaataaatattgaaattatgtttgtattatcaaaattagcaattaagatctggaaattctaagaaaatttcaaaaagtgtaagcaatatggagaatttaataaaaattaaatccaaccatataattttatttctcacacttattttacttgtaaattaacttaattatatacctacctacttagaaaatacccaaaaattctagaaaatatgtattttaattaattagataatgtaaatctttctcaatctttcctcaattttctcgtcttttcttcccgttgtaacacacggacactttttctagaatgtatgtcatagtttctaaaagaatattttaacaaaaaattggtaaacttttaaacttttcgctacaattttagtgcagtcatctgtccgccactaacttgatgcctgctgcaagacaacgatcaattatttttttaatgaactggcgagccgccaattttattgaacagagaaggagtaaaactgtacatacgcaaagcgcaaaaagaaaactttacaggttcaaggcctttggcccgaacatgttagaaggtaagccacctgccgagatgttttgcgcccgccaagacccatgttttggcctcctccttaattttggctatcagactagccaccgtgagctcttggtgctagaagactctgtggttcctttcgttccaaatctcccaagcgactaatagcattatagtccacaaggccttctttggcacttcattggtacatgcggtggcctcccaccacttgagtagtgtcgaggcttgttgctacgatgttggtcttatctgttcatatgccgaccagtctgcgagtgccgcccagattctcttcacgtatgtacactccaccaggaggtggagggccgtttcctggttccttcgacaaaggggcagacggagccattcggctacccacaggttgccaatctatcggaggtccatactctattttggatgacgagtcaagcaaatgttttacatattaaggagcttgcccagcgaatgaattaaggagcttacatattttagcgttgttggtgatcgttaattttttttagatatttctttttgtcttataaaaaattaaggagcttgcccggcgaatgaattggagcttacatattttagcattgttgacgatcgttaatactgattttgatactcagtatcataataaataaatgtgaaaactttcgatggcctgtaacaaaattcaaagatcaactttcgatgatatgaaaccaattttgcttataaactatatcagtgatgggatcctatggcccctaggtatccctcaccggatccgcttgtacgccgatggtgtggtcgcattccttaggccggttgctggggaactagctgcagcacaagggatcctggctctctttggagaggcatatggtcttcataccaacttcaccaaatgttccgcaatcctgatcaactactcgaaggaagaggtcgcagccctcgatgactccctcacttgcccggttgaggagttcccatgcaagtatttgggtttgcctctctccatcaaaaagctgcgccgtgaggacctccagcctccaattaacaagattgcgcagtggctgccactgtggagatcaaattggctccagccagccgggcgcctagcacttgtcaaagcaatgctgagtgcgatccggtttacttgctcatcgccattccccccccccccgcgaaatgggtgctgaaagccatcgacaagatacgacacggctttctctggtgcggtatctttgcatgcggttggcaaccgcatgggggagaaggtctgcaaaaatcacccttttcgcatgcggccggcccaaccacatgcgaaaatgggattttcgcatgcggttgcttatacctaaattcagcaaacaaaaaaaaaataaaaataaaaaaacctaaaccctagcccgccaccgcacggtgccggattcgtcgcccccgccgcctgccggagttgccggcaccggatccgtcgcccccgccgcccgccatcgtcgccagcataggatccatctcccccgccggccgccgtcgtcacgggctccggatcggccgccctcgccgcccgccgtcgtcacaggctccagatcggccgcccttggcgccggatccgcgcggggcggcgccgcccgaggcggcagagccgcccccgccgccgtccgaggtcgtcgtctggtgaggaggggggaggggcggtgaggaggggatggcggtagtgccgccacccgaggtcgtcgccgccgcgggggagggcgccgccgccggatccgcgttgaaggagtacgggggagtcgccggcgacgacagagggaggtagaggcggcagatccaggcgagcggccgctcccgcccgccgccgcctcgcgccgcgccgccctcggccgccgctgttagtgatatgccctagaggcaatcatagagatgattgtatcacatactatgtttacatatttatccgacattgttccttgaaatagataactccttattggttaatgaatatgtgattctttcatgagactctttatgttgttttgttactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttcgatagacccaacatgagacactgcaagagccatatgtgttgtgtcatcagtgatctcatttagtgttggtgttgaatctttagacctgagattatcatggttctcaacatgtgtagtagcttacttagggactgctaaacgctactccgtaaatgggtagctataaaagtagttttcgggtatgctatgaaacatatagtgggatatgaataatcaagatgggatttgcccctcctatggagagatatctctgggcccctcgatgttgtagattatgaaagtgcatggccatgccaaaggtgattgaggagtcaatcacaagttatataatctatcaacaggttcgagtgaatgattgagctattagaggatgacacatatctagccttgagcttaatcgatatcgtgaggcaaaggggttcatacaagtatacactagaggttcagccgatatgatctttatgtatgccaggtgggtcaatacgttctgctaggggccgctgttgacgcgtggaccgaaaaggagttttcgggttacagctgagtatatatgaacctatagggtcgcacgcttaatgggccggaataaggggattggatagagatccaatatgagcttaattcggatagggatccgaataggagtcctacgggccttggaggcccgagtgatggatcctatatattcgtgaggggcatgaccggcggaggcataacatcacgtgagaaaccctagccgtcacttccctccccgagcaaaaccctagctgcgcacgggtgctagcacatctgcgcgtggcgttccgtccctgtacgtgtggataccggtagaggcgccacttgtttgcggtgttgatcggcgtgggagtatggcgaggagaacgcacgaggaggagaaggtcgagccggtgcgatcgactacttcctctacatcgacgcgcgctacttcgcgagagttccttcgacttctcagcgtcttcttccgctgcacagcgcgtcgaatagtaatgatctgtgatctaatacttgcatggttcctggtttacgcgataaaaaattttgatttatgctatcgtagcctacgcgtatcccaacagtggtatcagagccgccttgtatagtttatgatctagatcagtgcatatagttgatgtgcgggtgtagtagatgagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaaattgctccaggctggtatcagagccgccttgtatagtttatgatctagatcagtgcatatagttgatgtgcgggtgtagtagatgagatttattatgttgtatatgaggtgatcggaacatgagatgaaccgatggtcacccatcccaaattgctccaggctagtatcagagccgccttgtatagtttatgatctagatcagtgcatatagttgatgtgcgggtgtagtagatgagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaaattgctccaggccaagcacgcttaaccctggagttctttggagattggcttccggaaaagaagttgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagattcggctctgataccattttgtaacgtcccgccttcccccaggccgggcccgcttacatctgatagctttcataggtcatagactgccctcacagactaacacatatcttttctgcacactttgtcctcactcgtgtgcacccgggaagaatttcccggtcggtcacccatcctaaattgctccaggccaagcatgcttaaccctggagttctttggagattggcttccggaaaagaagttgcaacttgttgatataagtattctattaatcctattaagccctaggccgggatgttataaatgtctagtactcaccaaggccaagcgcgattgtgttcatcggatagtccgatgtccactggaactgcacgccaatgagaaaaaacgagccaatgagattgactcggcttcggcataatttgattacgccgttaaggttttcacatagcgaatcgtagatgagatctatgtaccccgggactgccgtgtgcgttgccccttagatttcgcttggggtttttatatctatcttactttattgctgttatatatttgatatgacatggtaggatagattccctcagaaaaattaagtgaaatttatgctctttcaataattgcacctatttcggttgtgatcataagtgatgggtttgacatagcaaagtgtcactttttatcatgataaaataggatagatgtcggacatctatatgcggagattattggtttacttgacaagggtatcaaaacaattttggaccttggggcataggttgggttggacatggagatgtcaccccaacaggacatggagatgccctcggccggcaccacctcgcgccgccctcgactgctgcgcgccacactgcgctggctcttggtctgagagtgagatagatagagagagagagagagtgaaagagagaagactctaagaggagaggaagggaaggactagaagataaaaggataggtgtgaaaaattttaaactggtggagagagaaggaagagggaccatttttacatgcggaccacttaagcgtccgcatgcaaaaatcatgtgttttttaaactttaaattgatttttatgacattaaattaactcatatcaaaaagttgtcaaaaacaaatttgtagaatacattgagatctaccaattttattttggttatttctccatccgagtttgattggactatacaaaatttgagttttaaaatataacaaattaaaataatttttcgggtagtaaatgattttaaatggaaaagtcatcaatagcaaagttgtatagctcatcaagatctacaacttttgttttggtcatttttatatttgactttgtttacacagtttgaatttgaatttcaaaatatgacaacttcaaacaatatttttaaatactaaacgacttcaactgaaaaagtcataaataacaaggttgtataactcatcaagacctataacttctattttggtcattttttcatccgacaaagtgatttgcaagattgtttacaaaatgtacctctcttatatagttttataagaatatataagagatgtacattttgtgaacaatcttgcaaatcactttatcggatgaagaaataatcaaaatataagttatagatctttgttgtcgaaacgaaaactgtatacgttgaaagacgtggttactcaacagtgcttggaaaagaagtaaagtgtattaaattgagaatttttcttaggatcccctattacatggctctaggagactaattatagcctcattacaggttcttactactagagtttaggttacacaggggaatttacacggttgcccttacgacagggacatttatatgggcatacagtgtaattaaggtatatggactcctaatgggccgccaggcgatcgctggcccaacggccattgggcttgagaagctaggatggcctcatcggccttagcgaggccaaacttgctatggtgaagtcatctcccttcagcatacacgcttcgccttacatccttcgcccaagaggcctttggcttcgcgaggtacccacgcgattctccttccttcgccgtccttgctccatagtcttcgccatgggggcttcgccccgactaatctggacgtctcaggcttgaatcctcgctggtctcatggttttggcaggtttggtcgaagggcctcatgtcatactgccaataatcttgatgagttatacaactttgttattgatgactttttcagattaaatcatttactgcttcaaaatattatttgaagttttgaaattcaaattttaattgataaaacaaagtcacaagaaaaaaatagctaaaataataccagtaagaacacaataacatgatagagcattattttagaaacatttaggaaaaaaatcatccaatttggagttcatataagtgagatacactagtttcaaatttttcaaattttattttcgcatacggctgcttaagtggcctgtatggaaaaatcgatttttccatgcgggcgcttaagtgagccgcatgcaaaaaaaaaaaaggaaaagtacaccgaaggtccctcaacttgttagcgagatacgaaaacgtcctcgaaccacaaaaccagatatgcgaggtcccttaactatacaaaaccggtcacccaaagtcccagggcagtattgacgccggatttgtcctatgtggcggctgagtcagcgtgggacccatgtgggtcccacatgtcaggatgccacatcatctctttttccccttctcttcccctctctctctctcatcctctggtggccgtcgcgtttgttggtgacgtgcggacgacgacggcgtaggacatggcgtgcgtccggaggaggttcgcggcgacgtcgacgccgatggcgcccacggcgcagctcacgcccctctacttggagcttccccgggggaaccctgtgctctaccgccggagcacgtggacgaactcctccttggtcagattgctcatccacaatgatctcgttaaacttgttctcacctgcttcagatcatcccccataatcctccaagctgaaattgatgtcggcctccagccctccacgccgcggaacttgatcgccgctagatcgtacgtcctgcgattgggaaaggagcagaaaaacaaaggtaaaaggagcagaagcgagaaatgcccaaaacaagacgaatccaataccaaacccgtccatgctgctcttcttttgctccccttgcctctctctcctccttcctccttcgttgagctctcgaaaatggaaagaacgagcaggagacgaggaggcttaccatatgtgcgattcccatcgcccggtgcggcggtagaacttgacgccgcagtactgcgagctgcgcgaccgcggcccgcgtcggattgggcgtcgcgtcgcccgcctgcgcccagcccgccgccaccacgtcgccacaccatcccgccgccttttcctgcctcgccccaccggcacgaagggggcggggaggacggcgagctcgcgcctaaccacacctcctcctcctccgcctcaacactcccagctccctccctcccacctcaccaccatgccccaccgcggcggcgcggcgtgggcgagcgctgcgcagtacggccggcgtcgggaaagggcgccgacgacaaccatgcccgctgctagggggccaccacctccgccagccgccgcgcgcgtgcccgcctgccgccaccgccgctccgcgtctctgcttcgccggccggcctgcgagagaagagtgagagagagagatgggagaaaggaagaaaagagggggagaggggggttgacgtggcacgctgacatgtggggcccacgcgccacgtaggtcaaaactgggtcaaaaccaactaaggatctcgggtaaccggttttgtataggtaagggaccatgtatatctggttttggggtttaaggacgtttttgtatcgcgctgacaagttgagggaccttcggtatactttttcccatgcaaaaatgagctcatttttgcatgtggccctcttaagaggcccgtatgggaaaaatcgatttttccatacgggccacttaagcggccgtatgggaaaatgaccctcgatttttgcagacgccactagttatgatccgtttgcaaaaatcatggggcctcgtgaagaaaaataacttttatagtagtgtatctatgtttttttttttttttgctttatctgcctcatgatgcactcgtatggacgaagaattagcgcgaaatcgaacggaaacatgatgaggatcggaaagttaccgattttttaagtagttaagatattgtccgtagtaggtaccaaagtttctataatttctgtaccctaattcagtttttttttttttttttgctattccgatacattttgcgagaaaacaacgtatgcagcagtactttattttctaatttttgcgacgaacattgaattgacattgacgtagtaggggttttaatctctatagagaatcaagggggcagcataccccaaataaatggaaaattaatcagctcgtatctgatacgggtgtaaacgatggtaataaggtcgtgatatccggcctgctatctggtgccatgcatatttctcagcatttacagctgacgatcgagcacaaaatcacagggatgcaacgatataatatcttaccatgtgtaggcaaataatcagtacgccttcccacagccacgcccgcctataaataacgggccggcattccaccgtagcaaatcatccattctcacaagcatatagccactatcataacaaaagcttcaagaattcgtagctcatggcgaccacccacgcccagcgccggcgctgccttctcttcatggctctggtgttcgccgtggcggtggcggccgtggcggcagcgcgtccaccgccttccttctccggcacggcagatggtgacgacggcaacgtcctggtggcggcggccggttctcgcggcaaccgtgttgggatcatgcatgatgttcctagcggcccgaacccgatacacaatgaccaccctcctccccatcatccacctagctcgtctcgagtcagaatcatgcatgatgttcctagcggcccgaacccgatacacaatcatcaaccttctccatgagtgggctaccctagtttgaagcacgtacttttgcattacatgctgatgtgctagattgatgattcaatgcgtatcagatctcgatgtttatctgatcgatcttgagctagcatcaagtgagcatgtacgcaagttttgttaattatcaagatatttcaataaaaagtgtggtttattgtcatgattgcatggataatggaatatatatagcgtaggttgttttgatttatcattggcttctcgtatcgtcttcgtttgaatgttatgaatggcacgcgttattaattaatgaattcagcagtgaacctacctagcttggaatgccagaaatgagcagaaccaccaactgaaagacataataagatgaaacacgcgatcgattgatcgaagagaaccgaacaagctagacatgagaaaaaaaaaggaacataaattaaaacaatgaaattaagacaaaattaaaccaacagatatgcgggtcaccaaaatggagtatttgtgcctcctaaaagcacatagtaatgaataaagttattgaattattgttgtaaaaacaacagaaatgcgatggcagattggcatggataacgagcaaaactttgtcttcctatgtgtcctcctagattttgctttaggaaagatagacttgcaaatataagcatagacctgggaattcttttttttttccttgtgaagaaaatatacctataattatttttcacggaactaattaataccagtgaatcagaatctctcgtcgaggaattgcttgggagaaggaggattttaagcatatatggacacaataagatcgatcaaaattttagctcttggattcaaattttgtaagtgtacaagagaagagacaagagaggcggtgagatgttgaaacatgcagaaatcagggtatatttgaaatcagggtatatttattcgagtgcatgcataccatatacgagcccaaaatttatgccggttttgggccaaatacgggccttccgaacagacaaattatggtccttatatatttgcggtggatatttctataggtagaaaataaattatgttcttaattaataaatctatatactaatatatggttcgccatttttatatattaagatgccatgtcgagcacaatctaattaacatagtacagtataagttatcatatcctagctgccaacgaaatataatcaagatgttacctttcaaaattcaaacagaaaagaaggaaaatcgcagtatacatatagtagtacctctggtatcatataattaaccggaataaagtacttaccatacgacacagatacctttacataactggtgcaattaatacttttgccaaaaattaaaaaaagaaggttctgccttacaaaaacgccattagaattccataacacgatggggatcgatcgatcgatcgacgtccaacgtcgcacccgataataaacttaccaataaaggaattaggtaccaaaatttttttgtacctgaggtactactcccgtatctaagataccaaattttacatttaaaaatatgatacctttgataccttcttaataacgatgataaaattaccctaccaataattacaacgcacattccatacttatgcctataaaaatacagctccatcgcatgcagccaagacgcactcgcccatcgtcgtcgttgcacgaagctagctagctagcatcttcaccgccgcacaagcagacacagctagacgacgtcgtcaacaatggccaccggcgccgccgctgccaaccacggccgctgctccctcctcctcttcgccgccatcgccatggtgctgctggtgttcgtggcgacgacgacggccgcggcggcgcgagatgttcgtcgtcccgccgccgtggagaagaagatggcggctgtgatgaggcacgatgtccccagcagcgggccgagccccgtgcacaacggcgcgccgactcctccggccgccgccgacgagcccacggtggccgtgacggagcgtctggttcccaccggatcgaacccgttgcacaacatgcccagtcctctacaaggccgcacaccgaccaagaagacggttaattaattgagatgattccatcatgctcaattccaagtggttattaattaggaaatttaattatatagagaaattttatagttcttgagtattttttacaaatcttcgtaccttatatagtatcggaaatataaaatttggtatccctccgtaccttctcgaggaccgtaaaatctcttagatagatatgcatgtatcacagatgcttattataattattaatcaggtaccatacaatatgttttgcgtgagtaataaataaataaagagatttgcccctagttagtcgtactgttaatttatcatgtgcgtgattttgtatttggttttaatttgtgtgcaatggaagattttgagtttgaaattttcaatattggtatgttgcgtacttgcgtgttgtgttatgcgcctggccggaggtttccttgatattgattgatgatccctcttatctgacgatgtttgccacgtacgcattcaccactaacactgagaaactaattattttttttgatagactgagaaattaattattggtaacatatcgagaggattagattgcttgttcgatgtcaacactgagaaattaattattggtaacatatcaagaggattagattgcttgttcgatgtgtggaatttgctggtttactgttcattcttatcaaattcgctttaataataataataataataataataataatattattattattattattattattattactattattactattattattattattattattattattattattattattattattattattatgcgcgtgaagtactgaaacctgttgaaaaattaaggcattatattaagctgtgtgcataccttcgtctttgaacttcgatcggttttctgaactctctctccttttcttcgcttggtagattctctctttttttttctttctcgctggtaccgtttttttcgctgtttctttctctttttttttctttttcgctgtttttaccgtaccgtacgtaacgtaattagtttagattagtttttttactagtgattagtttactagtaatttttaattcttaactttaaaatttaaaaatttggacttgaaactttttaaatctcgagttgaaaattttctaatctcaagttgaaagttttcaaatatttcaaatctggacttgaaagtttttaaatcttgagttgaaaattttcaaatctcaagttgaaagttttcaattttttcaaatcttggcttgaaagttttcgaatctaagttgaaagttttcaaattttttaaatctggacatgaaagttttcgaatctcaagttgaaagttttcgaatctgagttgaaagttttcgaatctgagttgaaagttttcaaatccgagtggaaagttttcaaaatttgacttttaaatttaaatcttaaatcaaaagttttcaaatctaacttaaaaattttcaatctgttggtacaaaaatctcccaaaaaagaaaaaaaaatcttgagaatcttccctaattactagtcattagtagttaagtgggtgttaactaatagtactatagataattagggaggtgaggtgctcgctgctggcgcgcacgcgccagctagcagccccctgaggtatatatttcgtatgtatgcaaagaaataaagaaaataaacgttattgatcaaaagaagcccaacaagaaagcctagcaggctgcctccctcaaattcgaacccaatttacaaggttgcctaatttgtacattaactgtgctgtgatggcatgatactaatcgatatatacttggttggtagattgtactgcatatgttctttcacaaagtacatcataataaatcaagaaatttgctaaaaatcttgtcgcaagttctaattcaataagcagtactaaaataccatattgttgatcatacgtatcaaatattatgctcgcgtgttgtaaaatttttttttaccccctttccatttcgaatacccaatctcaaaatcttgggcccgcccggtatgaaatcgattagtccgatggtagttatggccgtaatggccccattgttttgcttatttgtggaataagctaattaaacaacatatttgtaaacgaaaaataattcataaatacaacttttatatacttgctcttagcaatctaaaagtaaaggttgaataataaacttcgatgaaaaaaccctaaaattaacttcaaatttaaggttgaaaatttaaattttagcttctattaagcgttgacttagtccaacgttagttactcatacacaaattgatctgtgcgactaactttcaaatttgaaactttcaactctaacttgaaaactttgaactcaaaattaaaagtattaattcaaaactttaaaaacctctagccaaattttaaaattttcaattcaaaatttcaaactttcagcttcaaattctactcatattttaaaactttcaaaataatttattttttcgtttttctataatagttaaataaaacgctaagtatactaggctaattagtgttctcgatatctccaactacaaaaataaataatttattatattattaagacaactttgcaaggagcaacacattcgctttgaaggctagaaattcccacattaatcagagaaaaagaaaacaagagtctcaataggaatacatctagaaataactgaaattcctcaaaaaagaaataactgaaatttgtaataaaaagtaaaaaaatataaaaatatgagtccatgtacaacacaattagagattaattgaaatttgaagtaaaaacaaaataaattccgaaattaaaaataaccataagagtttaagttgcaatactatttagaaataactgaaatccggaagaaaaattaggaaatattgaaagaataattcatgtagaatacagtgtgagattaattaaaatttagaataaaaataaaataaattatgaaacattaaaaagaaatataagagtttagatagtaatataatttataaataactaaaattcggacaaaaaagtaagaaacattaaattaagaggccaagtagaacatatttagagattaattaaatttggagtaaaaaataaaataaatttcgaatttaataaataaaaaagttcatgtaggaatacaatttagaaacaactgaaaatcgtaacaaaaaataagaaatattgaaagaatagttcatgttgaacacatacaagattaataaaaatttaaaataaaaaatagaagaaaataataaattagcaaaaaaatataatagttcagctaagaataaaatttttaaataactaaaatttgaataaaaataagaattattgaaataagagaaaatttaaaacacaaacaagattaattaaaagctataataaaaaataaaataaattccgaaactagaagaataaatatgagaattaagtagaaatacagtttagaaataactgaaatttaaaataaaaaataaatattgaatgaataatgtgtaggactcaatacgaggttaactaaaatctggcataagaaataaaaattcggatttaagaaaaaaaactagagttcaaatagtatgaatttataaataataaaaatttggataaaacaataaaaaaagtattgaaaaacacttgatttaggacacaacggtggtgaatggcagaggagtaaggggtatccgataatgataaggtttgtaagacgaatgagatgcctatttatccgataatgataaggtttgtcaacaaaatgccaattgatagatctccagggcctgatggattcaatggttgcttcattaaggcctgttggcctataattaaacaggacttctataatctttgtgctcaattttgttagggttctctggtgttgagagtattaatatcctttataactctagtccctaagaagtcttctcctgaaaaggtaaatgacttcgggccaatttctttacagagtgtggctctaaaacttcttactaaggtgctggctgataggctacaatctgtcatcattgaattgatccaccaaaaccaatatggtttcattaaggctagaaatattcaggactgtttggcttggtcttttgaatatctgcatcagtgccagcattctaagagggaaatagttcttttaaaattggattttgagaaagcttttgatactattgaacattcagttatattggacatcatgaggcagaaaggctttgatcctaaatggataagctggatttctcagattttttcttcagcctcttcttcagttatcctaaatggtgttcctggcaaatccttctattgcaaaaggggtgtaagacagggtgatccactttcacccttattatttgttcttggagctgacttgttacaatctatagtcaataaagcttgttcttagggagttcttacaatgccaatcccaacacctagtaatgaatttccgattgtccagtatgcatatgatactcttctttttttgactgcttcccaaaaagagcttttctgtctcaaggcaattttgaacacttttgcctcttcaactggccttaagattaactatagtaagtcatgcatgattcctctgaatgtagatttggaaaaagttgatcatctctcaaaattgtttggttgctctattggtaagttaccttttacttatctgggtcttcctcttggaaccacaagaccaagattattgattttgctcctatagttgatagagtagagagaagactctcaacaaccactgctttgttatcttatggggacagattgaccattgtgaatgccgttctttcctcccttcccacttactacatgtgctctctttcactttcaaagacagtcatagaaagtattgatagagctaggagacattgcctgtggaggggatatgatattaattctagtaagaagtctttggttctctgggaaagagtttgtcatccgaaagatagaggtggtttgggtgtaatagaccttagattgcaaaataatgcccttctcttgaagaatctgcataagttctataatagatatcctgttccctgggtcagtttgatttggaatacttactacactgcagaacctcctcatgctattactcctaaaggatctttttggtggagggatgttttgcaatttgtggatatttttagaggcatctcggcatgtactgtgcaagatggaaaatcttgtttgttttgggaagatttgtggaacaataaagtcagggccttggtttatcccagaatatattgttttgccaggaattcaaatctctcagttctgatgttctctacttctgatctacctcagctctttgccttgccactttcagagcaagcttttcaggaatatttggcaatgtcatctgcagataccttggagcatcttaatgatgagagtgatcgttggacatatgtttggggcaacggtattttttcctcatagaaaatttatgccatgaatttttctcgtgtccatgtgcctatttatattaaatggatttggaagagcagttgtactatgaaagtcaaggtgtttggttggctcctcttgattgatcggttaaatacttatgacatgttagacagaaggcattgctcccctcaaaatgcttccttgctctgtgtactttgttcaacaggatcaagggaaacaactctccacttatttttccagtgtccttttagcactcaatgttgggcgcaatttggtgtagtttggaatctttctttaagctttggtgaaatgttggtcacggccagaaattcatataactctacccattttgttgagaaggtgctttatgctgcttggaatatttggaagcagaggaatagtttaattttttaaaacattgttccctctgttccctcttggagagttctctttaggaatgatctctcccttttagttcatagagtcaaaaattctgaaagagatacattgttatagtggttaaatttgttgtaattttttcccctttattaatataaaatcttaacggtgggggcttcccctactgtggttctttaaaaaaaatgaaattcaaagaaaatcatgtgtaaaaaatatataattttgtatagatattagccacgcagttacacagaataaaaagaataagtagcgatgaaagaagagtccacgtaaaatacaatatgagattacttaaatatagagtaaaaatcagataggaatacaatttagaaataaaaaaattcaaaataaaaaataatgaatattaaaaaagcatatatctagaatataatagttacaaatgacaaaaaaagaaaaggggcaagacgagctgcaaaggtgtatggtggtgacggttgatgggacatcaccccaatgatgattaggatcaatttttagaattctaatgacgattaaaaggaggaacggtggcgggtagaccataaaggagtaggttcgcgacgattggcgggacttccagagtttaaaaaaggaaaccaaatatgatcaagtttaatttttcaaatccaagtaacactaaaaagggatgctgcgggcaagccataaaggagtatagtggcggcatttgatagtgcttctaaaaactataaaaaagaacataacgtgatcactaaactctaaaaaactataagatttgatttttaaaggttcaatggtgtataaatagaaatcgtggtagaccggaacgggtaaagaatctactacacgacaacacgaagaggccattgttactgatctgctattctggtggtcatgagaagctatagctagaaaccagtgaattaggtggagcaaagtgtggtttactgtaatgttttatcaagtaagccatctcattagagcatctaaaaaggctagaaaaactataaaatgctaactgctttctccttttttagcagcatatcaaggctacattgctgcacagcaattgacacatatggtaattgaccaaaacaaaaggaaaacaaatcacaacattttaatttgccactaaaagagctactagaatgtgcacttcttgtttcttatgttttcttatagctagctataggatgtttcttcctcttaaaaaatgattttttttaaaaaaaaatctagaacaatcttggtcgaactcagttagattttgttcaattttaaaattttagattgaaatttctgaaatttttgtcccctaaaatgtttttacttcgaccaaagaaagggagagttggtgaagtcaaaggtgttctctagattcatggaaggatttttttacctttttttttctttccgaaatattgaaccatgttagctagatgccgccgcctaactggatgcctgcatgcatacattacataatactcctacatggatt

SEQ ID NO: 35767 - DNA, 8357 bp, Oryza sativa
ttaaaaaagcatatatctagaatataatagttccaaatgacaaaaaaagaaaaggggcaagacgaagctgcaaaggtgtatggtggtgacggttgatgggacatcaccccaatgatgattaggatcaatttttagaattctaatgacgattaaaaggaggaacggtggcgggtagaccataaaggagtaggttcgcgacgattggcgggacttccagagtttaaaaaaggaaaccaaatatgatcaagtttaatttttcaaatccaagtaacactaaaaagggatgctgcgggcaagccataaaggagtatagtggcggcatttgatagtgcttctaaaaactataaaaaagaacataacgtgatcactaaactctaaaaaactataagatttgatttttaaaggttcaatggtgtataaatagaaatcgtggtagaccggaacgggtaaagaatctactacacgacaacacgaagaggccattgttactgatctgctattctggtggtcatgagaagctatagctagaaaccagtgaattaggtggagcaaagtgtggtttactgtaatgttttatcaagtaagccatctcattagagcatctaaaaaggctagaaaaactataaaatgctaactgctttctccttttttagcagcatatcaaggctacattgctgcacagcaattgacacatatggtaattgaccaaaacaaaaggaaaacaaatcacaacattttaatttgccactaaaagggatactagagtcgacctgcagcatgcactcttgtttcttatgttttcttatagctagctataggatgtttcttcctcttaaaaaatgattttttttaaaaaaaaatctagaacaatcttggtcgaactcagttagattttgttcaattttaaaattttagattgaaatttctgaaatttttgtcccctaaaatgtttttacttcgaccaaagaaagggagagttggtgaagtcaaaggtgttctctagattcatggaaggatttttttacctttttttttctttccgaaatattgaaccatgttagctagatgccgcggcctagctgcatgcctgcatgcatacattacataatactcctacatggattgttctagaagcttctagttgtttttttaattattttcaagggtagaagagcttggtgtagaggagctcgttccacgtgtcctgcaggccggggaggcaccagtggacgcagtcggcgtaggtcttggggtcggcgagctgctccggcgtcggcggcgtccactgcttcttgtacaccgacgtgtgcgcgtccttgcggtacagcgacagctgcgtcacgttcaggaacgtcaccggcacgtcggcgccatcgccgtcgagcacctcgccgatcgcccgcatcaccccgcgccggctgtcggagccccagtacgcggcgtcgccgatcatctccgtctcgccgtagcagttgccccccggctcgccgccgccccagtcctggctcttgccgtgcgtcggcgacatgctcgtgaagaagactcgcgtcgtcgcgaagtccatgtgctccctcgcccactgcagcatctcccggaacgccatcgcgtacgcctcctccgtcgacacccacgtcgtcgtcgacgagttgccgccggcgtcgaacggcccgtcctccctgcgtgtctcgccattagtgtcgttgcctgcttgctatggttaattatgttcttgggatgcttacaggattcggaactggaggccggtgcaccaccagaggtaggtgttgaagacgatgacgtcggcgccctcccagtggcggccgtggtggccgatgctgccgcggcggaccatgcggtcggagatgcggtggacggcggcgttgtcggcgttggactggaggaggaacggcgcccagtagaactccacggtggcgttgtacgccgcggcggtgaacaccgagcgctgctggtcgggcgacgtggcgaacgacctcgcggcggggtcggggacggcggcgaggaggaggcacaccagcgacgtgaactgcccgcgccccagcgagtcgccgacgaacatcacgcgcttcccgcgcagcctgtccagcatcgccgccgcgtcgaacgccgggagggcgcagccgcgcggctgccaccgccaccgctggtacgccgtctccggccgcccgtgcgcctcgcacgccagctgcgccgggatgtaggggcagtccgcctcccggtacagcggccgcgccgcctcgtcgcgcacccacctccccgagaacacgtcacactcctcctcctcctcctcgccgtcgccgttcgccgcgaacggcagccgcccccgccacctcctcgtcgtcgtcctcccctctgctcccatcgcacaacacgtcaaaacaaattcgagctagctatcaactgcgacgagatgcaccatgcatgcgtggtgacattaccggtcgtcgccgccgtggcggccggcagctcgatcccatcaccggcggcggcggcattgaagtggaggctcggccgcgcttgagcttggctgccgaggagctccttgaggtcttcgccgtagaggaaggagaagaggaggaggaagagcacgagcaggaagacgaacggcgagacgcgcgccctcttggccaccggcgacggcggcggcggcgccttcatctccggcgatctcgatcttggcgttcaagcttggaggatatgatcagttttggctggggattatataggctggatttgctagctaattactgcacttttttttaggataaataaaattaattagtgctaataatgtgtgagctctttaaatgttgcttagtcactgtcagaattgtgattacagatgtttgagctgatttgttacctgacagtcattgtcagtattggccacacactacatgtgtcaggaggagatgaatctgcaacattttcagtgcctaatggcaggctgagagatctattgtttggttaattaacatccaaatgagagtcattgtggatatgtaggaagaaatattattacaaatattagtaatgctcttttagtttagatgggtgtatcagatcaggtaggttggttgtttcatcaatcatcagtgatcctgctcaatctgtacctctgtgagctttcatctctgcataaatcaacatgtacaggctacagggatgcagtatagattggtactaactagctatatcaagtaggctgtcaattaaaaagtaagcaaccaatgcaagtataacctattatactccctccgtcacaaaatataagggattttgaatgaatgtagcatgttcaaagtcgtagtactaggatatgtcacatccacccaaaatcttttatattttggaacgaagggagtattatagaagttcaattatatttcagcggctaattgttccgaagaaataaatgcatttttttcctatcactaaacaaaaagattaggccatcttttctccttttggcattgtagcctacagctaagcaagatttgggcagttagaattcatggccaaccaagaacaagaaaaatgggagtcagaaaaggaaaggaatgaaatgcaacctactaggcaactatcccaactgaatcataccaatgcttactgaacaagggtagttggtggtgattcatatatatgtcagtaagtaatgctgaattgctgataaacttatctttttcttggattctaagccaagagagagctggaaagaggtgcaaccatcacataattcccaaaaggacattataaatactgaacatcaggttcaggtatgcccctatatcggtcatgtcagaatggttgttctcatcttttggttggagcaaagggcatcaggaatttgactgtcccatatttcctgttcatcaactttatttgtaattttcctttttatctttttttccctctcctagtgacacttcaacaatatatacatgagttggttggaagaggcaaatgagtggcagattgttcagtcataggagtttctggttgcattgtccttcaaggaaaaatcaagcacctaacaaaatcctgtgaaggaggcacaaaacctccctaatggctagctgagaattttatggggtacagaagagtggaaaaagtgtcaattatccatattctctgtgatggatttgcaattcaacattatggatggtgtatttgagaagttatgaatgattagataacttttccccttcgtcctttctgtctttctttaatttctttcttttctttcagtacagtgtacttgtgtactgctgagtgataagcaaaataattgtcaatgcagtttctagccatttggcccatggaagaaaaagaaggaactcatgacgtgaatttaatttatcattagttgttaaaagtactagtatctggcagcttaattctacaatatgaagatatgatatcattggttacgtttttgcttgggttcagaaagtaaatgcgaatcaacaggaagcgactgcactagattagctagttcctttccttcatgaaaaaaaaaacaaagcaaaaacaggttagattatattaaaatagaagagattacaaatataattgagaaaatctatcaaaaaagtgctccacatcttaaaacgcacaagaaagatgagcacgactacaacgctgataaactacggcacatataaaagcatatgaatgagtatcaatcaagagagaatgtctttgttccttgacaaactaacgccactgaacaagtcggcgacctagctatgagtcggcatcgctaatttgatcatcaacaactcgatagacacgccttagctttctagatcttagtcgatgacctcacaaatgaagtagtcattaattataacaaattaaatataccaaactcgatgaccatcttgaatggaatgatataccctgaactatctcatcctccaaaaatttcatcaaaaagaagtccaaaaacttactagaaatgcctgtatggtgatgtttggatgcccattcagattacctgctcaatgatagtcaagacacaaaagtcgacttaatttctaagttccaataatatttgatgtttatatatattgtactcgcaagcatgcaagaactactgcaccaggttaggtgaatggtccagattgtccaaaagttgcagatggaatattcagacctatggatcggacaaatttaaagtgtactcgtttgaatcattgatcatagctggagaaaaaacctaggagctggggataactgacatgatatatatggaagactctcaactaacaatccatggcgttgctggttgtagttgctagtacacgtttgatagaaaactaggttccttttgctttatgcctttatacaagggctatataactgctcctccaactaccataccctagctacgtctgtcctgaaaatgcttgaaggtagtactgtcaacagagtagttagcatttaattttggcatgtttgaacattatgaactgttttcacgtgaaaataatgtgtttttgttccaaacaagtcataggcataccagttaaacatcatagtatcattgttaattaatcgtataactttgtgtgaatcaccttgaagtatcatttcttttaaatacatgtatatcaaataagcatcgagtttgtggtggtggtagctagatctagagtcgtggttcacttatccaccctaggggtgaaatcagatggatacggtcagatcatggcatttccgcatcataacccatatttttctttaaattcgaaactaggtatgagtaatgttagataacatatcactcacccagctattatcctatattatttcctctaaattggattcgggaacagatatctatttgtatctctaattcattgatattaaatatagtgatgcaattaaaatgttaaaaaagatacatcaagtaaaatagtgattaatcaatcttttatcatgttttaggtgaatttataatagattttcatatatattttataatatgggacatacgagtggatacaactcttctcctattttaacccaattttttttacaaattcgggttcaaacttggatagtaccgagtatcctattttctatctcatattcttcccgcaagcctcaagtaaggtgggtggtcggaaatacctatccaattttcacccctaatccaccccgcaactccaccaaccacctacatttatgcacacacagtgctctttcaacggtaaggactcctttaggttgaagggattttcattaaaggaaatctagatgaatccaatcaatgacaaaatatctatataagtcatttggtgtgtaggattacttcaaaggaaaaacgtataaaaggaaagttccttcacattttgaggaattttagcatgatgtctaacctcatttttcaaattcctttgggacttccaatgcatcctctctctttctctttctctttctattttctctctaacatgtcaacatataattctaatttcctgtgttttcctgcagtacatccaaacacatgttttgaggaattcatgtagaattcaacatggtgtgacatctcaatcatatgtgaagcaaaatcaatgttattctcgttttctgaggaagccgccgccttgccaggcaaagggattcgtcatcaaaagtactttcgtataattatactttaatatcacataaataatatactagagaagcaattgaaacccttatgctaagaaaaacaaaataatcatatattttaaaaataatccctccccattaatgaataaaaagttagcatcatttaatttaataaattaaaatttattgaataatcccacattggttgtggaaggacaaaggaactaatatataagtggggggcccctcacctattgattagtttttgggatgagaaatgctctttacgatcttacaattgatattagagcctcactagttcaacatctctgacccgatggacaaagtgtgtaaagacctgatggaccgtgggcacctgcggggactgtatacctgagggactgttgggatacggtgaaagggcggtgaacggctgagagacaccaatatgtgaagggaagattgttgaatagttccatattggttgtggaaggagaaataacttaatatataaatgagaaagcccctcacctctcattagctagcttttgatatgggaaagccctttacgatcttaaaaaaatgaccaaagagaaatatatagtctaatgatatttttgtaacctttttaacagcttttacctaaaatggcagtggaaaaggataactactacaatctgcggcttgatgggagaagacctttttttttacagcaggatcgaaagaaacaaaatagttgatgttcacctttttcttttttgagaggatacttgggactgtctataaatttatcaacaattcatttcattaaaatcatacgaatgtaataataataataataataataataataataataataataataataataataataataatataactattacaatgtaggtagtatatagtcccatacaaataaaagaaccgagttacgcaatagaaatgtttctgtatttacgtgggacttatattctactatttactacatgctagttacagttgcatgctggagtatattttaattacaccaacatatgtgtgattttaatgaaataattatcgacaaacgtataacaaaaccataagaaatgcttcattttctctcttggagacccagtcgttgaatagggctcgacaacgattcccagatggagccgatgctggacagaacaaacacaaagctccagtgacgtgcagaccgttcgtagagagcccaaaattattattgtctggcaccgtagcacccagctaaggcccaagagccgagatcaaatggacacggaaaaagtccactttatttccctcaactacgggtcgagtttcatcggtgtcccttattcgcaaaatcaggtatatagcgttccccaactatctaaaaaaccgttgtaaagtccttcggcagcttcctagggtggttttagctgacgtgtaatcccagtaagcgaagataaaataaaagaaatatgttgaggccgtatgtcggtgggatccatctttcctatattccttattcctcactctcctgtcgcatgtatagatggccaaatgagccgccggctagctcagtttgagcacgacctagcccgggcccaagatcagtcgggccggcacgacccgacctacatgccgggtcgtgccatgcccgctcatggactgcaccaacggcctaggcacgacccaataagactcgggccgtgctcctcctt

SEQ ID NO: 35768 - DNA, 5050 bp, Oryza sativa
  unsure (1)..(5050): unsure at all n locations
tactacaatctgcggcttgatgggagaagacctttttttttacagcaggatcgaaagaaacaaaatagttgatgttcacctttttcttttttgagaggatacttgggactgtctataaatttatcaacaattcatttcattaaaatcatacgaatgtaataataataataataataataataataataataataataataataataataataataatataactattacaatgtaggtagtatatagtcccatacaaataaaagaaccgagttacgcaatagaaatgtttctgtatttacgtgggacttatattctactatttactacatgctagttacagttgcatgctggagtatattttaattacaccaacatatgtgtgattttaatgaaataattatcgacaaacgtataacaaaaccataagaaatgcttcattttctctcttggagacccagtcgttgaatagggctcgacaacgattcccagatggagccgatgctggacagaacaaacacaaagctccagtgacgtgcagaccgttcgtagagagcccaaaattattattgtctggcaccgtagcacccagctaaggcccaagagccgagatcaaatggacacggaaaaagtccactttatttccctcaactacgggtcgagtttcatcggtgtcccttattcgcaaaatcaggtatatagcgttccccaactatctaaaaaaccgttgtaaagtccttcggcagcttcctagggtggttttagctgacgtgtaatcccagtaagcgaagataaaataaaagaaatatgttgaggccgtatgtcggtgggatccatctttcctatattccttattcctcactctcctgtcgcatgtatagatggccaaatgagccgccggctagctcagtttgagcacgacctagcccgggcccaagatcagtcgggccggcacgacccgacctacatgccgggtcgtgccatgcccgctcatggactgcaccaacggcctaggcacgacccaataagactcgggccgtgctcctccttcgaataagtctatttggcctccctcatctattttgcctccctaatcattggattgcgccatgccaagccggtccacgaggcagaggtctaggcacatcccaacgatcgacccgggccaacacgggctcgacaccagttgggtcgtgttgtgcctgggacgggccgtcgagcccaggccttaggccatctatagccacagggcgtcatgccaattaggatatgtggatgcacggcggaggtgtgcagcacaaccagagaccttcttcctaggtagaggagttcgatgatggtcgttgcgccactcgcccctctcaaggcccaccacccagccaccggagctacaatagcgacgactccatcctggccatccatcctgcgctgccgccattcaccaccggcctgcaccatgacgtcggttacgtcgagtggaaggacatagtgtacaaaacgcaggtcacaaccttggcatccacatgtacaggctgacgaggaggaggaaagggatggtgaccgcctagggataaggtggacacgatgcatccccatcgatagtgggctgagaggtggagcccttgacgatcgatgttcacacacagaatggctccccggccctgccgaaagcaacaaaggttgagctagcgccctaggcctcctgatctagaaagcgacgtccgtattaccgccagaagagatggtcaatggtggcttgggtaggggttagcggtgactcaacctcatcttcgacgacgtctaggaagccctcgacgaggtccgcattccatagcaccttccaggagaccctcctcgacctcaagcaccacacatgccaaggtcgtgcccaagctcctctacaccacccccgttgtcgtcgacacctttgtagccttcgccggatcgatagctttcgccatctccagcacaccatcatcatcgagggcgacttggggtggaactaccatcatcgaggcgacgacagtggcttggtatcctccctatcctcaaggcccacggtggtggtcgtgggaaaccaatagaccccttcccttgggcatggcggcagctacaccaggtatgtcaagtcccgctatgtcggcaactcggcatcagcatcaacatcaacataaggagggtgccaacaagcgggcaagttttgacgccggcagcagttgaagacaaagatgaaggggtcaaatgggagaaagagagatgggcccacatgttagtgggccccacgtattttagttttatactccctccttccctaaatgtttgacgccgttgactttttttaacatgtttgaccgtttatcttattcaaaaacttttgtgaaatgtgtaaaactatatgtatacataaaagtatatttaacaataaaccaaataataggaaaagaattaataattacttaaattttttgaataagacgaacggtcaaacatttttaaaaaagtcaacagcgtcaaacattttgggatggagggagtatttgttaataataattccatgtaaatggcacgtcaaataaaaaccaggttaaacatgccacataaactaaacccggttttaatagttagagatcctccatatctagttttacgagtttagggacacacgaatctaacaaaggctgtagtcgagggacctaaattgaacgttttccaacggagaaaagctggagcatctagtggtactagtactacgtagggacaccaaaacatgctgttctacttctgtgggtacatcagttcaaacatcaacatgttttcacatattttggttgggcgtttcaaaatttgtttccgtaagcctatttagttcgcgaaaataaaatttctggatgttacatcggatgtttgaccggatgtcggaaggggttttcggacacgaatgaaaaaactaatttcataactcgtctagaaaccacgagacatatcttttgagcctaattaagccgccattagcatatgtgggttactatagtacttatggctaatcatagactatttaggctcaaaagattcgtcatgcgatttccatacaaactgtgcaattagtttttgtttttatctatatttaatgctctatgcatgtgtccaaaaattcaatgtgatgtttttgggaaaaaaaatttgtgaactaaaccaggcctaagtttatccagaaagttgcatgaaaattagtggtaaaagctaaatttttacaaacaatttaattaaaaaaatcaacatgttttcactatgcacatgaacttcataaaataaaccacgtgggcaatgtcagggtccttcatttctctcccagagatcaccagcaccaagcagtcaaagattccacaatcagcatcaagtagaggacaagtgtgttgaagagcctcccctgaccgacattactcccacaggtaagcacagcaaggcagcatttagcttcctggtgaccacacaatgcatcagcatcgtactaccatttttttcattaattcagttcttgcagtcactgagaagctactactgtagctctctgaaccagtcaagtgaaagcaatagttcactcaaaaggagatactagtactaatcatagagtagtagtagattacagagtgtatagtaccaaagtagggactagaaaacagaataacacagcaacacataggatgaactaaaagaagggtgagtggctgataccttccctggcaacagctcaaatgctcaatcagtacagtcttcttttaaacaccagcattaatgtatggtcatgtttgggtccccatacagatcactaatgtagggtcatgttggatcccctctacagatcactaatgtaggaccatttcatatgtttggctcctctacagatcaatgacgaacacttttgtctgatagtcacaacaccacatagttctttggtgctctaagtacgtgtaacaagggttttgacataaaacattatgatgaacaaaattcactggtcgatctgaatgatgcccaataacagaactcattgatatctgagctgaaaatattttactgccatgttttgttaagtatcaccacggattcaggtaataattacaatgtatcacctatcaaaatcaatgtctgtgccaaaatatcattaagacctcaagagaattatatgatcattcatgtcgacagtgaaggtgcccagcaattctgttaatcattggcttaagtatgttaaattgttaatatgatatggactaaaggtgtgtaatgagacatcgacatctccacaaatttacaaaatcactgaattgattatgctgatataatatgcatgaagctaagggaaattttggaataaaacataggggtcattataaggaacaataaaaatatcttaatatgtttagctgttactaaaatatattgttagttggttgacgtgtacgtgttcaaaaagaaagtttaaagctacaaatcactagcttaatgctggtctaacatagacagcgaggaaagtttggtgaacaaaatcacatcataccaaacacggtgaacaaaggaagagttagacgccatgtcatcctaactactgcttcttttctgtatactttaccatagaaatgataaaatgagcaagaaaaaaaattaccatgttctaagaagctgctaaaaaacaaggttagcttgttgtcatatgtccaggaagagtttgaaactaggctgtcgaggtgaccaatatttttttgtatttcagatggaagctcatcaatgttcataggtggtacttgctttgatcaacttatcaacctttgtactcattgttccagatcaaactcaaacgaacaccagtaccacacagttaaccagaaatattggtgaatattaaacaaataaaactgatgagcaaagatgatcatctcacccatttctacatctatcaagtgtcaagtattggtgaatattacccatcttcaattcagtagannnnnnnnnnnnnnnnnnnnnnnnnnnnnnnnnnnnnnnnnnnnnnnnnnnnnnn

SEQ ID NO: 35769 - DNA, 2511 bp, Oryza sativa
  unsure (1)..(2511): unsure at all n locations
gtagattacagagtgtatagtaccaaagtagggactagaaaacagaataacacagcaacacataggatgaactaaaagaagggtgagtggctgataccttccctggcaacagctcaaatgctcaatcagtacagtcttcttttaaacaccagcattaatgtatggtcatgtttgggtccccatacagatcactaatgtagggtcatgttggatcccctctacagatcactaatgtaggaccatttcatatgtttggctcctctacagatcaatgacgaacacttttgtctgatagtcacaacaccacatagttctttggtgctctaagtacgtgtaacaagggttttgacataaaacattatgatgaacaaaattcactggtcgatctgaatgatgcccaataacagaactcattgatatctgagctgaaaatattttactgccatgttttgttaagtatcaccacggattcagttaataattacaatgtatcacctatcaaaatcaatgtctgtgccaaaatatcattaagacctcaagagaattatatgatcattcatgtcgacagtgaaggtgcccagcaattctgttaatcattggcttaagtatgttaaattgttaatatgatatggactaaaggtgtgtaatgagacatcgacatctccacaaatttacaaaatcactgaattgattatgctgatataatatgcatgaagctaagggaaattttggaataaaacataggggtcattataaggaacaataaaaatatcttaatatgtttagctgttactaaaatatattgttagttggttgacgtgtacgtgttcaaaaagaaagtttaaagctacaaatcactagcttaatgctggtctaacatagacagcgaggaaagtttggtgaacaaaatcacatcataccaaacacggtgaacaaaggaagagttagacgccatgtcatcctaactactgcttcttttctgtatactttaccatagaaatgataaaatgagcaagaaaaaaaattaccatgttctaagaagctgctaaaaaacaaggtagctttgttgtcatatgtccaggaagagtttgaaactaggctgtcgaggtgaccaatatttttttgtatttcagatggaagctcatcaatgttcataggtggtacttgctttgatcaacttatcaacctttgtactcattgttccagatcaaactcaaacgaacaccagtaccacacagttaacccgaaatattggtgaatattaaacaaataaaactgatgagcaaagatgatcatctcacccatttctacatctatcaagtgtcaagtattggtgaatattacaccatcttcaattcagtagaagtaacaacaaacaaactgtggtagcaaatagccaaataccaactcgggttgaggcctccaaaacagcaggagaaaatttttttatcgatcaacaaaagatacatccacccacacaactctactactaaatcatctgatcagtaacaaaagataagcaacacaactagctatcgccgccgcaaaatgcatattattcctcaagttcgcctaccgcgcacgcatcaaatggagcattcgcaaacgcctcccaccctccattagctcatcaatatacactcgcaatctcaaatttcatcgaattagtagcagtagtagcagtcgtagaagagatatcaggatcattaccttccttccggtgggaaaaaaaaaatataaatctaacttgcaaatgttccaagggagcctttcattccgagaagtggaggaggagccatcattagccatggcgtgaggagagcggatcacagagggtttttaccatccgtggaagatctcggagcacttgcccttgaaccagcggaggccccttcgcagcgacgccttcatcttgccctccaccgagtacgccttgtagctcgccacccgccgccgccggttcatctccgggtcgctgaagcaccacatgccaccgttttcggcttcttcaccggcaccccccgctccgccacctcccaggtagccgtcccgcctcccgggcggcggcgggagcgctaggcgcggcggagggggcagcggcgggggcggcgccgtggtgtagatctcgatccgccggtcgccgttggccgcaaagccgccggtgcccttggaggagaagtagcccgttgccggtgggggaggaggaggaggaggagggnaggtagtatccgttggagtgcgggaagaagtcgtagtacgccgncggcggcggtgggcggaggtcnaggtcgctccggtaggggcggtggtagtcggccatggcggaaggagtgggagagatgggaaatgctcttgtgttttttttgctttgatttgagagggtggagggcgacaaaaggggaaaggaaggagagaaaggagagtgttgtgatgcaaccatgaagaaaagtatcactcatcgatgcattattgacagttggaaattttctttgtaaaaagcaattttgatac

SEQ ID NO: 35770 - DNA, 19331 bp, Oryza sativa
catcagatctgaaatggagtgaagtagagatgggagcggatcagaattgtatgtgaggggtagagcgaccttagcccgtactacatattattaatgaaagtgttaaatgtgaaattagagagaggtattagagcagtctaaggcagttcatggcctccccgaggcttttagaagtaaagcatctatgaaaaccaataaggatgtctatggttccataactttctctcttctatttagcattatagtgttaattctttcttcaatgagcattttttctatccttgagaagctaccatgaggtacgaggtaccatgaggtaccaatctaatctaaccgttgatttagcaagggtatgatcggacaaaaaaaacatctcttcgtccgtgcccatccagcccgccgtcgtcgtcgccaatagaggtcaccgccgccgccgtgcatccagccggccgccgccgtcgcccatccagcctgccgtcgtcgtcgccatcgtcgccgtcgtgcatccagccggccaccggccgccgccgtcgcccatccagcccgtcgtcatcgtcgccaatcgaggcaccccgccgtcgtgcatttagctggccgcctgccgccgccgtcacccatctagcccgccgtcgtcatcgccgtcccccatccagccggccgtcgtcgtcgccatcgtcgccgtcgtgcatccagccggccaccggccgccgccgtcgcccatccagcccgtcgtcatcgtcgccaatcgaggcagccgccgccgtcgtgcatttagctggccgcctgccgccgccgtcacccatccagcccgccgtcgtcatcgccgtcccccatccagccggccgtcgtcgtcgccaatcgaggctgccgccgccgtcgcccatccaacccgccaccgtcgtcgccgtccctcatccagctggccgtcgttgtcgccaatcgaggctgccgccgccgttgtgcatccagccggccgccggcgtcgcgcatccagccgcctgccgccgcgcgtccgtccgcccgccactgtccccctcgagcccgccgcgtccagccccttccagccgccgcgcgtcccgccaccgccgccgcgcgtccgtccgctcgccatcgtccccctcaagcccgccgcgtctagccgccgcgcgtccagccgccgtccagcccgccgccgccgtcacgcgtccaggcgcccgccgccgtccccctcgagccaaccgccatgccgctgctatgctctcccgacgttttttctttctctcgtgaaacagtaaaggacagaaagacccttccacccatagtaccacttcaatgaggaggtgcagtaccatgaggtacggatgatttctacccgttggatgatgccagatcaacggtcaggatttggtactgcacaacctcaaggacagtaaaaaaacctcttcttcaatatttagcctgtcatggacactttgcccctaattaagcatcatcaagctccaaccacctaggttggcacaatgtttcttttgcctcagtttgttacgtacaaagccatgagcttaattatgcgctaactagattcattaggaataatgccgaaaaatgcatagaagaccttaaatggcatatatttgacgacaaaactaatatgataaaacgacatctatttgagaacataagtgtgctaatttcatttatagtacaccctccactatattcgagcatcactatgtcaccctccactgtcatggcatgtgagtgcaaatcaacataattttacatgagaaacgttttgtttgtttttattacgaacagagcccaaatattttgatgtgaaaagtacgatagacaaggaaattacatttctgtcttgtgtactagctttttactctatatcatttattgaaaagttatagccgactatcaatgcttatatatttagcggcgctggcaagatataccacaccatcactaaaggcattgtgagtttgtgactaggataccactcaaacattgatataagatcaaaagctttgagatgcttcttctgctgtcttctttcctttccttggtctattcttttcttctttccctagcctacccatatgctgctgttattctgttgaaattcttggtgatgcttcaatgcttaagatcaccttttgtagctcgccttctctttctttctttttttctttctttctttctttctttctttccggcagatttgatgatttgtcagtctccattggacatgaaatgctacactatgctactactggatagagttcctttccatttcaatcaaaactgcaagtacatttcagaattatgataagaaaaaaaagagaatagtacaaaaggtgatggaaagtttgagttcctcctacgtaccagctgatgttaaagtagggttcacaatctcaatgaatttcgatccaatttcatgaattttgatcatctcgagatggttctagatgcgcatcttgttcgaaatttgtcccaatttatatgaaatgcttcaaaattagcgaaaattgatgccttggtggggctcgggtttcacttgccaatcaagatcgtaacccctgtgttagcatgttggcgccaactaaggggtcctggctccttgtgttaggcatcctgcatggcgaatattcatattatagtgtttttcatcttttgttttggttctcttttcatgatcgctaaagaggacaattaaaatccccgcaaaaaaaagaggacaattaaaatattgttttgatttcttttaaaatcaaactttgaaattcattttaaactttaaaaacacttcagtttacagtgtgcagtatgctatagcagaatcaaactctccaatgacaatcgagtacagtacggggttctgattaaaaaaattaggatacaagtatgtttacgggagacttgatttcgctggttgtctgggctggaaaagatagaaaatttttttccagttacaaattaaaacaaaatccatagctccagagcgttatcaatcgccatacaataaattacgataacacaaggctgtgtcgatgagcatgcagcttctcaatatacaccatctgctctcgtaattatggaaacggtcagaatcggtagcactcgacggtagcacttgacgctcagtcgatctataattgactatatttatagtttagtttcaatatcaatatgacgttgaaataaattagaaaaatcaaattttatatatagctaaaatggtaatggctgaaaacaatacaacttgtaaggaaacaacgatcaggcggtcatgaaattccgtgaccattttcattttagagtgaattgtatattggaccatatctttttaccaaagttgcaacttggactagaattaactaaccattttcaatttgtgccagatatctttgcaacatatttcactttcaacccgctcttcttctctagcttctctctcttgctgctctctcctccaagaaccactgtgaaccactgaatctgagcaaggcagatcgagctcaacatttgccatgcccatacggagctcttctcgctgatacttggcaagaaagaataatgagaaaggtgaaaatctccatgatctgcacactcactaactggtcttgcaggtttcgatcttcatcctccccgatatcaagctttgcatcctccattgttcccaactcgagctccaactcttttttttgcctcaatgctcgagctctacctcctctgttgcttgagctcgagctccaacagtccaactccaccacgtagaactcgagctccatctctgttcattctctatcacctcaacctcgaaccccgtctctttctccatgcatgctcctgacatcgaactcaccaagcacacctttcaaattgctggcaggtttggagcatctgcgctcagactcgtcaagtagcagagtgtggttcgaggtgaatggagattgggaaagaggaactttgtctgtgtgaagaattaataggctcactagagacatcgctggatatagctcagcctagaagactgctgaggaagaagatgatgttggccactgacttgtggatccaatagtccaaaatgcaaaatttggtcacaaaatctagccctaagtgaaaaaaatttgcttatacctggtccaatatgcaaacaaggtaataaaaactggtccaaagtggaattcactctttattttatctcagaggatgttttggaacttatatggattattaagggcgggaataaaaaaagaagacgaatggatggttgggatgaaatgggataagatgaacgaacggttaatattaaaatgtatgcttcagatgattgggataatattcccccaagcacattcaacatgccctcgtgtgctggtggtacaactgcagccattggctttgtacacaactacacatgaattatggcttatgtttcagaatcatttgggggagctttgataactacgacttctcacagaatagacaagtccccccaaacaatccagtttttcttacatattctaagaggctgtagtgcaaaatccaataagtaaactaaaatcggtttttcaaacttctctagattctcattggttgaattcccaccggttgcttattataatctaaaactccccaaatctaaagcccttcatcacgggacatgtgagtgctattttgaagtggattttgtgacccttattggtccctagaggttatatgatatcccctattcttacggaattacttcctccgtctcaaagaaaaacaaatctagaactggatgtgacatattctagtacaacgaatttaaagataaattcgttgtacttccaaatttgttgtaatagaatatctcacatccagtcctagatttgtctttcgtggcacaaagtgagtagagcttagcatgatattaattgattacaaaatctcttttgttcgtggatcttaaaacaatcttcctggatgatgataggagggatgcgcatggctacaagctaacaagcaccaccattcctgcaagaacacttacacaatgagatttgctctctgttttccccccttcaaaaaataacaggaagagggaaaaagaaagaaagaaaagtaaattccctactgtcggtaaaatggcaaccagggtacccatttccctgacagaacaattataaataaaataaatgacatgcttaaaccatccttaaaaataaaaagccacacccagtttgatgcggctaggggtcccactttggtgggtcccgggcccaccttcaattgtttacgggataagtatgtagctcaaggtctgcctcggtccattcctcgccttgggatccaggcacgccctagtccctatagtttccgcattcttctgcaaaaaagagcgtcgaaacatgtaaaataactacattatcgactcatcaaagacattttcgagaagcatgcctaagaatagatgaactatcatcacaaaaagcgcgcaggtgcgacctcacgaccagctggggagatggacacgctccacgggctattgtgaagcggtcctctccgccataaatgaaacagatttatggggagccccagccagcatggagttgaaaggatgtagacaagacaccagtgttgagtcattggtgccggtggcaccttggatgcgtgtcgaacatgccctgcaccacctgattaagccaaacgggcagaagcgaggctgtggcattgtttcagacagcccgggttccaccaagcccaccactcgccatgtgttgggatagctggcgcgacccagctgtctcggacagaagcccgggtacacggggtaatgcagatttcaaatctcaatagggttttcttgaagatgtgttaggaaaccagccgacaacgacaagatagctgataagacaagacaaggagtatatttgtaataatgtgagcccctacttggactataaaatgaaggggacaagctacagatggagggctggactctttagatcggtataattcattttgcagcctgaaaaagcctcctttgtaagcagctgatctagggaagacaacgaaaccaacacatgagtagggtattacacctccggatagcctgaacctgtataattcatgtgtcttttgcatggcggggagcttgggccccacagatccgatcttgcttgaatctttttctaagtattgcaccacaaaccccttggttgaatcttcccacttgggggggaggggtctccactcctcgttgtccaaggaatcactcccttgacacctacataccccttaaaagttgcccaagtccttttatgctgctgagttttattcattctcttgcataccctagactttttgcttcgatcccttccataccttttctgttggttgattgttagttgatcattaaattcttataaaaaagtctattttgccatttagtacgaagaaacatgtaattatttatattattggagtatagaaatttactgtatgaaacttttatatttatgagtttgtcatgcgagatattatttacgacaaaatttatttcatgcatgacaaaaaaatcaatatttattttttaattattaaaaaatgtacatgtagcatatttttgttgatagtagtttcaacgtatttgtcttataagacaaatctacacaaacaattattttaaataaataataataatttatgtcatctaaacataaaacctgtcataaataaattccgcataacaaacctataaactcatacaatagtttttttaaatccaacaatacgctccacaaatctatatgctttttcataccaatgggtaaaatagactttttgatggaaattttaatagtcaactcatggtcaactaaccataaagatcaaatttaaattcagaggtacagaaggaaagcgatctatagaaggtactctctccgtcccgaaagaaaaacgaatatggacatattagaatgtgtcacatccagtattggtttttttatgggaaggagggagtactggggaaaatttcacggttaaatatattcttttttaagaagaagaagggtggaagaaaagaagctggtcctgttgcatgtacccgaaaaaggcccaaaaaggtcaagcaggccccccaaaaaaaaggccgagaaggccgaaaactgaaggagtacagcggccgccgccgccgccgccgacgagtggtgttttctggtcacctgcggcagccgtcgtggtccgtgaaacgaaacccctgtctttcgtccgcgaaaattttccattcttgcgcttccaagtatcgagccccaacttcctagaagaccgcgaaccctagaagcaagagaccaagagtcgaggaggaggaggaggagttggccggaatccccgtgtggaaggcaggtatcgcgctcgtcttcttgcttcgtttcgtctcatctccattttcgtcgttgcttcttctgtctgtggttggcgagttgcggcgacgggagcctcgcctccccaatctcagtagtgagagcttgatttagggtgggggattttttttttcgaaaagaaaaaccaaaaaaaacagagaaaaaaaatcccctctggcgatcggttttgggatgaatggaggaaatgtgtgagcatttcaatctcccttttgcctgtccaaagtgttgtatcttgttcttgatctttgatgttctggaggcggagagggtgggggaaacaatatcaattgttgttagttcgttcagactagtgttacagagattttgtggaagtattgctgtagcattgttgtctccattagcatatgccatatatatagtctgaggtgctagaatggataatctgatggtgttaatgttttatatcttgcgaaaacaaatactacttcagcttgttaggaattcctggagtgagaagaaatgtcagcttgatagatgtatataaattctctagcagaatcgtagttttgtattcgcaaactcagcaacctccactgagcagaactaaatagttagtttcccatcgtttatgacgatatggagctgtctcagattatttgttttggtggagaggttcaatttatgatttaatgtggaatatatgttctcatacgcaggttgggatgattttatgaagtatgggttgttcaaagacacagactcaggaagactctgaattcaatcaatgcaatgaagagcgctccctgtgcttacactcattttctgacttgtcacatgtttctgcagctacttttatgtatcttttgaaggactgctacctatatggtatacctagttctttttcatgctattcgaaaactactccttccgtttcataataactgatactcatattttttgttgaatatttacaaacctagaaatgataccatgttactaaagtggggtttgccctaaatcaaaactttcgttcactttggtctaacaatttaagggcaattaattgtcaaagtttaattgggaaagtcaaaattgtcagttattaagaaagaggtagtatcatctatgtggcactgttataatttaatatctacatgattggtgtgctaaaatatttctttctgtaagcttcggtgcaactaattctgcttgattatgatatgaaaatgctgtcacacaatcttcccagaaataaacacgtgataggaaaataaataaagttacctacatagtaataattacaggttaaatccatagtagtttgtatggaaccttggttgaggtaaatatcatcaaatatgattttcaaattcggttaatgcaaaatgcaggctcttgaattccttgggtcttcaaactttttgcataaccaactctctgctatgaatttgctacaagcttgctttattattttattttatttgttttcgatatcaatttcatccttgatcttatgcacttattaattgtccatactctgatgttttacaatcttttttgaaaaatcaggaactgacaaagcaaccccaaagttcaagatccttcagctgcaggttaaaagggtattaaataatgatcctcagccaggcccattcacgtatgttgttcaatgcatgtatattgtgccactgctggggaaaacccatgctgaaggcttcagccatatgttgatctcttctctaaggcatttgaaatctgtggaatctgtacagaaagatttcttagatgcaaagcatcttgctgcgcgacttattcttgatattgttgcttctattgtgccccatgaggaacgcatactgataaagcttctcgaggcatatgatatcgagttgagagatatggctgatgcattatatggttcagagttgggtgatgaagatctagtgaaagcaaaagaacatctcaaacagtatgtacaatgcttaatggaatcagaatcttatgtgaccgctgtgaacctgataacacgattttctattcaatgttatgatgagtcctttcttacaaaactgattgaaaataatcacttggaggcagcagagaagtgggcagttttcatggggaatgaaatgatatgtttgatcatccaaacgtatctggatataaaaatgctaaagagggcaaatgagttggtaaaacaacatgaccttacagaaaagttcccagatgttaactatttgtataaagagaggtaacttttgttttgctcaatgcaaattgcaaaatatttctactataatgtttactaatcttatagatctctgaattatattgtatttgcagtgtactgaagaagctggctgagaaagggtgctgggatattgcagaggttcgggccaagaaggaaacaaaattgatggaatacctggtaatatgcatccacattgtcagagtcatcttttagacatgtttgttgtttgtacatgtcatcatgaaagtatctgctgcaatggaagatggattcactcgagacacagtttcctatatgcctctatctttgttcatcggatgaaatggctaggatgtattgcttttgttacatgtggattgatggtcgttattgtgaagccatgctgtcatctatttcatagtgttcatatttatttattttttgctggcatccttgtgtataaaatctatatatcctatatagttggcaccaaaagcttaacatgcattgagccacataactgacaaaataagagccattggattattcccatgcttcatcacaatcatccaagatatattaaaatagttacatttacttctcattagttcctagataacttaatattgattatcccacatagtgtagttattattgcttaaagaaggcaggtcatgccatttgtcatcttatcatcagatggtgcttttacggttcatatcaactaacaatctctctcatattaatatatagactttttataatcgtattgcacacaccattatcccgccgcaacgcgcgggttgccatctagtaaaatataattgctttactcatgactttgttaccttgtgcaggtatacctagctatggaagctgggtacatggagaaagttgaagaactttgccaaagatactctcttgaaggctatgtcaattctttgggtaatcataaacaccaacgttatttatcatacattaatatctgtagtcctgcaggtgtgtattcttttaattttctagctatttattttcaacctgctgtagaaactatctcctttacgtttgcattaacttttaaatagccaccctgctgacattccttttggttattacaacccactagaatgattaagttgattactttcagctggaactttgaaatctgggttgctgatatagaattactagaaaaacattataatggaaaggtttactacatgcatccgacgttccaaatttaacttacataggaagagctgtaattaggaacaaggtattttaaagactaacatttttaccaatgcaaaaatcatggacgcgtgagagggagggagggagggagaatgcaggatgggttaatgcaaaattatgatatatgaaacacagctttatgatacattcattgaattttatctgtactcttgatacgttgtaattgactttatcccatcaactccatttctactgttgatcccctatattaattgtgtatgagcagttccagaggagatttgttgtgggtctgactacttagatcttaaagaactgattttggaagacattatctgggttgatgagattgatggacttcttaattcaataagttatattgaagcttgtaaaattattggtgtggattgtgaatggaagcctaattttgagaaaggtagcaaacctaataaggtaagcgatgtcttaatttaaatttctgtcagtttccatgtttaacttagttttctggtacaattataatcatttttcctaatgtatggtaatcatatgttgcattattgtggcgatacagcaggctgaatgaaaatctccccctgttcttcctcaaaaggcatcactggataaaataggataaataaattgtattaggtatcatttaagcaatttagtagttctagtattcagttatccatatcactccctgtgtagtaagctatggccttgtgatcatctcagtgatattttctttacagtgtttattgttttggaacgactatcttatccttaagttcccatgatattttttacttgttcctctttcagaaattctgcattttatctatctatgtcagttcttgcattaattgaattttgctctatggttaggtctctattatccaaattgcgtcagataagaaagcttttatttttgatctgatcaagctgtatgaagatgacccaaaagtgttggatagctgcttcaggcgaattatgtgttcttcaaacatactaaagctaggtagcgtactattttgattaaaaaacccatatcttcccatacactcttgttttcctgaaaacaacatttctttcttatgcatcctgttaaacaagtacttatttttgccccattgtaaaccaaaggatataatctgcaatgtgatctgcatcaactatcacaatcatatggagaattgaaatgtttccagtcctatgaaatgctgcttgatatccagaagctcttcaaagggactactggtggtctatctgggctgtccaaggtaattgctatagcggtataggctccacttaactggacgttgaaccagttttgattttttttaagcttatagtttagtgtgaatcatctggtcctccatctttatttatcacggaatgtatcagaaaatattaggagctggtttgaacaagacgcgacggaatagcaactgggaacagcgccctctcacccagaatcaggtctgtcatctttcatattccttaaaagctgtcctcacgagtccttattccttgaaaggccctatttgttggtatgagtgattaattaatttctcataattttgtattgtgagttttttttttcagtctcattctgaatttattttcacaatacttttctaaccatgacaggtgtttgtatgaaaaaagtagaaaaagaaatttactttagaaatgagcctgtcgattaccacatttttaacatcaccttaagatgcctctccttattctcatgtacaagcaaattttctatcagatcttgtgctaagcttatcttggtaaacaccattagttaaaactaagtcaaacatgcttcatcttgcaatctaaagccacgagttagtttgatagcctactgttcatcgaggacaaaaagcgccatccctaaaacagagagattcttcctccttttgcagaaagagtatgctgcccttgatgctgtggtccttgttcatatattccatcacgtcaagggacagcctcagtttggtgtcaccgagggatgcaaagtggaatggaagtcccatattgtaagtgcaatctaaaaacatcaaagtatcaaactgccatgtttatatgctaatcctgaacatcatgtgacattttaaccatcgttgcaggtttctcgggtgaagaattcacggagtacattacgcttctaaaattaagggctgatcaaagttgactgtggacgtagtatcttgctaaagtgttagccaggaagaagttaagaatcaatctgttcatatctttctcacatcttacatgatctcagcagctgttgctgccatctgtaaatattatatgctcagatttcttccatgttgtgttatcgctaattaggagctatgagcctatgacagttcaggcatgcatctttttggtggcaatggactttattatcaggaagcatgatagaaatgtgccaatgtgccagttggagacgattgaaatttcatgaactaacactagaatgtttgtatttagatgaacgtgaatcctacctttgctcaagggaattcatttccttcatttacgggaatgtaggaactttttttttaaaaaaaatttctcgtattccatatagttgtggcagtacagtagattcccacaagtccagcaagtccagtaaggcacaaagtaatccagagttctcaacattactttttttcaagtgatctaagctttaaaagggcaagttctctcattattcgtgataggtacatataattatacagaattattacttcctaactatgctttcatcttttgctcgtacgtggcattaccagcaccatcaacagagatctaaaaaaggcgagacagaaaaactgaagaattattaggaattaaaggcgatcattctccctttcgatctcctgggttgctgtcactctttcctgataattactttgcattcgggaatcaattcgtggttggctgtagcaatcttgtgttgatacttgatagcactggattcggttcttggccgaccagatcttccctctggctggatggatagggtggtttctgtttgttgggggatcgaattggacagccaattctaatctggacagtcaactctttctttacagataagaggctattgcgtgtctgtttcgaaggtgtcaacaaaaggatttgtgcagaattttttttagggttctaattctgtaagaatatttcctatttgaccatttgaaataaagaaatggatcttcccaaattctatagaattccttataaatttgctcaatgtagattttggagaaaaattatcaagagttttaacattgtaggaatttccagtttatgtgtttttcctacggtttatccaaatagttatttctatgtatttcatacggtttcgtgtggatggtaataacttgtaattagaggggttatcttaaatgtagctaatgatggtttaccttgtttcttggcctgttatttgaggtttagggtacgtgttcatgttgggttcacttatttcgtgccggttagatgtagtaccgcatttgattttttaagtaattttcattttattttaataacgtataagttgttaaaacgtaacgtcaaaaccataaattagatccactctaatttacgaatacaaatacaagctaataacttatcaacttcttacaatctcatcttttcgcttttatttatactaattagtatgtttactaggtgaaaccccgcgcgttactgcgggacttcaatatgataataataagtaaaaataatatgtaatatagctaaacaatataaacttacataagcactaaaatcaatttatgtgatatggcttatttagagaagagagaaataatattaaccaagtgaggatgaacttgtataggtatataagatattataaaaaataatgaaaatatatattgaaatattatgtgaattatgtgggatgatgatttaacatgctttcattttaaaagctctaaaatgtaataaattttaaattagataatatagtatgtttacatgatattaaatgtattaattgttagtggatgatgatgtggcacctttgcatgttaagctttaggagttagtgggttataaaggattagaaaaaaatatgggtaaaatatttatataagtgtccttactcattagcgatacaaaagcaaatactataaaataaactataatataaaaaattaacttgaaaattaagttgtaaattcaatttttggcttactacggtccaataaatccacttggatcgacttccattttatctatatttaacaaatgatacataaaataaaataaagttgaccgaagggagtacttatgccatataacaacaaaaagaaaaaaaatggcaagaaacattcaggataaaaacacagagcaatgataaaaataataaggaaaaatttaataaagaatgttgtgacttagcggttttagctgtagaacatcgtacaaaagtagcttttggaagaaaatactctacaaacgtaaaaattaactcatggatgccgtacctattaaaatattgatttctaatttgatgggagagaaacaatagttcacaactttcacattgttcctctcccctatttaatcataaatcacctttatagtgtttttttctaaagtcacttgtgtaatgtcgtacggtgaagatatcgaagtcatgatgtcatgtactcatgtaccaaattttgccaaatacctatgtttacgaaccaaagtcattgataagagtcacgtacgtgtaccaactacttaggcacttgggtagtacaaacaagacaaaattttgagctattttcaagtacttggacaatctacctatatattatgtccgattttccaatctgtccccacaaatcgagagaagggggagagatcagtacaagccgcaccatggcgaaacaaagcaacataattcttgcaagcttatcttttcctctctcgctcgctgtggatagcgaaagaaaacgaaacgaggaaaagaaaaataaaaaatggtccccgcgagcccatctgggccgtccggtcgattccgcctcgtccccgatgcacggctgccgttccaccacgtcaccccccgggtggtaagcggcgaccagacaccgccgtgggcccccacgtcccgccatcgatgacaccggggacccaccgcgcggtggtcccacctgacagtgacgtggtcgggtgacggggttcgttgagtcaaaaacatgtggcctaactaataagctggtaaagttctacacgtacacgtaaacgaggactacgtgtcaatgactcgtgggccccacggccttggctggtgaccacgaatccgctcgggtccacgcttgtggctgacatcggggccccgcacgtgagccgccgcgccgcacgtgcacgacgggcgagaaagtcttcacccaaccccactgacacgtggaccctcggaatcattcccggtcccaccgtcagtgagagggggacgccccacgtgggccccacgcctccccgaggaggaggaggagaagcatatgagagagaagagagaagggcaggtgaggtgaggcgaggcgaggatgtcgtgacgacggaaaaacggagcagccgaggcgaggaagccgccaccgccaccgccgcgaccccaatgcgcgcgcctcccgccgcctcagatccccacccctaaccctagcctccgcctccgcccccgcctcgccgcctcctgctgccgcgacgagcgcgccacggacgtcgcgggcgaccccccggaggcggatgcgatcgggcgccctcgcgtagcgcccccgggcttcaccttctcctaggggtaggggagggtagcggtggctgtagccctagacgcggcggcgcgcggttccgtgccctgagggaggggaggagcagatcggtgtgtgtgtgggggagtgatgccgggggacgtggcgacctcgccggcgccggcgccgccgtccgcgtcttcgcagcagagccaccacgccacctccgcccgcggcctgctctgccacgccgccgccggcgcctccgctggtaacacatgaccgctcgagctatcttatccatttttttgggtcaatttgtgtgtttcggggatgcccatgtggagcaagcgttgaatttttggggcttgtccgcaggtgtggttgcggcgaccttcgtgtgcccgctcgatgtgatcaagacgaggtttcaggtgcacggctggcccaagctcgccaccggcacaattggaggtgcgtgtctcttcagaggaattcttgcgaatctttgcttgctacagtttgctgctgcagagctagagctgcacataaatctattatagactgcaatttctatcctatgcttgatgaagcatggtgagcacataggagtttgagcacttaaagtcagtgcatatagtggtcagaatatacagtggatgcatcatgcatgcaggggaatgatggtaaaccggtgcagattttgtgcctttctctttgtgtagctttactcggacacttccaggattcagggagttgagaaaatacttgtcggcaacgaaagatctgctctctgcttttagatgtcgtaacggtttcggattgcttgtttggacggttctgttatctgaggcttttgattggtctctcgttgttgttttgcgcaccttgaatctatcagtacctccaatcaaagtggggctgggagcttcacatgtgttgagcggaattgttgggaacttatgagatcgtgcacattgagaatggaaggaaagcatgcagcgtgctatttgctgttgcatgaattcgttgatgtatgataaaagcattagcatacatgaacatgtgaaaaaagccaacagactttgtgatgtccatgggtgtagtatagtgtgggtaatacttccaagcctggatttctgatgttattggtacacatttgctgaacctaaattgcctggaacatcagctgacgtacatgctttgaattcaaaaaatgttttagctgcattcatggatgctggcatatgtgtggcccgttatgctctgaagaatgccagcaggtcatcctatgtacgtggccaacagcattggtgcattgataatgcacttacttcgtactttttactgttgaatttgcatctttgtcaatagaagtttgatgagtagcatattttctgaaatgcttatgtctggactaaattgttttctactataccaagattcttcagaagctaaggtttattacatcagttctttgttctatcattactaggtagtgtaataattggaagcttacaacagattgctcagagggaaggttttcggggaatgtatcgtggtttatctccaactattctggcactcttgcctaactgggcggttagtctttacccttacattatagctccacttactccattgatgagatgtttttaaattctatgtaaaaagcaacgatgctaatgataatgctataagttgatctgcatgcaaacccatgtatggcaccgagtagagtagtacactacactatagatgaatcaagtgtctatgatctattgtggagctaatagtatccttgtggatttccaggtctattttactgtgtatgagcagcttaaaagcttgctttcttccaatggttagtgttttaccctgcatatgacttacttgacagcatatcatttgtcagttcttatgtggtatcgtacattcattttgcagatagaagtcatcacctgtccttaggggcaaatgttattgctgcatcatgtgctggaggtgcaactactattgcaacaaatccactttgggttgtgaagacaagatttcaggtatccttggaccacaacttgtctggaccagtagtcgatccaagacgcctgatagcataattgcaatttcaaaatgctgcataccaaatattttgtctggcctatattaggcaagtgtttaaaacctgtaagcaattcccatttctttcctaatgttgactgatggtctttacacaggctgaatgcccatttggaatggagctatcattaattataatcacttataaatatgctgaatttcttttagatcttttacctgtccatactaagcagtcaacatctacatgctatactcagacaaattgattcaaagattttattttgagtcatatcatcatctgtatccttttcccttttgtagacccaagggatacgagctggggtgatcccgtacaaaggtacacttgctgctttgaagagaatagcacatgaagaaggcattcgtggactgtacaggtagctttccatggaagtccacagatgcaagattttacaccgtttgatgataatatgttttgtgcgctggctgatatttttctttttcttttttataaagtggacttgtccctgccttggctggtatcagtcatgttgctattcagtttcctgcatatgagaagatcaaagcttgcatgcc

SEQ ID NO: 35771 - DNA, 825 bp, Oryza sativa
  unsure (1)..(825): unsure at all n locations
nnnnnnnnnnnnnnnnnnnnnnnnnnnnnnnnnnnnnnnnnnnnnnnnnnnnnnnttgaggaagaacagggggagattttcattcagcctgctgtatcgccacaataatgcaacatatgattaccatacattaggaaaaatgattataattgtaccagaaaactaagttaaacatggaaactgacagaaatttaaattaagacatcgcttaccttattaggtttgctacctttctcaaaattaggcttccattcacaatccacaccaataattttacaagcttcaatataacttattgaattaagaagtccatcaatctcatcaacccagataatgtcttccaaaatcagttctttaagatctaagtagtcagacccacaacaaatctcctctggaactgctcatacacaattaatataggggatcaacagtagaaatggagttgatgggataaagtcaattacaacgtatcaagagtacagataaaattcaatgaatgtatcataaagctgtgtttcatatatcataattttgcattaacccatcctgcattctccctccctccctccctctcacgcgtccatgatttttgcattggtaaaaatgttagtctttaaaataccttgttcctaattacagctcttcctatgtaagttaaatttggaacgtcggatgcatgtagtaaacctttccattataatgtttttctagtaattctatatcagcaacccagatttcaaagttccagctgaaagtaatcaacttaatcattctagtgggttgtaataaccaaaaggaatgtcagcagggtggctatttaaaagt

SEQ ID NO: 35772 - DNA, 570 bp, Oryza sativa
ttttagacggttaaattatacgtttctaacaaaaaaaaacttctgtctagaagttatttttagaaaatctaattattcgtcttttaattttataataattaaccatgtgctaacgagttttctcaatgtctatgttaataatatccattcaattgccttaaaccaacgggccttacaagcggaggattttttttgactttaccattcaattgccttaaaccaacgggccttacaagcggaggatttttttttcctaaagtcaattacatggaagacgtacacacacgaatcacacttatggtggtacgattgactgatcatctcgtctcctctgatgtgcaagtgaaggtggagacgcgggtggagaaaggggacccgagggatgtgatctgcggggcggtggaaaaagcccgcgcggacatggtggtgatggggagccatggttacagtttcctgcagaggacgctactggggagcgtcaacaaccactgcgtccaacacttcaagtgccccgtcgtcgtcgtcaataggcccggcaccaacgccaaagcctcttgatgcgccaactcc

SEQ ID NO: 35773 - DNA, 585 bp, Oryza sativa
cacgcacatgataaattaacagtacgactaactaggggcaaatctctttatttatttattactcacgcaaaacatattgtatggtacctgattaataattataataagcatctgtgatacatgcatatctatctaagagattttacggtcctcgagaaggtacggagggataccaaattttatatttccgatactatataaggtacgaagatttgtaaaaaatactcaagaactataaaatttctctatataattaaatttcctaattaataaccacttggaattgagcatgatggaatcatctcaattaattaaccgtcttcttggtcggtgtgcggccttgtaaaggactgggcatgttgtgcaacgggttcgatccggtgggaaccagacgctccgtcacggccaccgtgggctcgtcggcggcggccggaggagtcggcgcgccgttgtgcacggggctcggcccgctgctggggacatcgtgcctcatcacagccgccatcttcttctccacggcggcgggacgacgaacatctcgcgccgccgcggccgtcgtcgtcgccacgaacaccagcagcacca

SEQ ID NO: 35774 - DNA, 697 bp, Oryza sativa
  unsure (1)..(697): unsure at all n locations
nnnnnnnnnnnnnnnnnnnnnnnnnnnnnnnnnnnnnnnnnnnnnnnnnnnnnnnnnnnnncgaaaatggagatgagacgaaacgattcaagaagacgagcgcgatacctgccttccacacggggattccggccaactcctcctcctcctcctcgactcttggtctcttgcttctagggttcgcggtcttctaggaagttggggctcgatacttggaagcgcaagaatggaaaattttcgcggacgaaagacaggggtttcgtttcacggaccacgacggctgccgcaggtgaccagaaaacaccactcgtcggcggcggcggcggcggccgctgtactccttcagttttcggccttctcggccttttttttggggggcctgcttgacctttttgggcctttttcgggtacatgcaacacgaccagcttcttttcttccacccttcttcttcttaaaaaagaatatatttaaccgtgaaatttttcccagtactccctccttcccataaaaaaaccaatactggatgtgacacattctaatatgtccatattcgtttttctttcgggacggaaagagtaccttctatagatcgctttccttctgtacctctgaatttaaatttgatctttatggttagttgaccatgagttgactattaaaatttccatccaaaagtctattttacccattggtatg

SEQ ID NO: 35775 - DNA, 686 bp, Oryza sativa
gtattgctgctccgtcgtctgctcgtggtggctgtagtggtagtactcgtcgccgcactgcttacgctccctaatctcaaacgtccctgcacgtatatatgggtaataaaaaaaatcaagagccccgttggtggtcttaaaaggataaaaaaataataagtcaaagtaaaatttaagtttgaaacttaacttaatttgaagttaattttaatatgttttcaccacttttttttcagtattagcttttaaatagtaagaatacatataaaaaaattaaaccaaattattttttaatcgccaataagatgttacggtgtttataataaatttttgggtagttggtgacttaacttaatttgaagttaattttaatatgttttcacccctttttttagtattggctattaaatagtaagaatacatataaaaattttataaaaaaatatttttttaatcgccaataagcctttacggtgtttataataaacttttgggtagtcgatgaggccccaactcaagataatatattgtctgatagatatgcaagcatttggcattctagacaggatttataaaacattttaaactccaaaatgtgtaattttatactagaataaattataaaaatcgtttttttcatatacatttgagaaatttcatgctgcggtctatatattttcttaatt

SEQ ID NO: 35776 - DNA, 550 bp, Oryza sativa
acacatttccctcacgtggaaccatgtgccacataccaccatggtatatggtcggaagacctggacatagtttccaacccatcctagccatagacaagagtaccgacccaaccccacctacgggcggaacctccgggacaggtaggcaggactgagcccctagcagcaggacaccggccctgtgccatgacatctcgactaccgggccacagctcgtgtagccttcatttgccctaaacatgtccatcgacccccgacttcgtccatctccatccgtgtacttttgtttataaccagactgagccacaaactaagccttacccactaaacatgtggaagtacggtagtgctttgcaacaaaggcccgaagaccggtccttatatggccgaggtgctactatcaaaaccatgcaccccgagcccagcctaaaacccttttgaggattttgaatagagagggaggtgtgaatccaattccacaataatccaaccatttcacagtgtccaggtgatgagaatattcccaaagtctagagttgtaaaaccacct

SEQ ID NO: 35777 - DNA, 800 bp, Oryza sativa
cccacccgtcagcgagggtgccgggcgggcccgcccgtcagcggcgcgcgcgcgggaagagcccgagtggtccgcgggaaaaagaaaagaggggaaggtaaatgggccgagccggcccaagatggggaaggggggattttatggtttttctttttataaaatcattttaactttgtttatttcttaataattattatttgtgctctgaaaattccactaaaatttatttacacattttaggcttttaggaaataaacaaaaatcctctaagccttatttgacttttaactttgcacattttaatttttggaggctttcacacagattttaattattctaggcataatttagaggatgtattttagggtcgttttgggacgtgacagacactaattttgaggccctcagcccattggcatcatggttgggcccatttcgactccaactcctttctaaaagatttaaattaagcaagggtgagtacaaacgtactcagcaagccaccactacagaatgcatttagtgcacacaggggttcaaggatggcttggtttatttgcttaaagcttgttttcacaattcatttcacaaacctacgacttagcagttttaactgaaaacaacgttaagttggagttgtcattaatcatcgagggttcatccaccttccccaagcctcgctaggtcaggtttaccctcgcattcctgtttatatcctctttcatcatatcgaccttcccgcacagtgggcaaggtcagatagtttggtccatctctaatcttaagcaggtcacatagtc

SEQ ID NO: 35778 - DNA, 930 bp, Oryza sativa
cgactactagggtggcactcaccgcgtggggggtcgcagccaagtaaagcagcaatggttcctccgtccctggggctaccaagatgggaggggaggtcaggtaagctttcagctgattgagagcttgctccgcctcctctgtccacacaaacggcccggggcgcttgaggagtttgaataggggcagcgccctctctcccagcctcgatatgaatcgacttagcgcggccatgcatccagtgacgcactgcacatcaataagcttgctgggggggcgcatcctctctatcgcgcgtattttctcaggattagcttctatgcctcgggaggagactagaaaaccgaggagtttgaccgctggcacgccgaacacacacttttcggggttcagtttcatgcgcgtggacctaagactgtcgaaatgccacaccctaaaaatcctaaatatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagccaaggaggtatttttaataaatggaattgcatttcatgagtaatttaaattggaaaaggttttaaaagtctcttttggctttgggcctaaagtcggcccaaaaccttctctctcttctggcccagtccggcccgaagatgagcccgccgctcgcgcgcgcgcgttcgcccgctgataggtggggcccacctgtcagggccgtcgtatttctcgcgccgtgggccgcccgaaccctagcgccgcgttgccgtcgtctcctttcaaatacagacgccccttttcatttccggggaaatcaatagaggggaaatgatctt

SEQ ID NO: 35779 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnnnnnacataactctacatagaaacaggctaaacaaaacagactgaaaataaacagatgcagataagaaataatcaaaggtaatgagaaacagatgcagataagaaataatcaaaggtaatgagatgcatcagcaacggcaaaagatccacagcatactcatcttggtcatcgggttcaaaagattttgcacgttgctttcccgaacaataagcacatatatcgtaaactatttcatccctcttctgtccaaagagcggcaaaactaaaacgatattaactccgacacattacacccctgaatcagggaaagcttttaaagtggggaaagggggggagatctacagtttttcttcttcttatgtatggtacacacaagaacattacgatcttcgatcatccacctgggggtcagggtccaaaagatgaaatggcaattatcaactacagaaatcatcaaaagggcgaccggtcctatcttaactgctgactgctacactatgcctcctaaatctcacagttctacatcgtctcaacttggcgattgcttcttgtgccttcccttgaagaaggtccacataaactgatgctagcactggcctggggtttgtgggcaacaaggcaacgccacggcttaccatatagttagcctgctcaagctcttcctgca

SEQ ID NO: 35780 - DNA, 920 bp, Oryza sativa
ttacaggggcggacctacccattgggcagggttgggcgaccggcccagctacggcccacgttgccccactcccctggatgccatatccatcagtccatcaaggaatagcccacaagtcagcccatcaagcaaacaagccaatgttagcccgttaggcatctgttaacgaccaaatttggtaagatatgaaccaggttcggcattggaatcgaagtggattcggcaaagacatagatttgaagaatagagtatgcatcggctgcgaaggcatcggctggattctgaatcggctgagatggcttcgaggctgcttctagaatcgatggacgtgcttcatgaggattgccacgatggagataaagctctcagataggtaattgtatctattaattaggatatcttatttaatttccttagagatatgtttgggtaaaagtctgccgcaaagacttatggtatcttagagtttgttagagataagagtcgtgtccggcaaggacatattttgtatctcgggtataaatatgacctgaacccatgtaatcaattaacacatgttcaataacactttcggcgcatcgccacccttttattttatttcgacgagttcttgctttcgggttgagctgcatcgattcgatcttcaactagaggtaaacttgtcatggcggtttgcgttctcgggaatagtgcttccatctttatgacactctaatcttgtctatgtaattcgttgagttatcatatatactttataatctctgttagttacgctatataacttgtcatcggctgtttcttttgttaggaagttgccgatagagttagatctcgttattaatctagattatatcgtgtatctaccatctcttagaggttttcatcatcttgtatagatctcacagttatctttatgctta

SEQ ID NO: 35781 - DNA, 7808 bp, Oryza sativa
cccgatcggctatcgtttatggatttaaccgcggcttctcttgtctttattcttgttgattgtaggatcaaatcaactggcacgctcatgaacctaaaggcgagattttggacctgtacaggatttaagcagatcttccaggctagtgtgtgttttttcacatcaacacgcttttggcacgtccggtgggatcgagttgtgacaactttttctcatggcagaaaaacaatcaccgtcatcaggagtcaagcctccaaaccccccgagggccaagcttccaaaccctccggggaccaagcatccaaatcctccggggaccaagcaatcatcatatgaagttgggactgataacattgttccagtcactatagacaaattatcaccagaacaaaagctggagtttgtgcaaataatgaagagcgctcaggagaaattcatgaactcattcaaggaaacccgccaaggaacagtcattcaaaagtacaagctgaaggtggttgctgccgatgaacctggaacaagctcatctcaagatggtagaaccaagggagctaaaggtggtgtggatggttcaggtgacaaaggtgcggaacctagagatggtgaggttgaggacattggagaagaggatgctgaggagcaagagcctccaaggtgcaataatttccaagaccaagttgactatgctgtgcaacatgctttgaccaaccaatcaggagtgcttgttaacactttaacaaatatgattaagtctgtggttgatggtacgataactgagcatcaaaacacggggccagtcttcctaccaaatggcgtgttcccacagtacaagaatttggtgataggcaaccaacagcataccgccaatgcaccaccggtccagccgatggcagcagtttcagctctagcaacaggtgcaccgtcgtcggcacaaaggcaggtggttaatcctcatgtcttgaccagagagcaaccacaacatgttggacagaacatcaatcggctgactcaggagcagattgctgcaatgttcgcgccaactcagccgactgtcgagccagtacagtcgacaccaatcaggcagcaggttatccagccgattaggcagcagacggtgcaacagataccaacaggacagagaacacctattgctcagaaaatccacctgtcggagcccagtttgtgcctgaacagcagatgtataatgttcaacaaacccctcaaaactatcttggtggtaatttcaatctccagtatccacctcggtcacctcaaattcaatatcaaacaggaggatcacctcagcctcagtttctaccccaactcaatcaattcgatccaatacagcagcagatgcaaggagtgccccagcagaagccttgggcaggcatgattgcagatgtgatgagggagcagtttgggcttaagccaaaagacactggaaatttgtatcggcacccctatcctgagtggtttgaaagagttttgctgcccaaccgatacaaggttccggacttctcgaagttttcaggacaagacaatatttcaacctatgagcatgtcagccgattcttagctcagtgtggagaggcattggctgttgatgctttgagggttcgattgtttcctttgtctttgtctggatcggcattcacatggttttcttcgctaccttataattctgtcaatagttgggccgatttagagaaacaatttcacagctacttctacagtgggattcatgagatgaagctttctgatttgacagcaattagacagaggcatgatgaaactgtacaggactatattcagagattcagagagatgaggaataggtgttacagtttggctttgaccgattctcggttagctaatctggctttttagagtttgatcgctccgatcaaggagaagttttcgtcccaagacttcgagagcttgtcccatcttgcactaaaggtgaccttgcatgagcaaaggtttgtagaggctaagaagaatttcaagaaggtcaatcatgtgtatccttatatgtatgactctgaagaagaagatgactccaaggtagcagcagccgaatgggccagaagcaaaaagattatagcgtgcccatgggtgaagagttctgggaaggaagaaagatatgatttcgatatcaccaaggctgataagattttcgatttgctacttcgggagaggcagattcaacttcctgctagtcatgtgattccatcggctgaggagttggggaaaaggaaatattgcaagtggcataactctagttctcatgctaccaatgattgcaaagttttcagacaacagatccagctggctatcgagggaggcaaaattaagtttgttgactccaaaaagccgatgaaggtcaatggtaatccttttcctatcaacatggtgcatatatctgggagaacagccgatgagggcaaacatcggagttcacagctgaattcagttagaattatcaacaaatatcaaaggaggcatgacaagcagcaggagaggtattttgaagagaaagatgacggttttgatccacattgagattgtgagtttttcagattttgctagaacgaggggatgcggttgccatcaattgaagattgccctggatgcagagacaatgcggggagttcaagccgatcctacaatagaggcaatcggctgggtcagaaaagagtcctgttcatcagaggttgggcctagtgcatcatgatcgtgatcaagatgaagatgagggtagaaaaacgcaatggtgtccttctggtattttcaccaaaaatcagaagaaaagggttcaaaggatgaggaacagagagcgttttctggaggtacaacaggagatcaatcatcggctgaagaagaccaagcaggaatggcgcgtcaaaagtaaagttacaacagccgatgaatttgaagccgacaaggcgaagagattgaccaagagcaaagctgttgcatccacgtcggtaaacatggtttttatgttacctgcagaattcgaagctaaacaagccaatgttgatgatgtagaagaggcctctgctaggttgattttgtcgccagagcaagcaatctttgagaagccagaagggacagagaatcggcaccttaagccattatatgtcaatgggtttgtcaatgggaagccgatgtccaagatgatggtcgatggtggggctgttgtgaatttgatgccatacgctacattcgggaagctgggcaagaatatagatgatctcatcaagacaaacctgattctcaaggattttggtggtaatccatcggagaccaagggagttttaaatgtggagttgacaatcggcagcaaaactgttcctacaacgttttttgtcatcgatgggaagggatcctacagcctgttgcttggaagggattggattcatgcgaattgttgtattccttcaaccatgcaccagtgcttgattcaatggcaaggtgacaagattgagatcggctcgaagataaatgatacgtcatcggcaactagccgatcggctatcatttatggatttaaccacggtttctcttgtctttattcttgttgattgtaggatcaaatcaactggcacgctcacgaagctaaaggcgagattttggacctgcacaggagttaatcagatctccaggccagtgtgtgttttttcacatcaacagcatcacgcgcacacgccgcagccgcacacgaaacagacttgacttctcgtcttgattgttttctcgtcttccgatcggcgatgctgcccgacgccgattgacaccgacccattgtggcgcactgcctctgccgtcgtacgcgcgactgcgccgacgcatccaccgcccacgccgggtgctgctgccatgccaggctgctgcctgctgcagtccgctagggcctagggctagctagcggcatggcattgcaggcagcgggcctgcggtagccggcagccggcagccagcaaaggtctgaagtggcgaaagccgctgtccgtttccaggcagcccggttggaaaaggtatcatcagcaagaagtccaaaatgaaatcaaggtatcgtagatgtagtggagttttcaatataattgactgatgagcaacaagctagtgaccggatttttctcctcttagaattttgaccttgtggatatagacatttcttttaaagaaagtgctagcatgtgttttccaatagtctctactctagaaagggctaatttattagcaggacatcttcttatatattaaacgatttttaaagacaatgaccagttaactatcaccaatgttttataaattacctggtttttgcaaattgatatgatgaattatatataacataaagattattgttttgttttaaaatgaaacgcaccatccagaataaaagtattatcttgaatgttcttattcgtcttaatttattgattgtattgaactttttatgtgattaaaatatataaatataatgcgtgccgtgtttggttgtacttatcgagcgaacatctccaccccatcttttttataaagctgcgtccgccactgatttcttaacgacattactagaaatataatttctagcaatgatgtagaaatattcatggtatattcatagttacagatatgatccgtaagcgcacggatataccattataatttcacccggaagtatttcaaggtatcgtatttatttaatccaagggaagatatgataagagagaattatactgataatttatatattacttgtatatatcaaggtctatggaggggttaagtaattcaaaaggtaggataaatgtgacacacagaagaaagagctaatatattctcactaaaatataatctaaactaagtggaggaagaataagaaaagaattcattcctatactgggatcctctagagtcgatatgcaggcatgcatactttacactgctagtatacagtcatgcaaacaatagccctaatagtgccctcctagtgtttcgagagaccacccctgattgccgagttaattacgacagcctgtcatggccatccaaccagggctaaatacagaagagtatcctccccaggaaagtgtctcaggaatatacactaacgtagaggaacacctgtactgagctgtcaccatcagcagcccacctttactgtcccgcagcatatatggccagataatgatactccctccgtttcacaatgtaggtcattctagtatttcccacattcatattgatgctaatgaatctagacatatatatctatccagattcattaacatcaatatgaatgtgggaaatgctagaataacttacattgtgaaacggaggaagtacttaataatctaagcaccatgcttgcattattaaatactacaccacatccatgcatccaacatagagcaaccgaatattcggacattaaacccataccaatgcacctcttcggtaagctagctacacaactatatcgatacacgtagaaaataaagtcggtactcagataataaaaagcgaataaaataccaaagatgtataaagaagaatattctattaatttaatgtcttacaaaagaagagagaaaagctgctagagccatacccgaaatctcctgaagactcgaggactaagaaaactattctatttcctactccactagcactagaccactactaaacttgagagagctctttgatcttcttcttgagtgtgtggagaatggagtgagaggaggggtatttatacgctatgaggtgccttgggagtgtggaaatgctcaaagcatccaatgagcatattccctcttgcttcacctctttgtgccaagtgtccatgacggttgcttcaggtagaaacggtcacaactgccatgggatgtcgataactaccggcctgtggaatttctgggccatctgggctgttttgggttcgatagaaccctagactggcccatttagcccacaaatcgacagatgaactcctcgttgattcctcagctcagaagtgcattagttgggcccaattgatattattttaatgggtttagaggcccatccacccgtaaatctacctctcgacggattttgattaattgttcagttatgtttcgtcgattctcctccatttatgaatgcttctcctgcatatatgttagtagcatagcacatagtggaagtagatattttatttggaaattatgcattgcaagcatagctagtcttcattaattgggtaatattgacggtcgaaattagtcgataacgaccgtcaacaatcccctcaagcttgaatctttgctcgtctcgagtaaaggatgaaaggaaacaaagacttggttattgatcaggagctgttgcaatgctgtatatctagaatgtacaaaatgcatagtatgggtacccttaccagaatcaagtcagccagcacggtggcttaaccatacgcctaaactgtgaggcatcatgcttcaccttgtcttgggtgtttgagagacagaacggttagtaaagcactactcacccattccttgtctaacttttattcaggagattttctcaaatgatttgtgcaaataaaaaaaacaagttgctcaaatgattctctcagtccctcagcggtatataattgtattcctcaccaaggtattgcattggtccctattctaaggtcatatatgtggagtttggtagggatcaagtgagtcatacttctattcacatttattacttctgatcaagatcatgcaagatgtgtgtgtggaatatatggtggtaccaagacctatttagtggataaatataaaactaaactttactcctttttgatatacctcctccttctttatttttgcaagctttaagaagtatggctagctctttgtcgaaactagatttcggcaatactaaagggggtagcgaacaagctgtaaaaatggatgggttatgagacaaaggatttatactggttcaggccctctcgatgagaagtaataccctactcctgtccggggaaatattctgctgattgtgttattgatttgacaatctgaagggtggttataccctcaaggagccccccgacctctccttatataggtagaggagtcgtgattacaagatagaaaccttatcccttacgatctaagttctatagatattttacaattgtcaccgagtaaaactacaagatatttccttgatatacaagttaacataatacctgagtccttatctttacatattctattactatgtgttacccccaataaccagtcggataacacaaccctgtgagtatatggtatagcccctgagacattcacagacgacgagataatcctttcccaagtgatttaataaaaaggtcgagtaattcaattatcctccgctgcaaccctcgagtacttcaatcatctcaagctgtgaagggctaaaaaaacaaaaattaaggtgcatcaactagatgcacctaattaggtgtagccctcgactatgtaattagttgagcaaactaaacatatagtcaaggataaaataaataaccaaccaagcggtatggaatgattacggtcatcaaaatgactaaacaaaatataaagccgattaatcgccgattcgccgtcccgtcctccatccgccgcgcgccgtctccgcctacgcaccgcgcgccgactccttcaccaccacacagcctcgccaaccgctttcatcgttctcccacgtcgccatcaccatcctatctgctgccggcgctctccagtggtcctgcctaccgccggcaccacccc

SEQ ID NO: 35782 - DNA, 1383 bp, Oryza sativa
ttcccaccttacccatactttgctcctgtgggctatgagggggagagagcgctggcccagtgcctgttcgccctcgcttagatgggcgccaccgctaaccactcactcgccgtccccaagatcgggtgcaccaccgaccccccgctctcccttgccaagatcgatgccgccgcacctattgaaggttgctgctgcgttgaaaggggaataattttcagacttaaacttactgaatccactcgatccactccaccgccatcgcctcgatccactcccatgtccttttggcgcctgctgcatccattccgccacggctgcatccactccacgtctccaccacagctccatcgctgcactcgatcttctagcggtaacggcgccgtctctgcctgggccgtggtgcgaaagcgtcgtcgccaagctggtcagctagccccgatcagtctccaagtttggttgattggtgataacgaataacgtacaatcctgactgtggtagtatggtagaatagcgctcctgtgctccagctaatagtttgtttgacagacgcttgattggctttttatgtgaccattttataatttatattttgtcatatatctgtgctccacagagtagaaaaggtgttgaaggaaacaattgaagacaaaatatcggtagtactccaagttgctatcagggaagcacttacaaagtgtttgtggaaatgcctctcaacaatatatccacacgtgatctttaatcttcatgcatttttttgttggaatttttttccttgatatagtaggtgggactggatttttcacattttggtccttttgaaaaacttatttcgcaaatagacccttgaaaaaacttatcccagaaatggtcctttttggggcgctagagtggctggcgccgtcgcgccagcctctctggcgccgtccccctgccgacgtggcggggcgatgctgaggtggctagggggagcgcgccagagtggctggcgccctcccccccaatttttttttcttttatttgtttgatattttttttcacatttagggacacacaaaaagcaaccatagaaaaaatgaactcaaatggacataatatgtggcatgtagaatttttcctctcctctcctctctctccgaactagtgcagaggagagagatgtgcaacttttttatttttattttatttttctaatatttttttcacgtttaggaactcaaaagaaccaaccataaaaaaaataaactcaaacggacaaaatatgtggcatgtggaattttccaaagctctaccgaaaaatttctctcctcgaaaacacaatcttgcaagcggaatttggaggttttaatatcgctgaacccggcgaagcagggaagaatcgg

SEQ ID NO: 35783 - DNA, 1342 bp, Oryza sativa
tgcttaattttcatgggaaactgcacttatgctgattaacctagctcttttggtgataagaattaatatagtttacaaaagcgttattgtgcattagactaaatgaatatatgtgaagtcgttaaattatgtatacgatgagtgcaagctatagtcgctgaataaaatctcactgattcattgtagttgtaactaaagaaaaaagagactatgctcaacaccttcgccgcctcccaccttgatggcatgctggggtcctcctcaagcccgcttccaaagccaggatcctcatccatatctgctacccgggcccgtggcattaccgactcccaagttggcgcatctgcgacaatgggttatgtggacaccccgagtattataccatccagtgtccaacgcgaccaccacatactattggagaagtgggatccatacatgcacaaatagccactcgtcctcaatatgtccatgatcgcggttgacaaccttctgttataataaccgaaatgtcgagtagtgagcgcaagacataaccgtaagatagcttgccagtccactctgtcataagcccatcaaccactcgaaggtggtgactgaaagcataccccagtgactcgatccaaagcgctatccccgattatctcaagcgatcaaaactcgttactcatgcttggctagtccccaggaatgcgactagcctcacactttcatcgcaagcaattaataaacatagcaagtcccataatagggttaaagtgcagcaaggtacatgacacataatatggtccaaggtcccaacatacaacacataaatatagcagcggaagtctcaattagagttcataagcaaaagataaaaccggtggtgccacaaccccactagggcaaaccaaccgggcaagagccaagctgcaatagatcacttattgccctcgccgcccttggcaaagcaatgaccacacaagaaacataactcataaccggaatcctctcctgaaattgcagacaccgggttaagtacaagattgtactcgcaagtcttacccaaaattataaatacataagggagagagaagtatgcaagctttctagcctatagtgggtctctaggttcaacatttgcataaagctaattttattgagcaattaatgagtaaaataagcaaggacaagtaaatctagcatcattttaatttatggacagcaagtatataattctgaaatgtataagcaaatgagcccaaacggcgctctcatcatcagccatggactaccaaagtccatgccaacatggcacaacatgccaacaccaccatctaacataatcccatccataataatc

SEQ ID NO: 35784 - DNA, 1604 bp, Oryza sativa
ccatacaccataaaccgacaatattaatatctaggcaatgcatgcatatatgtacgtatagattgcaaccaaatcatttttagagaaagcataggttctatatgcttaggtgcttgccttgctgctgcgtggaaacacactcaacctcagagtcttgctccacgtactccgaattctccgaatctatcgataagaggcaagtatgcaaataagattcgaataaacatgcatatgcaacatgctctgcagaacacggggtaaacacagtggacatgtcacattttcaacaagaacttgggtgaaagaatgaccctatttgctgccatgattctggagatataaaagtgacaagccacaaatgctgaaaatggtcctatgccaaaactgaatataaactataggtcatttggtgatacccacatattctagcaaattttcatgggtgaaacttgctccatacaaaagagtataatttactggtgataggaatagtattcggattatttaatttggagtttgaacaagatagtaggtatatatgaaacctagagagtgagaaaaagaaaactgctgtctgcagcccttgtgcccaagatttgattcgaaagtttacttcgcaaatgctcagtgattgaggaaaatgaagaaggcatgatttagctcagctattggttttgtaaatacaacttttacaaggtgttggttagttctcggagggattaagtcgcaacatgaaatttctagctggcctaagaacttatgatgctgaaagacagcaacttgcttccaatggcaactcataaaggtccaaaggttgctgttacactccatgcatgcatatactttagaatgcagatggtgaggtactttggttgtgaaggttggagcacaaacagccatagaacaagaacaaatcaatgaagaaaaaaaaaatggtgatagcaacctgagtaaaccgagggagataggggttgtaatcgtcggagtggagagagacgagttgcagctgttctttgctctaaaatcttgcatcaatgacctgtggagagaggtagggaggctcaacacaatggcactcacaagagggacacaatggatgggaaggaaactcaccaagtggaggaaaaacatggttgttttgctgctgcaaccagcagcaagctccacctattttcttcccgatctccctcacgaatccatgcatgtgcaagatatttggatggatgggaggcttggatacttgagattgttgtggtgtgacatgcagggatggatctcaagtgtttggaggagatttgatgggaagaagtgagctgggagctcagcttgcaagaaagaaaagaacaggcacgggagaaagaaaagaggaagaagatgaaagggtttagcttgtcttatggatctgatgtgggtggatgacctggaggtgggttggggtttggtggagagcctaggtctgtgacaggtggggccaagtcgagctgggtccatgggacagataaaggaaggttagaaccataagtacacattgaaaatagtgaattttcaggaattttccttctctccttcttgggtaactagtttgtcctagctacaagagagtc

SEQ ID NO: 35785 - DNA, 7649 bp, Oryza sativa
  unsure (1)..(7649): unsure at all n locations
nnnnnnnnnnnnnnnnnnnnnnnnnnnnnnnnnnnnnnnnnnnnnnnnnnnnnnnnnnnnnnnnnnnnnagagcctaggtctgtgacaggtggggccaagtcgagctgggtccatgggacagataaaggaaggttagaaccataagtacacattgaaaatagtgaattttcaggaattttccttctctccttcttgggtaactagtttgtcctagctacaagagagtcaaaaatgtgtgttctggcgtggagatagattgagttacgtagtttccatttttcaaagtttcactcaaaaattcaaaatattttaattatggcaaaaaggtgaaaaggggtatgctgagaaataaattgaattttaatgaggttaaaactgactgtaaaaattctagaaaaattatattaactcattataaataatgtactatttgaataaattataaaacctatatccttcagttcaactttaggcacatttagaagttgcttcattttgccaattaggtttctaattaatttagcttgactaccttgactgctttacttgaggtagtaaaaagaatgataaaattatgaaaccttcatggtggtcatcttaggttgtctaagagacaagacgagcttcaaggaattttatgttgcttagatttagtacagagtctatgttcatttaacatgtaccaatcagcaaaacaaaagaaatcattcaagctaataaattggacttcactacaaacaggtacacaatcacacaatcacagccactagttactcaaattacaaaccaaatgctatgcgtgattgggtagattatctaataagagaaatattaatgactagactatgaagttatatttccgattggtcatttaatatagttaaatacaaagaggttttgacttggcttaaaagttaaaagggagaaaaagaaaggtggatcttcgtggattatctggtattgagttggcttagtctcttatattctcgttccattcgtgcaaggaaattattggtgagtaggtctttagttgtgttggtgaattttattagcgtcgtagtgctctctgaaaaattggatgagacttcattaacccagcaacttatagatttcgccaccaaggttatagagttatttgttttctgaaaaaaaatgttttccctataacggtaactaaagattcacatcgtcccaaacgaaggtctggtaaaaggtttaaatttctagccattttaaacataagaatcatctggagaattttttttaagaaagtttttgaaactcctataattttatcagaaacacaatatatgacatgttaaacaactaattaaaatttcaggttgttacaggttatggaaggaggaccccaagggaatgttcacggacaatatccagaccaacggcgcgtccatcacttgggaggagggtctcatgcctgaggtgaagtattggtttgtgctgttcgatactgctaggttgttagtagggtttaaactttagaacaatcacgtcaggtaaaaatacatgttgtttcgtagaattttacaatgtgaattattcttaaattggtgaatttgttatgtaggaaggaagaagcagggaggctgaaatttctattttaatctaataatggagttgaacatgtgatttgatctttatgctaatttattttgcaaacaatctgggtgtggttactgactgcatgctattttttcccaggttttcctgttggaatttgcttattttataagttttcttccttaaaattccatttgttctgtgattgttctcaagtggcaaatgaggaagttgttgatttagtatattaaacattggtggaggaatattgatcaagtgcaaaattgatcaaaagttgcctgttgatctggcgacgaagatcagttgcaaaactaatactctttcaaaatagacatgatagcaaaggttgtatttttcttaagttctttgcagcataaatattccatactggtgtactgtggttctacacggtgattttcttaattttatttaattttcattttgtatggaaacaaaaatgaggcttggtgtcttctccgtttcaatgatctattctcgccaacatggattccatgtgcattgttgtactctggttggatgctctacacttctgaagtgttgtgtttatttttcattttcaagttgagtggaaattacaatgaaaatttatttattctatctctgaaacgaaaatggacagtcttggatacatattaagtatgcattgctaaatattaggttgaagcaagatgtaataaagaacgtgcattgcacgtgcatgattactagtatcaatcaaatgtcttaataaaccctcactgctttgcgacttattaaagaagtccacaaaacaagcataaaaattttaaactgtaaggtaccttttaaaatgcactgtagtaattcactaaagaattaacggtattgggtatttaatcacgtgcaaatttgccaaaacaaaaattacctaagacccaaaggaacgtgacaacggtagctcggtaagaattttgacgtgggaccaaaaccatctgaaagtagactccataagctttccagcaagtactcatgggcctcgaaattccttctagatcagcggctaggtccgtttgaagttgatgctgttaggaggcttgattccaaatccaaaacgtgtacaacttgatctcttgtcttctatgggccaaaagtgacatggtgagttagaagtagacttggagaaggtcttggtttggtccccaatcaactttatcatccatgcattcgttatgctcggcctcttttacttcgtacaagcaagaacctctgcaaacgaaaacacacaaaacttattgtgtagtaacgtttgttcaaatatataacaagtaaatctaatgtagaacatatgcacctttggttgattaatacataaagtagtcatggttatatccgagctagttgtgtactcatcagctggtatggacccgaagtggtcacacagcatggcacgtgcgctggcactggatacacggacgtggccaagaggggacgttcctggcctgggcattaatagaatacttatatcaataagctgcaacttgttttcagaagccgatctccaaagaactctagggttaagcgtgcttggcttggagcaatttgggatgggtgaccgaccgggaaattgttcccgggtgcgcacgagtgaggacaaagtgtgcagaaaagacttgtgttggtctgtgaggacagtctatgacctataaaagctatcagatgtaagcaggcttcccgggtgcgcacgaatgaggacaaagtgtgcagaaaagacttttgttggtctgtgagggcagtctatgacctataaaagctatcagatgtaagcaggcccggcctgggagaggtgggtctacaagatcctagagaacatcaatgttaagctagatggtttcgcttctgctttacaaagccagctgagcttcaataaaatgatagaaacacaactagctcaattggcttctttagtccctgcaactaaaactgggaggattctgggccaacccgactcctccattgaaaatgtcaaggcgatcacgacgaggggaggtaagtccactcgtgatccgccgtatcctaaccctacaggaactaatgggattgccagagaagcgccatctagtgactcggctgacaaagaggttcagccagaaaaagccgtgccgcaggaatacttcgacacatgattgctgccgttttcctcaacggagtaggaaaccgtcagtggacgagcagttcgctcgctttgttgaagtaatccagaagattcacatcaacgtgccattgttggatgctatgcaagtgccaacatatgctagttatctcaatgatatcctcaacaacaagagaccgctcccaacaacagaggtggttaagctgacggagcagtgcagcaacgtcatactccacaagctccccgaaaagaagaaggatccggggtgtcctacgatctcctacgaccaaaccctgtgtgatcttggagccagtgtcagcgtcatgccgaaggacgtctttgacaagctcaacttcacggtgttggcaccaacaccatggtgttggcaccaacacggatgcgcctacaactgctgactcgtcagtccgttacccagcggagatagcggaggatgtgccagtcaagatatgggatttcttcatcctggttgactttgtggtgctggatatggacacgggaaaagagacgccgctcatcctggggcgttcgttccttagcaccgcaggagctaacattgacgtgggaacgggaagtatccgtttccatatcaacgagaaggaggaaaagtttgagtttcagccaaggactgaacaatgctccacggtcagaataaagtacgggccaaacccgcagaatattcaagtggtcgaagtggagccacccaatacggatagcctagtaagggctcctttgattcaaaggattggcataggacttttgtaggatttacaatcctatggattttttcctatgtatgtctttgattcataggaaatgaaaggaaacattccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaagagagagagagagaaagatgggaacgagaacaccgaggaccacatattagcagccaagaaagccaactgtgatagagatagacaacagcttgagccggccgctgggggtgcaaggcggaggcgaggctcgccggctcagtcgcgtatgcggcttctgctggggacgccggcccaacaactagcagcacgcagcaaccaagcacagcatccatctggcgcgcaggttgggctccgctaggcggaggcgtgcggcaggtcccccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataagganggtgtattcnttttttctttctttttttttgggnnnnnnnnnnnnnnnnnnnnnnnnnnnnnnnnnnnnnnnnnnaggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacgacaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcattggcgagataagtcgttcccatattttgatgatttagctccactttatgatggtgagctttatattttttttatcagtggtttgtttgttttgttgaaatgttttaggcaagttatgctgatcgtgaggagaatataattgtgtaggtcgttatgctgaagggagaactcgccatggtatggaccattatgcaaggaagacaaagaatgcaccagctcattcaacacaagaagcaaatgtggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagaaatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaaggaaatcgcagcattagagtgagtacttttgtgaaacatatggcatgcaagtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgatgtgccatgtcatctcgttttctattcccagcttctctagagttgttaaattcttgtacatcaccattatagttctcgtctccatttggcacatcaacaatatgatctggatcaatctccaaacgacaattacttggccacaccatatctccattatgcaggcgtatgaagttgtgtagaacacaacaggcaaccgaaatatcaacttgtttacgagctgggtggtgtgagccggtctttagtataggaaatctcatttttaatacaccaattgctctctctatatggtttctgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggtttnnnnnnnnnnnnnnnnnnnnnnnnnnnnnnnnnnnnnnnnnnnnnnnnnnnnn

SEQ ID NO: 35786 - DNA, 2679 bp, Oryza sativa
  unsure (1)..(2679): unsure at all n locations
taataaatctgatggtttggtctaccaatatatataggagagcagaagcaagcaaataagttgctaatccttacatacataccaaaaagaaaaaaaaatcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggccctaaagttcatgcagaatttcctaaaaaaggaaacaacgatgcacaggagccgttaatggaagacgccggtaaaatcaagtacaccggccaagaagctagagcagtcgaagccgtcttttgcaccaaaaccaaaggtgtggatagaaaagccaaagacgcccgctccattacctccggagacgggtggaaaatccgcgcactgaactgaaaggaggtacggtcttgcacgtcggacttaaaatgacgcgaccttcaccaacaggtaaattggtatgtatccgcatatttgttttcaacaatttaaaattttgcatcatcacatgtttgaatttgaaaattgcatttaggatttttttgaattttgaggaaattcttcaaatgaatttttcagagcaaatcaaaataaaattttcaacgaaaattcactgtgccacgaccacactgaccgttggaacccaacggccgaaagtagggctggtttggctcaccaagggttcggccgaaccggccaggcaacggtcggctgcctccctttttgaggcaacggctagtgggccccacaggtcagttttgaccattgtgggtgcaccacttaagccaaccggccgggagagggaaatccaccccatttcaacacattttcattcccattctaaagtttgctctcaagttcattcaagctttgatagtttccctcaaattcaaatacttagctgcatatatacaagttgctttggtgaaactaaccggcgggtgaaactcttgctattctaatccccgccgagttagaccgttcttgctccattgtgcagaatgaggaggcagctgtctcgtctgttcaaggggtctggcttttcgtcaagtcatcatgacgagtctagtgctcattcatcagctgatgtctcgatagaggacgccgaagctccgcgacgtctcctgaacgacgccgacctcgaccttgttgacgattgggaaagacaagcctactacattctgagcgaccgggagtacgctcacatgcgagaatactctccggagctgctgaaaaagataggtatggatgttgattttcgtgctatttggaaagctgttggttggcatagatttgctgtggttgatgagcctgattctcgtttgcttacttttcaatttgtgtgcactttgaaagaaatagaagatggagtttccttttgctttttccataaagaatacacacttacatggaaaggattaagtacacttcttggctttcacgattcctgtaaaatcgatctccagaaaggaatttctttgttcgagaaaaataggttttgggaagatatttatggtgctccaatttgcaagaaacctaggacgaatgatatccataatcctacacttaggctcatgcacaggtggattgctatgactttgtttcctagaggtgatcttagacccattaggggggatgaattaattatcatgtttgccatggttacaaaaaccaaaattgctcatgtgaaatgtatgataaggcaatgttaggacgtataagattttttgctcttgttgagtgcacatctctgattactcggagcaaaagggctaggggtcgttagtgaccaaatagctttcatctcagccgctcgtccttgtattgatgagaattatctagtgcaagggcatattcttaaacatgaagtagatggatctttgatataccttttccccggttgtacaaatgaaattccgttgccaaatgcggggtatcatttgtacaactgctgtgaactaaccattcccctgcagaccatagaagaatctcgtgcaggtggagcatacagggagacgcgcaacatggcaaggaatgaacgagaaagttcatcatccccaacacccgtgcagatgtatgaggcaggttgggaaccaattggggatgcacccggatggacccaagctccatgccatagcattggagtctcaagctgggcaagtgccagtgaggaccgatggcatgtgtgtcacgtccgtaaataacccaacgggcgttccttacgtgcgtgcattattccttgtcccaggaggcaaggtacaccaaaagttgatacaattcagagtttaacaagcggaagcgtaattattttattacatgggcgccgaagcccccgcgcacaagaagacaaatgaaaacacagcggaagattagggcgccaaccacannnnnnnnnnnnnnnnnnnnnnnnnnnnnnnnnnnnnnnnnnt

SEQ ID NO: 35787 - DNA, 1626 bp, Oryza sativa
  unsure (1)..(1626): unsure at all n locations
nnnnnnnnnnnnnnnnnnnnnnnnnnnnnnnnnnnnnnnnnnnnnnnnnnnnnnnnnnnnttgctcaaagctattttgtaaatacgatcctcgagctatgcaatattattaatcaaggccgtgaacccacacgaacctgccttaacccaaggcctacgatgattcagaccaaactggcaacccgaccctgggtcccagctcgtcccaagccaacccaggccaaccattccacattttagttgttaagcaggttttaagaattaaaatactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatttccatccgtgtacttttgtttataaccagactgagccacaaactaagccttacccactagacatgtggaagtacggtagtgctttgcaacagaggcccgaagaccggtccttatatggccgaggtgctactatcgaaactatgcaccccgagcccagcctaaaaccattttagggattttgaatagagggggcggtgtgaatccaattccacaataatccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaataacaataataataaggtcataacaaaggtagataggcatggctaaataaaacagtgataacgcaggaatttaaataaagcggtaatgcaataatttaaattaaaataatttcataaactgggattcaatatgttcaaggatgatgtgacttgccttgctcgctttcccaaacgccggcttcaacttccacgaagagcggatcctccgaagctgcagcgtctacacgaccaacggaaaagaaaaggcttttactctaataaactccatataaccagtaggaacaaagcacaaaaatgggttcttgacttcctaaggaaaaattagagacttgaacggtccaattccgagttcaaatggccaagttatggccatttgaagtttatatgctctttaaatgaatatttgcgaatttcttcatttaaattttaatttaaaaagggttcagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35788 - DNA, 164 bp, Oryza sativa
cccctagaaaaacttaacccagaaatggtcctttttggggcgccagagtggctggcgccgtcgtcctcctgccaccgtggcacacgcgaactgacgtagcaggaggagggcgccagcacagctggtgccgccccagggaggagggcgccagcatggctggcgcc

SEQ ID NO: 35789 - DNA, 7072 bp, Oryza sativa
  unsure (1)..(7072): unsure at all n locations
nnnnnnnnnnnnnnnnnnnnnnnnnnnnnnnnnnnnnnnnnnnnnnnnnnnnnnactgccacatcattatctagtaacaatcattaaatttaaacatcaaacaaagatgctatattgtctataattttataatttattaaattttagagcttttaaaatgcaagtatgttaaatcatcatcccacattatcacataatatttcaatatacatctttattattttttaaatatactatgtaactatatagttcatgttatttttctcttctctcattaagccatatcaaatcagttgtttttagtgcttaaatgaaatctatggtccaaattttctctctttttcttctctcattaatctatatcacctcaatgatttttagcctttagatgattaatctatggttcaaactatctcaatattttttttctttcataaattcatataaccttacttttacattttaatcatcattctatatactattaaaatttaaattatcataaaagatgttaacttatgtaatcttatgttgtctacttgtcttacacattatttttatttattgttatcatactaaattcccgcagcaacgtgcggggttttacctagtaataatcgtaagatccaaacctaacccattttttaattgcactatcgatggcgacagatcaatagtttaacatatgttttgtcactattcatctaatatatgaataaccataaagattttttatgggaaaaattttctatacatatgttttgtcattatattcatttaacatatgaataaccataaaaaaatggcactataatacttcctccatccacaaaagttacacatatttcacattaaagtttttctaaataagttgttcctatttgtagtctttatgcattcaagacttaaatgagaagataaattaaatgtttgatggagtcatctaaatgctcattggttgcatgcttgcattcactccttacatccaaaataatataatttttcttggtcttgatgacaaaagtaatatgtgtaacttttgtggatggagggagtactatgactttgtttggcaaatgggattgggaaaataatatcccaccctttaaagggcaatattgcatcctaaccattcatccttcacacctcatttaatcctagccattcatccatttccatttcctaatcccacctcccatatcccatttgccaaacacaccctatagtttttccgctccctctctccttttatcttttcccttataagtatgactgtactgatggggaataatttgtagcttgccaatggagtcttagggcctatttagttcacgaaaagataattttttaggtgttgcatctgatgtttgaccggatgttggaaggggttttcggacacgaatgaaaaaactaatttcataactcacctggaaaccgcgcgcgagacgaatcttttgagcataattaatccgtcattagcacatgtgagttactgtagtacttatggctaatcatggactaattaggctcaaaagattcgtctcgcgatttctcccttaactgtacaattattatttttaatctatatttaatgcttcatacatgtgttcaaagattcgatgtgatgtttttggggaaaaaaattggaaactaaaccaggccttaaacctgttgccggcgatacaaagagcgcccttttgtgttgaaatagctactcggtttagattttcagcgccacgtgaaacgattagctgtttctgtgctcattttctttttttttttatcaaagagctcatagcaccttttccgaacatatcatctcgggatggtatcttaaaatcaaggcagagcatttgaacaaattagctagaaccccgggcgttgctgcttaataaaaacaaaacatttaacatatgaataaccttaaagattttttatgggaaaaattttctatacagaacacctataatttacatacaagtagagtcagatgacagagatcaatcacatagggggcagtggctcaacatacagagacgactagttgcatatagtcgggactcaggcgggcaagtggtgggccatctcgttgttggagggggagagcgcgaaccctactctctttccccattgccacttgcggagttgcggtgactagggtgcggggtagggtcgacggtgctaccgtgatgtgttctggctggtggtgctcctgttccacctgctcgtcttcgtcggggcgcttgcggtcactggcctcaaccgcttcgcccaggccgaccgcttcaccaacctcactgctacacatcgcttcactgaatcgctggagcccgtgagggagttgctccagcgcccgacgctcgaggttgaggaggtcaccccactaagctcacggagtcgtagtagccctactatggcaccacggggctgtggggtctattatcgcatgggcatggttggtggcaactattgggagcctaggaggaaagatgcggagagggtggtcatgagggccgccacgcacaacctcaccacgtacctcacggtggtgagcttttttttttctcttccccaaaggtcaaaaaggtaaggtataatcccaagattatatattttattatgcttcatttggttaccatataagttttcttgaatgttatctgagtgactatagttcacatattgttgtaaaaatttaatttcatagatcagtaaagttcattcattgatgttgtttgtcttctaattttcagttgacttagttttgctaagatatagccccccttttttcacttgatctcgctttattccctgtgtagtatatatgtatatgtatgtttctatctccgttatctcctctcaagaagataatcaatttcttctactctaattctcttgtacaatgggtactagaaaaattacaatgtaaccattgaaatttatagtgtcatattggtgtagatgtagtttacagtataaaaaatttgactggtttttagaacaatatgacaaaaaaatatggctagtccctagtttaatttggcccaatagtttagacgcggttatgaaacaacatatatagaataaaacgtgaattgtacatgcagtattgctagtctcactaaaagaacagtagctccatggagaaataaacccgcaacaccagtcatgtaattccaaaagtagaaagatacatacaaagtgcggctggtgttacccctctctgtacattgttcaataagtagcacatttggaagcaactcagcagaaacatcatatcaccacatgcgtatacaatggcacaaagaatatgcatgtctgaagatcaaaagcctaaagagctaactttaatgttcacaccctcctgacactctttccatactccttcctgatctcccacagctgctctccaacttctttcatggtcggacggtcctcccgcgtcggagcggcacactggaatgccaagttcagcagcctttcgagcacctcatcgtccacaggatcctccaacaacggatccaatatctccctcctgttcccttcattgaatttcttgaatgtctgcagaaatacaagttaaagtgtgcccacattctctacttatggacaggacagatacaaaagtagagttttgacttgaaacacggttgtaggtaaattctagctagaggttcagttccgctatatttcaaattatcgtgcaaaaaactgaggacagttatggttagatcagaaaaacgagtatgattttaccctcacattttgccagagctgtattaacaatcagtgtcattttagttcatggtaacatatgatcacatccatagtaatagaagtatgcaacaagtgtaacatcactggaattaattgcaaagaattggtatcaaagaagaagccattgaacatacccatctgatagttattctctcttcagcagcccgcttcagttctaccggtcggcgagcagagagaatttccacaagcagtatgccaaaggagaagacgtcgctcttaggagtcaactggtatgttctcagatactcaggatcaaggtagccagcggttccttttacttttgttgagatgtgtgtcttttctgtgtcactggggccacttcttgcaaatccaaagtcagacaccttggcccggtagctctctgtcagcaggatgtttgatgacttcacatcccgatgaattattgtcttctctgttcacatcggagaaattatcagatagcaatacagtattattaaaatcaaacttcatcaaaataaaaagtgtgaatttcataaaaccgcagcaatagcaaatgatttcatcaatatgaaattttctcccttatgtgtgtatggcatgtgggcccgatttgcataaagcatgtgtacgtcatgtgtatgataggtggggccaaaattgtagagatataaagttacagctttttgataaaatcgtatgctattgttgcagttctctgaaatgcttagctaaaccatactgatagttttgacaaaatagttgtagctttctgaaatttactcaaatacaaatatagaaaattggcactagtgttatttcaaaatagaaattatgcaaccaaattaacaaggaaaaagtctaatagatcctctaaactataaaccatcccaggaaacttctgatctatgcaaaaacatttaaataactcctttagaggggtcttcaaggtggtttgccacttcggcatctgatgtggtagaaaatgtgtatggacttcgcaaaattcataaaaataaatttccttgcatattcagattgcatgtgatagaaataaataaagggagagagaataggtcatcttctttgctacacagggcatgatgatcgacccgcactgtggagagaactcgagatggccaaaaaggaatgctcactacacaaggaacttaatggtgctggtgatttagtagtccgatgggcattagagttgtgctggcaggcacatctctatagaaggtatagatgagcgcatcacatcaatattgatccaaggaaaaacagagatggcttaccagcatatagatgaagataagtcagtgcatgtgcaacatcaattgcgatttcgagacgctgattaaaatccagggttcttccatattggcctgcagaatgcagaaatatttattaatatggaaatttggaaacacacaaatggcaatgaagagaataaatcagaaagtgcaatgtaccatcaagatgctccctcagagtgccatttggaacatactcagtgataatgatacgttcatgtcccttatcagtaaatcccagcaacctcaccaaattccggtggtcaatcttagcaagcaattctacttcattgctaaactcatctctgggacctgcgaattgatcctgtgcacaaaaaatagtcaaacccattagcaggcagtaaaccaaatacttcgtctggtcataaatacttgatgttttggataggatctgactatcagcgacttctaataaagtactaagtttgaaaacataaaaatggtacgtagatttatcctgaaatgtaatttcataacatcataaacttattgttggcaacttttttttgacaagaagacaatcacgatcgggacacctaaacgccttgcggtgatatggaatcgccaaccaccccaatctagccaaaagacaaatcaagatgggttttgtagaaaaaaaagctaaaccggccagcggagccgatttagagatcaaaatcagcctctaagctgatttagatcgatatgaggataactgcccgtctcgtgggcaaacggaaggtttacgggacaaacctacaaaggggtaattgcactctcgagcgacggcagacgatttacggcgcaaatcgacaaagatgaactaaaactagagtaaagtagaaaacatggctaaagtaaagataaaagaacgattcgattgtgtttgaggaagagaaatatctcgatcaaaccggccttgtcccttagataggggttggtcttgcctcctacaagtcctccacgtccaactcggggtagaaaccaatggaaacccgaaacatgccttcccgagcaaggaaacccgagacccgacgaaaaacagactcgggctcggactcagccggtctgaccggcggcacgcaccgccggtcagaccggccctcaagcaacggtctgaccggccaacatacggcggtctgaccggccctgtggaggaaaccggcaatttttccaaatcttggcaataattccttaatttgaacctaggtgccaaatttgggtgtaaacacttacaatattatataaatttattctcatataaaattatgggtaaggcaccttgaggaccacgaaaaaaaaaatcaaacatcattttttacctgagggagtaacttaatccaaatcctaagagcagtgtattcacccatagatattctaattaaccccaacatagtgatataaaaggagcaacgtgtaccagtggtccttaaacttgccgaatagtgtcatccaggtccctacactttcaaattgcagatttaggcctttatagttgtttaacgtaccatcatgagtccaaatgtgcccataccctcttcaagagcctatgtggcatgctaacttggagctgacgtgacatacaagatgacatgagcagtgtagaagggaatatatgcatatatcccatctataccaagctcacacatagcttatgtgttcccacacaccatgtcggctctaagttggcatatcacatcgctctctagagagttatgataaacaagtttaagaacctaaatctgcaatttaaaagtttagtggcatgactgacactgtaagagggccgctagtgtactttacgcattggccctgttcttttcagcttattcaccagatcatttgctccacgcttcggaaaacacagtttctttaaaattcttttaccgcattgcctagaccacttatttcaaaccatttgttaaatttatttcttaaaatatttaatttatcactataatagagtagataatctgcgcaataatccattcataatctaaatc

SEQ ID NO: 35790 - DNA, 1848 bp, Oryza sativa
gtagactgtcccaaatcctccttcacctaacttaaatgaaggtgagaaattctgagtagccctcagaatctgctgcacagttaagttcacagatccaactcgagcaatttgtggagattgtgcgaatctagatggacttgggggtattcggtgtggagttggtggaaccttctcagatgacgtgcttacatccaaggatgcaatcgattcgactggaaaaaagaagtttggttgttaaggacaagatcccaacaatgcttttgagtttgacactgaatcaaaatggtgctagtacggtaggagaacattaatcttgcaaacagcttaacagtcagagctgcataccagaattgagatattctgcaacatatattaaaatacataatgtgcaaaatataaatggctttgcaaagaagttttattacaaatactttttcttggttcttctaggaaacattgagttctcaataaccctattaattgctaactagtaggggtgtcagagagatgggcacacctaaaacttaggtagcaattatttcattctgctgtgtgtatagagctaacgacacaaatgaggctggaaggaatagcagcacatgagttaaaaattacaggatgacagttaatcaaacaaacagattttgttctattagttacggactattatataagttctttttctgcactagatgccactccttcctaagtagcacagaccaagttaggaattggtagagatgatccactatggttctctgtaaatccacatactagccgggagttgctagtttggtaagtaaatggtaggtaagaaatttgtaaacacatactagtaatccatcagagttagctctaaaggtcccaatgtgccatcacaaactataccatgcagaagatggttaggatagcacaagattgaactgacatactcaacatactagaacagggagcatttgagcatgtatttaactcatgatgagagaaagctttagacaaccagttccctatgacaacaaattgcacagaatacatgtggattttaatccttacaaaatagctattcatctgactcttgccgtgaaacagtttgaagaacagaaatactatatactccctcttattacttgtcatttacgacatcagtaagtcttcaacacactttttacttcaactgtcatgatatgaaaaatcaataattgtgtgtatttaatttctagtccaccatcagcatgagtgggtgacaaccaaatggttttttttttcagcagtaatatagtgcaaggtactcatgatgtgtggactcacctgcattgcgctgaatggatgtagtgttatgcctgctgacttcctttttctcagcatgaaagcacggtatcatcagaccacagcataggagaatcacacctggcacagctagtagatgatcctgcccttccaaagaatcattatcatcctgattatgtccatgaattcccatgtttttacatgggtcatcttcaatttttgcatcattcattgagggctgccttaaaagcttccttggtatattttgtgctgcagttacaataattcccatgaaaccatgagtacacacaatttagaaggaaagaaaatctttgtgtgtacaacatcataccaagaaagtacacaaataaaggtgctctctcacaacatcatatcaataatttaccatgagcagatctatattggctctctcaactttaattctatacaatacaacatgataccaagaaagtacacaaattcaaaacccgggcattattcttagcacaattgaagctcgttaccaaaagctaatcaacaggatgaaactcaccggtgctt

SEQ ID NO: 35791 - DNA, 3051 bp, Oryza sativa
ccttacggaaatgaaaagaaaatcctagtcaagaacaagggggagaagaaagcaagggtgagcttagaattttgtggggaacgaactgcctgctagaacaccaccaaaccccgagaagcagaaaagggaatcgagggggaagatgaagacttggatttaactggtcacagcaaagaaacaaggaagactcttatctatatccagacccagtggagtcgagagaaggaagaaaagtcggagcagctaccgccggcggccgggattcggcggcggcgaatgaatcagatcgaagggtaggatagggtagcaaagggaagggaagaattgaggaggaggagcatagtgctagtagttggaggaggggaagaagagagagaaatatcaagccattttagtcgagtcagcttggattggagagagggactgtggatggatggtcaagttggagactccctggcagccggcgtcactgcgtctgcgtgcacactgactgcaacgtggggccggctgcggctgtctagttgcgtgcgctgctgattttcctactgtagaaaaagacctcacaagtactcccttcgttgttttgactttttttttccttagtcaaattcctttagattcaactaaatttgtagaaaaatacactaatattttcaatatgaaacaaatatattatcaaatatattcaatgctaaatttaatgaaactaattggtattataaatgttgctatttttttctataaatttaatcaaatttaaagaactttgagtataaaaaaagtcaagtgtcttataatatgaaacggagggattacttactactcattgaaaattaaacttactactcattgaaaattaaaaacattttaaatttcttaataagaaataaaatatccacgttccgagatataaattatttttgtttatgtttttctattgtcaaaatctcttatattttggtacggagatagtagtttttaaatttagagtatttaaatatttaccactctgaaatttattcagatttgtattattaggatgtctcaaatcccacattagatttattttttataagacggagagagtagacacatagggtggctagacccatatgtcatagtcatataggggtggtaacttgttaaatatcacatttgacaaatacttaactatctcttttagttacataagataatcctaaaacaatcatatagtatactttttttacaaacacagatgatcacaatgcgtgcgcactcaccttagacttatgagcatctccggaagactaagctactatatctggagattgagcacctttagtgactgatatattttgagattgatgaagttatcacggatgcctcattgtgacgttgttgattggtacatcgcctaccacttaaataataattagcagtaaatacttgcacccgtatcaaatcacataataattagcagtaaatacttgcacccgtatcaaaccacagagggtgtgctagtacactataagaaacataaccaattaagttaccttcacttgcaatcatatagtattgtgtattgtgtaaactcagaggtttaggaccaacaacagaattgcaagtctaccacacacttgtactcggggtttatttacccatgtcgggtatgaactaaacaccaaattgtaaatatgccatgtatgacccatgggttgttacaacaatgaaaaaaaaaggcaaaaaaaaaagtatatgttgcctctctctactgtagcacgagtcccatttttctccctcaacccgataaccatacagatgttccctcatatgtcaaaaccgagtcaaacaacctcccttagtggtgcacaacgattttgtcttatatagctggcaattcaacaaaattataagttcaaaataaaaaacatgctaggcctacatgccatcctccctattcgttttcttcctccacctctcctcatgtttggggaccaatcatcaattgattccatatggcacggtgaggcatacatgcgctcccgaactgggtgcgcgctgtggcgaggaagacaacaaccaactcaactttcttgcctccatctgagacaattagagcaggatgttctacagcacctgaattgagatcatataacttacctccctctaacttgtgtcactgacgtgtgggccctttacccagtggaccccacatgttagtgactcaaagtcagagggaagtaagctagaggatcccccttcctacggcacccatgggtgcacatgcgccacggatcagaaccataccatcatttcctacgaggcatcccacgcccatcgctcacccctacgctccacgtttcatgctgaccaccgagggagtcctcaagtgatcaagtccactgtctccacctcaccgctgcccgcaataacctttggtccatctcctcgccccatcacatctccattggccctatcattagtatcatatataggagactagcaagtgggatttaaaacatgggttgaccagataaagaaaatacaatgtaagatgaaccgatgggtaagccagaacctatatgataaaatcaaaaggtaccacaccaaaatagagaagataatccacaccacaccaacatgagattcttgatggctttgtttgtgccttgttcttcctacagaaattcatggagtgtacagtattagagttgtcacaagaacgaaaggaaacatattctatgcacacaagttcctgtgcataccaattagcaaatgtcatgaaaattctacagaaaaatagacatttactcctaatagtattatacatttctgtaaggtctcatattcaaattcattatattttagccgcaacaaaaaaagtgaaaaaaaactaacagttttaagggtaaaaatctattagaattttgtttttttaggctaaaatataataaatttgaagataagatttcacacgtaggtgtaatactattggaagtctgtgtccaattttttctagaattttctatgacatttgctagttggtgcgcacggagtgtacacgggaag

SEQ ID NO: 35792 - DNA, 2142 bp, Oryza sativa
accacaccaaaatagagaagataatccacaccacaccaacatgagattcttgatggctttgtttgtgccttgttcttcctacagaaattcatggagtgtacagtattagagttgtcacaagaacgaaaggaaacatattctatgcacacaagttcctgtgcataccaattagcaaatgtcatgaaaattctacagaaaaatagacatttactcctaatagtattatacatttctgtaaggtctcatattcaaattcattatattttagccgcaacaaaaaaagtgaaaaaaaactaacagttttaagggtaaaaatctattagaattttgtttttttaggctaaaatataataaatttgaagataagatttcacacgtaggtgtaatactattggaagtctgtgtccaattttttctagaattttctatgacatttgctagttggtgcgcacggagtgtacacgggaagttttgtgcatagaatatgttcccaaaacaaaagaaaatgttttttttattgcataagggaatgtcattgcttgccacaagctatcttggctacgcttcaatgccacaaaccaaggaaaattcactttttttctctttttgcttcgtttaacattttacccctgcaaatgaccaatattcccccacatgtttattcttcatattttcgaattctctcttgaatttctatcgtgttttcacaaatctttaggttctctctcttagaccttgtttgtttgatcccaagagaggggattaaggggaaataactctataccacagtagaatgtagaatagatctctttcaaatctctttcaatcatcttgtgggagagattaaccgaacaagaccttaagagaatattactaaaaatgttcttgatctttttggaaggttgtaggattactattaactaggtgattctccacgttttactgcgggaatcactaagcaattctgaatatatttttttgacaatcaagctagaagtaaaaaaggaaaaaaattgaaacattagggtttatcagtacttatcatgaaacaaacaaatgatacttgtattttaatgtgaaacatattgataagtatatgttaaatattataaaaataatagatatatttgttaaaatattgtgtaaatgatacgaggggtgatgattggatatgtttgcatgttgatttatagaattaaataaattatagatgatgttttatacttgcatgaagttaaatatgtaattattaccagtgggtgatgatgtgggatggttgtatgttaagctttgtaattttatacaaagtatagatttagcaccaatctaagctagatacgtgttccgcatgaaccaaccaaacatacgtggccttttcttcaagattaatattatcactggtgtaatcacccatctaaaatgatttacttgcataatgatcactccaaaattgcctctctgtccacagatgagagaaccacgtgccactcaaaacaagtggttgtacttttgtatggaggaaggcttcgaaatgcatcagctttccatcttctattattgggacatcattattgatcaagcaaactgtttaacccggggcccttgttggtctctttcatggtagatagtttaatcgccagtgttgctttccgtacatcatgcctggcaattttgggcataaaatctggtgttacacgacacaacagaacgcataaaattttcattcttttgaaagtttgactaatgaagtttgcaatgcataatcacaccaatgttagttaattaatggcttgtcgcgtcggacacgtttgagaagaaatttcaagatgtgttatttcaactcttcttatgcattcctacctggtaggtgtaacttcctgctgctctaggtggtcttgatttaaaaaaggtacagcttagctacacgggcccagatatgtatcattgtggcttttataaatcctgtacttttctcctgcattgttccaaaaaaaaagtgttctccctctttttgtttatatccgtgaatttttgtttatatctcaattcgtatcttaaaacgttgcacatacgtcttcagtttagtctatcaaaaatcttggaactgcgacgtcacatcattgtccaatgtaacgggcttaa

SEQ ID NO: 35793 - DNA, 15209 bp, Oryza sativa
  unsure (1)..(15209): unsure at all n locations
ccaaagataaccatgttctaatcgatgtgagaaatggcccacgtcggtcggccattgtagttgggagcggacaaacatgctgattcccgccgcggccaaatctattcttatctagcatgtcttgagagcaaacagctttcaaaggaggaaacaatctaaatgatgattgctggggacatgtcatgaaatgcccaaaatcatactagcgacgaacctctggcagttgcctatgcaaggaaagcgaacattctaatcagcagaaatgttacagcggtacaaggcctagactgcaaacattttacacggattggagctacaactttttagacatcaatctaagctatatccagagttacaacgatcggcatggccgcttggccaccactcaggcatcaggcaccgtcaaggcatttgatggaggcagcaggttgagtggagctcatttccgagtaacagcttaccaatttatcattcacctgaaaaaaaagagtaacaagttaatcatgtgtcagtacacgctggtccgtccgataacacaacagcatttatctcattgctttttaagaaaaaaaaatctgctagaaaatggatcaaaggaactaaaatccctcaagttctctacttctcgtcaaataaaactatctgtatctcagcatcgcatgtaaagatttgattcaggtcacccttttaaacatgacagcagtttctcattacagtttaaagcatacagtttcaaaaaaccactgttgttttacaacccaaaaaaaaaatcatttttcttgcactgcattccacacaacatgaaatggtcactggtgtttactttcatatagttcacaaagaatgccatactgagggtaggtaggtatttttctcaccttcagtctcaacttttccaagcacgttcttgtgcagattggatgccctaaatgttaccgagattaattctgttaattgaaattaatcaatgaagaatctaagatcaacatattgagaacaaaaagtaatgttaaatagtacctgttgtatcctactgggatcaatagcaccaggagtctgtagctgagtataattcaattcctatataaaatgtttgagatgtaaaatgttcaaatcttacacaacttacaacttcaaatgtagatttaagagacaggaaagttaaaatctcaacagtaaagttcattcaaattttatcgctattatacagtgtttcaagatcatatattcaacaaagaagtttttgtctcttgaagcggatacaacctgacgtgtcaaaagtgctgatagacaaagtaatcaaatcaaagttgagaatgaaaaaataaaaggtttgaatacatagaagaagcacatgtactgaaacacagtgctaggtagaaacattcattagaatagttttcttggtttgacaagactcaagaaacagaaaagggatctctttaatgagctggcaacaggaaagaaggaaaaagatagaagcagaatatagatcatgcgaagctggaatcaaatagtaatgtgcatattagaattatagctcagggaacagcatgtgcacctgctgtttcatctgcatttgttgctgtccttgttgtgcctgaggaatttgttggacaggttgcattgctggatgtgtctgagcctgaggtggtgactgaagttgctgcatggcaagtttttgttggtgctgttgaagcaaaagtagtttctgctgttgctgctgctgttgctgttgctcatacagcacatactcttcaggcttatcccactgtaaaacaataactctaagagtgagacccacaaatgttgcgatctttaaaatgattggtgatgagtttcaattcttcaccttactctctcgagttatgctattgtagtagtatttaaaaccttcaggagacgtatgttcagtccaattgcaggttaaaggaactgcaggtgaagtagcctgctggggaattgtattaatgtttgatggaataatggcatttggggcaccagggttactagattgcactggctgaccctgtagtggaaacagaaacggttaaaaaaaatgtcagccgtaaaccacattatacaactaaacacaaaccgcgtacacattggtgtatgcatagaaaatacatgttgctcagcgacctgtgtgggttgttgatggtttagattcgattgctgctgctgctgcattagttgcagctgttgttgaagctgataaattgcctgctgtgaagattgataactggattgcaaagcagcttgctgttggagtagcaattgtggtgcttgcgatggcatctgctgcactggctgctgaagcatttgtggtgcaacatttgagggaagatgctgttgcccgggaatagcttgcatggaattggacacggctgaaggcacctgcacagcgctgacggaagcattttgttgcatcaacggctgtgacacaggaagctgaccagataacctattctggccaaaagaaccaggacccatagattgtggaacttgaagctgaccaatctgttgagcaggaccctgcaagggttgtcccagctgattattctgcaattgaacagggaaattctgaggcaaccctggtagcttttgcaaaggtgggatctgctggcctcccagatgatggccttgtgccatgggaggagggttcatgccctacaaagtaaaaggtatcatgatgtttaaccgatattttccatctaaagctattgatgaacagaaaaagtcgaatatcccagtttaccatatgtgacgaacttggcacagctgtttggcttgacaaagagccatttccgctgaacatctgaggtcgaaaagtggcctatgatattgcagtatcaaaggtaagcaaatggaagcaaacagaattgaactgtcataaaaagattgatttgaaccacataccgtatctgttgttgatgtaacagtactccctttcggagccataggattgtcagatccaaagttattaaactgatgaggtgctgaccttgggcttgatggatgccaagagtcaggaggcatatgccgaccccttggttcatcaaggttggcggtcggcctggatagaaaaagtagactcagttcaagttctaactattctcaagcaagaaatcagtttaatatagtactacaaagacagtcatcaaaaggaaaaatatgaaacaagggtataatgcccgcactgtttaattagaaaacatactgaagggatggataaattggactaattttggaatggggtgtcaaaatacctgttttattgttcggtttgttggatggactactgatcaaagtttatatggacgttttcatttactagcctttgtaggactataaattgttacttgcaaaatgcaagcctcaaaaatcagtgaacaggctgaagggacgggggcaaactatttgcaactattttcacttgcaatttaacattattctccaatctttaaaaagtagctgttcaatgaaggggtaaccaaacctgataacaagagctgcatcagatcgtggactgaaaccaggacctccaaatgcaggaccacccctaacaaaagacaattcagacatcagtatttactgggaaacgggagcaattgtatttatctaggtataaaatataaaacatgtgctgaacctagattagcatggaggtatcagcaaagaaaacatagggtgaaagtgtagccaccttgattctccaggtctaggtctcttaggatcagcgaaccgaattattaatggttgctcgcacccctaacacaacataatggatatattataaattttcagaaagtcaataagaactcagctaacagaaacttaccctcattacataattcccactcagagcactcatggctgccagcgccggttctcgtgatgagaatttgacaaagccacaaccttgattttgcatatgttacaacaatggtttgtaagggaaaaaaaataaactgcaaatcaatcaagttaatatgacagacctcggctctgcctcatgccatctttcataatgtagacatcttccacatgaccatacggcgcaaaaatctacaaaataaaccagacacaaatttgatttaatatgtacttgatatatgcttcttaacttaaaatgatgagttcataaataaagcatcaaaaagcaatgcaaaatttcacattggtcttggatagatgagttctaaatctacataaccttcttttgaacaacagacccttacctcttcaatctccttcgcagtagcttgcttattgagtgatgcgacaaacagcttgtgctcaatagcccctaacaaatagatgaaaagtgatgaaaccacccaataagtacaataaagaaaatataagtgaagaaagtaaatttctattaacaagtcaaacatatttcactccactaatatttttgtttagcctaaaaagggaacagtacgattatcaaccatagaagttatggggtggagctatgctatacaattgactcaaatcccagcattgttctaaagtaccaatagcccactgataacaaaaatactattagttaccatggcgttccctttcaccatcagcatatctgacttgaatagggcccattgcctgacagaaaagatacacacagtcaataattcaagagtcttacagacaaaagactgactataaatgagtacacaacaaagagattagttaccccaggtaaagtgtactggttgtgaagagctctgatggctcgctcagcctcttcagaagtagcatatttaacaaaacaacaacctgcaaatatgagcatatcgatttgatcacaagccgttgcaattttctgtatgtttcacaatgatcatgtatatgagagaaacatagcagagttagccaaagcaggatagaaaggtggcgcattattttgaaacaggtcgtgaaattcgactccacattccaatctttgacattgaagatgaacaatactactcccaccatcaagaagcgaaatccattcaacgagacaagcataaaagccttattaaaaagtaataagattaaataatataactatttggtaatatggcatgtcaaaatatttagactacactgtgcaactgccagcaacattcatgcaagaagaatttacggctaatgtatgaaacattaagttctttcgcgatgctccaactgactgcatattccattaaaatttcagtaacagcttgcatcatacaacttatgttaccatcatactagaacaaacataaagtgttttgctcgtaataaaagaaacagggtgtgcctggttcacaacttcacatacagcactatactacatccatcactccagaagatggcatacagacagcagttcacagtaatggatcatgtggtgcacagcaattgcagaaaattgtggtaacagtaggaagaaagctcatgtacccattaaatagacaggataacaaaaaatcttcaaagggttcacaaaagggagaccacatttgcaatctgataatatgagccagacctagattcaacaatgtcgatgcactcagattctgattagcacacgtggcataatgtaccaactacctaatagttccattcaatatcaatacaagccagtcacagcttgaccaagaataagtgctacatgttgaacatcatagtaccatcctctctcaacaataataatgagcataactcctgtactcataactgatgggaggcacacattaaagatggcaaccaagtcgtgcgcaataaacaaaatataatcacaacagcacatctcagggtacgatgccttgcgcagcctcctgactccaatggctggagtgtggtcataacccagatagcatattataaagtataaacgggtctagaatcagagttcaacttcaactgatggtaaaaacaaatgctcatccaatcatttccacaaaaaataaaataccagcaccacagttcaagtgcaagggcttttcccagcactaccatcaattccatgccacataatctgattttgggtattctgaactcaaatctttagtacgccataataacagaaatgcatggatcatgaatctgagtaaaaaaatcggagtgaaagttaccacaaatgaaatacataaaatcacaaaggtgaggactactataaacacatggtgcagtacgcattgcttaatgtatcatcatcaccatcatataaaggtaagttctacaaaagatcgactcaattttttggtgccacagtcccaggctaaagaaccagaatggctgaatcatcaaaagcaaagccataattatctggtactggaagtgataccagcagtgccattcattctcaaatacaggtcaactcaaacagagcaagctgatcacatacaacagcaaaagctgttggagattgcactttaatagatatatttcatacaaatggcaagtaccatcgtgatgaccatcacacccagtaatgacactctgtctgcaaacatacaattcccactaaatgcatacagaataaaaagttgtcatgcccaagcatccataaattgcatagtcagcatatcacaatcaaacaaccagaactcacaggatatcattattatttcagaataaccaggaaggccgcgccactcatggtaataatgtatagctgaactgaacaaatagcattactgtccatccaaccacaactctagattagtactgctcacaacaagcacccatgatttctgaacactaaacaacaaaaagtatagcaccagtttagattagtcaggacaacactacagtgcaccatccaaccagaaacccactcacaaatcaaagggttcatcactcataccaacgggattccatacagagaaattcacgatgctagaataacaaaatctggatccatggaacagaaaatgatgaaatagtttggtctgaattcatcaaaatgttccctgttcttttgcagcacattcaaaagaaatggatgcaaaagttttcaacagattgatgtgactgaacaaagttgctggtactgaatctgctactttgtctagcagcagatcagaatatccagttagattacagtaatcagacaacagttaattgcttccattctcttcctctactgaaccaacaggagagaaacagaatggaagcgcggtaaaatgaagtcaacaactgccaaatctaactgagagaagatgcaacctcgttgctcctagtaactctcaggacctgaaaagaaagagatacagaacttgtaataatattaaggaaaaaagttttgccgtaccttgctgttcaccagtcttcctatccttgatcaaagcaacttcaacaacatctccatgctcctcaaataaaggacgtacctggagaaaggagaaatgtcttttacaaactggatagctcaagaagaaaatagaaggcaacaaaagagtgccaaaaatcaagtagtgaacaacaaattaaatgggtaaccatatgaattacttataatggatatgagatcagataaacccgaaactaagcaataggcaaaaggtagcttcagctagtttctaagtgagctttttctctcaacgtagatagtttcttagatgatttttgaccaacatgaatgcctatatttatattatcttctaagccaacttgtagaacttgtaagcattaagcctacggattgtttcagatacagcgatagctacgataaaacaacctcaaataacagattatagtcaggcagaagaatacaaattgaaagcagaacataaagagttaactaaggacgaaagagcagatacaacatcaagtggtgtaagtgtaacactcacatcatcctcagtcgctgtccttggaactgacccaataaaaagtttaacatagttgtttctgttatcatgatctgcaccgaaaaattagatgtaaatcatattttgcagatgaaagggtgtaaaacataagctctaaataattctccagtgaagcccacttagataaaacagtacatcgagatgctctagagcattgtattcattactactatcacaatccctacattggccctggttggctttgaactggaaaaaagaactaaatagtatataaaacaagaaacgtttagctgaacatgctataactgaatgctgaacctagaataaacagactctcaagtttcagaacgagacgatttcctagcccctcctgcaaccattaggccatgttatgaagtaaaacattctctacaagactaaaaccaatcaaaggtcgtcctccatgcaaaaaaagttaggtggtggctttgccatctagtacatacgtcagagccatataatggaactgtacactcgtgtgcagtgcgaatttcagcaagatatcccacatgcgaatattaattgcttaggttttccaacatccacagtaaaagttgatttactaagataattttcatacataagctaaggtacaaatcgtgaccaaaacacctcgtcacgtgtaagcagatcccaatcctaagatagctcgggaaaacctaaagtatcccaggcgcgataatctgggcacaaacctgagtggtcaccacggccactgccgtagcggtgtctcggcccgctacccggctccccgtactcgccgccgccgccgcttctgtagcctccgccgccggagtggtccgacgggccacggtacgggtggaacctcccgcctccacctccgcctccgccaccgtcgccgccgcccccacccccaccacgggagaagcggtggggtgggctgccgctaccgccgccgccaccgccggacgaccagcgagaagggccgcggccgaatcggccgtccccgccgccgcgagaaccgggcgcggggccggaggaggggtcggtggagcggtcgccgccgcggtgcatgtgggtggagggggaggtgggctagggttttgcgagagcacgagagaggagaggagaaggagaggagaggagactcgggagggagaggcgactcaggcgagacctcgactcgagacacaacacaacacaagagcccgtggggattttttttttattttgatctttggtttctcgtttacttgagttgtgtgcgtggatgagattggatcggatggtctcgattcgatgcgcctattggtcagaagtagtagaactcagaagtcgttgagctcgtccaatttaagctcaaattaaaaaatatattattctcttaaaaaaaagtccaaataccctctaaactacatatagaagtttgtaaggcatcttaaactttaaaactagatatctaactccctaaactttacaaaacagttcatattatctcttaaggggattttgtataatggtttttatctaatttgtactctctccgtttcaggttataagacgttttgatttttgtcaaagtctaattgttttaagtttgaccaagtttgtagaaaaaagtagtaacattttcaacccaagataaatttattatgaaaatatattcaattattgatttaatgaaactaatttagtattataaatattactatatttgtctatgatcttagtcaaacttgaaacagtttgactttgaccgaagtcaaaacgtcttataacttgaaacggagagagtatataacttggatgagtttgatcacgtgacatatacattggacatatatattaaaatctccatttaaatctttctttttaatcacttgttagctctcacttgtttgcaaacaagtaccaacataataatagtatagtataactatataagtacaaattgatgatatgcaaatatgttatattagttattcaaaattgtttgtttaagcttccaaaatatgcaaaaccaccttagggggtaatatgaacggttttacaaagaccaagggattagatgtccagttttaaagttcggggtgctagatagactttcatctaaagtatagggggtgtttggacttttttttagttaacaagacttaagtacccgtacatacacgtatctctataaatacacatatactctctttgttcacacatctatactttttatatagttggtacacactaactcctaaagctcaacatgtaactgtgtcacatcatcatccactatggcatatcatcatcatactctagagtattttaaatctcatgcaagatgatgaggacacaactagctcggatataaccatgactatcttatgtattaatcaaccaaaggtacatgtgttctacattagatttacttattatatatttgaacaaacgttgctacacaataagttttgtatgttttcgtttgtagagatacttgcttgggcgaaagaaaagataccgagcataacgaatgcatggatgatcaaagaagttcattagggaccaaatcaagaccttctcctagtccacttccatctcaccatgtcacttttggtccatagaagataagagataaagttctacatgttttggattcagattcgggccttctgacagcatcaacttcaaacggacctagccgctgatctagaaggaatttcggggcccatgagtacttgttggaaagcttatggactctaatggttttggtcccacgtcaaaattcctaccgagatgccgggaatctctaaaacaagccacgtatcttatccagtccgaatctgatttgggttttgggccttgtaattgtgtcgtgggcttagcccaagggggtgtgcgccctagggcaaccctaggacgtccctaatcatacttaatcagtaaccgtcatcatttagagtcgggttttgcttagattaatctgtcaagaacagtttcgccgttagatcggtttgtaaattcgtgtgcttaatcattcatatgcaaattggttgcaatctatcttgttcttgcttgtgttcttcgattcgcatgtagggattagccttcttggtgaggtcaaccggatttcggcacggttgataaccagaggagacgtggtgctgcgattgcggggctcaatagcgtgttcattcagaagccggatcgagttgtgtcgcgactccgcccaattcgactgtttatcaatacctattgaaaaatcgagacctaacatccctcatcacaagcatgacatattatttacaatattgttgtatttttagaattcaacatgcaagtaatgttaaaatcatcgtttccacgttattttcacattatttacacatatacatctatcattataattttataatgtataccatgtatccatccacataccaattaactagtatttctcaattattaaatgcttatttaccatactataattttttaatgtaaaataaaggtcttattagttatatctgcttatttaccccctaaactattgcgacgatacaaaatactcccatgaactataaaaccggacaattttcatcctcaacttttcatattggacgaattacccccctgactcgctctagagcgattttgatcctacatggtagtctagtcaacatgaaaaaaaattaaaagtgacagggcccaccatgtcatacatgggcaatagagcattggggaagatatgacatgcgggtcccaccgttttttagtttttttatgctgattgaattgccacgtgtgtaccacgtaggaacaaatcgctctagagcgagtcggggggtaatttttcatatataaaaagttgagagtgaagaatgtctggttttatagttcatgaggataattcgtaccgtcagaataatttatggggtaattcagacttttttattgtgttttagcggcacaaggatttaattagcatttaatgatcctatttgtaagcatagtaatcggtctaaaattggagtaaatcatatactcataatatcttttgaggttgggctttatgcttggatgatattggcacactaaagttatgatttagcatagtgtggcttgaaatgcatttgcagtgacaataggtgtgtgttttcaactacaagatcccatgttcaatgtccaacgtactcacaatttttcttatttttttaaaaaaatgtttgaagggatgtccctccctcaagatcccatgtttgaagaaaaaaaaaatctttttttctatgtgtggcccaataaaaatgagcttggctagatagataatttctaacgtaagagtgcatctcataagtcataattcaatcacctactcaaaaaatttaaacagaaaaaaacaacaaccattacagtgttgcctttgcaacatgtggtaatttaaagagagtataacatctgcggagacaaccccattgaacaagggttatttaatattttgttgagtaagaaagaagatgacgctattagatgctcctagtgtgatttctgtgatgagatgatttgaactgtgttatgtttctacatagcgaattggtgtaccgactactacctccatcgtgttaaaaaaaaaaagactaccacctccatcctagttgaagtgcagttgtgagttttcgtgtccaacgtttgaccgttcgtcttatttgaaaaatttatgaaaaaatttaaaaaaagtcacagataaagcattattcatatattatcatctaataataataaaaattaatcataattttttttaaataagatggatagtcaaacgttgaataaacgatacaaaactatattctttcttggacggaggtaagtactactccaatttttatgaagatatgtatacacctccaagaccttgttcggttcgaaaaggattcccttcctcatggggattgagcaatcatgacctaagttagcttatttagaccgtaagcagcagaagaatatatcttatgcatataaatttttcgtacacatcaactagcaaatgtaaaaaagtttctagaaaaaatttgacacataatacatcctgggctggttagtgttgtgataaaactagcgtcattttttccacgcttgtgtgtgtgcttggtcgggtattcatttaacactatatataatagtgatccaaatagtgcccgaccggataaccgtttgatcaagcacactgcccgtttttcttgagtactactagctctcttcactagtctacgtgtcatctatttagaggattttttttaaaaaaaacaaaatgggtacggttttggctgttattagctgatgattaggaggatgagtgcattcccccctaagatacacctacacggagtggagaaacacactgctatgatgataacgtttgatttcttacaatgagtcaaggggcaagactcccgtaagagtgcttcacaaccagcactgtccaggattatcagtgtgcccaatcaacctggtgaaatgtgcttagcgagcaacatatattcattcatctgaaacataactctacatagaaacaggctaaacaaaacagactgaaaataaacagatgcagataagaaataatcaaaggtaatgagaaacagatgcagataagaaataatcaaaggtaatgagatgcatcagcaacggcaaaagatccacagcatactcatcttggtcatcgggttcaaaagattttgcacgttgctttcccgcacaataagcacatatatcgtaaactatttcatccctcttctgtccaaagagcggcaaaactaaaacgatattaactccgacacattacacccctgaatcagggaaagcttttaaagtggggaaagggggggagatctacagtttttcttcttcttatgtatggtacacacaagaacattacgatcttcgatcatccacctgggggtcagggtccaaaagatgaaatggcaattatcaactacagaaatcatcaaaagggcgaccggtcctatcttaactgctgactgctacactatgcctcctaaatctcacagttctacatcgtctcaacttggcgattgcttcttgtgccttcccttgaagaaggtccacataaactgatgctagcactgccctggggttgttgggcaacaaggcaacgccacggcttaccatatagttagcctgctcaagctctccctgcactgcagctgtcatgcctaggtcaatataaagaacaccctgagcttcctcaggcttgaggctttctgaatactgagattctcctgaggacaattttgtgactaccggagcaactgaatcttcaccatcgctgtctttctcaacaagggctttctcgcagttctcaatgctgtaaggcaactcaatatcatcgccatctctcaaataaacagttaattgctcagcagcctcctttggtctattcagtgcacaaagtgcttcagctgcgtatacatggctgaggaaaacatacatcctggaacattctggcagctgctgtagcaacttggcaatagacaaagctttcaagtgattctgaagacacaactcaataaatgcaaggtcccccaagatggcttgtttaattttgaggttctcttttctacatatgtcatcatacaaagcaagagagctctgcaaggtgacattcaagtttgaaattcccttctgttctccatttgcattagttagtgctggaccaggcggtttggaatctgtattagtggtgttcttctgacctgagcctttctggccttgcagtgatgtttgattcgattcctctgtgcctgatgcaatcaccagattttccttcgtagagggatccaataaaatttgggcattgagtagacactgtctagcaaatctaagggatatcagatttccatatttgtccaaacttacctcctccccagattctgaagaatgacttggcttcactgggtttataactaagtgccgccattttcctgaccccataacatcaacttcaatctcatcattgcacgaagtagcaccacttgaagtcaggatacccttttccagagctagcaggctacactcagcaaaacggagccaaaagagggacctgttgcacaagagcggcatggcttcacgaaaacagcgagctgctaacaaaggtttcccgcacatcaaatgttggatgccgcagttgtatgaaataagacaagatttgtcttgcgatattgcggtcagcttgcatggtttctctgaacgaagtgataagctatatttcaatgctttgctgaagcaccatactgaggtttgaatagatnnnnnnnnnnnnnnnnnnnnnnnnnnnnnnnnnnnnnnnnnnnnnnnnnnnnnnnn

SEQ ID NO: 35794 - DNA, 5077 bp, Oryza sativa
  unsure (1)..(5077): unsure at all n locations
ttgcgatattgcggtcagcttgcatggtttctctgaacgaagtgataagctatatttcaatgctttgctgaagcaccatactgaggtttgaatagatctctgttggtggagtatgcaaccaagattattgtagaacatggccagcattgcttgttcactccgattattgggtgtgctcagcagcttcacagccttgcgatagtttcctctggcatattccaactgagatttcaggagaagctctgttgatgaatccctaccacgtgccatgttcatcagaactttcagttctcgctttgcaaccttaaggttcctagtaagaagcagaagccggaccttgtatatttgcagtctaactttcaaatcagcagcagtggcagcaagatcagctgaagcccttgagaaatcatttaaaattggtctgccccagttctgattaccaccatccaaggtagagtaaaaagattcaaactcaagtgtatcatcagaaaaatttcctgctgaaaggttttcagatccaccagcacaagtatttgaatcagaatctggaggtgtgctaatctttgcagaaggctttggttgagctgactgctgctgagctgtattagcattttcattctggtttgttgcgctaactactccaaatgacctttccaagtactgaattatatcctgtacaaacatatgtgatgcatgcagttgaataagatgctttatacaagagctaatgctgcaactttgaataaaaaggacaaacaaaaatggtacggttcgccatacaagttaagatcacaactatatctgacaatcttaggcacttgagttcagtaattctcacgtggaaaggcataatcatcatttggaatggataaaagtgaataatggaagccctaaaatcgttcagaacaggtaaatgtgaattttttgcattgaatcacttcttttttgttacaatgagtgttcacgcatggtacttctaaaattaacatatgaaaacatgagaatttggtcatcttggattgttgtgttaatactgcaatttaggacaaaacagaaaacaatatatggtagttctattttgtaatattaaataaatatagggaaaaattgcacgaaatgcattccagtcaaaatttgacaaaaaagggaactagttatggaagggtattttgacaccatggagcatatttttgggaaaaaatgtagataacaatgaatgtaaaacatcataagtggtaaatattggcatatgcaccaatgccaaggaggaagacattttttttaatttttatgcatcaaacagacgagacacagcatgtattgcattttcaggagaatctattgacaaaatacccataagcccacaaagctaatgtagtatttgtagcatcaactcacgatatactgagatgttaaaacttaccgcggcattcgatgcatcttgcaaagctaatgtaatatccaacaacagaaagcatacatgaagagcagttgtctgcagtattgaagaaatattagaaaatgtaacaacctggtttccaagttaagcatcttataactaataatacctcatcaattggttcaatatttcggtagagtggatccaaaatagatagtgcagattcataatcgtgaagatggtaaaggataacagcctgcaaattcaaaaatgccataaacaaatcaatcacctcttcagttaaagctcacaccaattacaatgcttaccatggttgattggctaaagcagtactacaattaatgcaagccatagaccagaaacatcaaacaatcaaataattacttttgcaaaagaaaagaacatacagtgttgaatgttattatggttgtgtcaaactcatccccataggttgtcgcattatttgcagcagaaatcagaggtataatgccactccctcttgatccagaagaaacactgtttcctgtcccattggcagaatcagtttgttgtctagatgcacaggcaagctcttcacttcttctctggatgcatgtaaggtggaacattagaattttcgtaaataattattaaatcaggagaataaaacaatgacataataagagaaaatgagaaatcaaaacaggcaccataaattaaggcttaaaaccacacaaaagtagatggctccaatgctataagtagatgtaagtggttaggggacgaccataacacgttacagtgatatgtgtgcagttgtgtaaatgactgaataactggcatgctgcataatattagatatttatatgcgcaacttgaatgacgaataaaaatggagtctgagaacctaatgtgagttccaaacatatagtgatgatatcacatctgaaaaaaatatagttataagttcatccactacaaaaaagaatatatggttttctttggtcagcattaacagcatttacataaaagttagaaacctttgacaaaaccagcatttgtaatattgtttcttacttcccatcaatgaagaatcgtaaattgtggaatacaaagactaccgttaggtccagatatattcaaaaaagaagaaatgatggctcatgactaaatataagttttgagcccctcactgatagatgtcgatcaaaatgcacgcaagtcaagatattatgactactctcaacatgtagcatgttatatgccttctgttttgtgcattaatgcatcacataactcctgactaatgagggatgcttttaccatatacaacatatacacatacaacaaacacaaataaaatgtagatgttaaagtttactatacacaaaacaaaataaattttcgtgcatgtagcatgtgacaaatatcttcatcaacccagaagaaggaaaagaacaaatttgaaattggaactgaaacatagatgagttgtgcaaaatgataagacccacggcgaatggatgaaggaaaacagggcagaacaagaagactgtccttttgagaactaagtatagttagtaacatataattgacactaactaaatgattggactaaagtgacaaacatcaaaattatatcatttcttgtataaccaaatttacaattggaatgaatttatataagaaaaaaaaagtaaacatagttttaggtttgaattattgttgccaagaaaattttaggtacatttggaaaacagaaatttctacccaaaaaaaatcagaaactcctgtacaaacagtaacttagctgtagagttctctactgacaaaagaatggatatttctagtacatagcctcaatggaaatatgaacatcaaaagtcaaacaaactaatgcaaattcactaaccttaacattgcctagaatttcaagcaatttctttgggtcaggacaaccatccaagaaagattctgcaatagccatattgtgaaggacctgaaagattataaaaatgcaatatcagatgccaaaataatacatgatcagagtatcatctctttatcaagatatagtggaaaagctaccagttcaagataaccaccgtagaaaagcatctaagagcataatatgcagtatacacagatatcgggtaattgttttttttcctatttgtatgcatattgttctttcagacttataaccttattaaacagatcatgccctatacatgaaatggacaagataagtaattagaatcatgcacgaggagaagcacatactgggtgacacataccagtgtggacatccatgtctacgcatgcatcaaacacaacatgaaactgatgaaatacaaattaacaagcatgcaaacacaaacccaataattcaagatgcacccacctgcatatcacacacagaccataacgcacatacaggtgaaatatgcagacatctacgcaaacacggaggcaagatgcacccaactgcctagattaacatacgcaaactcgcaactcaccccacgagctcaacccataatgctgcggaagcagctccactaacgaacacctagcaagcaagatataacctagagaagcagatggattcggtaaaagattttgtcgtttagcgaggaaggacctaacccaactaatcaccccgaagcagagatggcgaatcggctaccttggggtcgccctccttcttgagcaggagctgcgcgagcacctcggcgcagtcggcgtagcggcggctctggaacagcacggcggcgtctctggccatagcggccgtgacggagagcatcccttcctcctcggtggaggacggagactggggcggcggcggcgggggcgcctccttgggctccattgtgcgggtggatctagcaggatgggggctaatcgggggcgcagggcgccagggtagggccggaatcgcgcggcgaggcggtgaatcggagctccggagggcaggatttggggggccgggagggagagctagggtttggaaccgacggcgcggcgagagcgagactcgacgggggatgtggagcgagttgccaactgaggaaggccgatggatagacgtcggaggtcgcctcctcttttcctttttcttttttttttaattttgatgattgtttttctacccgacttatgcagtagtactaggcatcttaaccaccgtcggatctactcaaaatgttaaaccctaatataaaaaataaactaataagactccagcaaattggaaaaattctatgcgggggattgaaagtttacacgagagaattgatggtgagattaagatggaaatttaatttttaatcccagtatcttgtttggtagatgtggtgaaaattgatacggagtttagttggagattaggtcattaatcaaaacggatggctgagatttgtttaggtaaagtaaagaaggaattccctcccaattaccacccctacccaggtcaattccccatccccatcccaccaaaattcccatgtatcacaaccaaacaaagcagttaatagcctcatccctttaaactcccaatccctcctaaaaactccctccaaccaaacgagccgatagttataatccggttgcaaaataaatactacataataaatannnnnnnnnnnnnnnnnnnnnnnnnnnnnnnnnnnnnnn

SEQ ID NO: 35795 - DNA, 6079 bp, Oryza sativa
  unsure (1)..(6079): unsure at all n locations
tgtttaggtaaccccaagaaggaattccctcccaattaccacccctacccaggtcaattccccatccccatcccaccaaaattcccatgtatcacaaccaaacaaagcagttaatagcctcatccctttaaactcccaatccctcctaaaaactccctccaaccaaacgagccgatagttataatccggttgcaaaataaatactacataataaatatatggttataatattattacaacacaataaatactagaaatattttagagtaaattgcattgccgataaaaaaacttgtcaggtaggtgcaatctactgcacgaacttgcaaagtgctcgctttcgtgaatgaacttgtctggtgcatgcgaaggaaggcgaaaaggacacaacatggctaatcttattgatttaggggctggttaggaaattatgtaaacatatactatatgagaaggttattattagacatacacatcttcaataaaaaatagaataggatatagtgatagttgaaaaagataaaggaaaagagcaatgatataatggttagaaatatatgaaattcattatttccatgacaaaggataaagtagagaccaaatttataaatattacatgtcttatgcatgcatactcactacacgtaagcacgtcacatcctaatcaacgtcatcttcgtaaaattaacatggtcaagttattttggtcctcttcgcacggactagacatgttcatgtactgaaacaagcattttacaagtttatatactaaattgcacctacctaacaagtttgtgtaccaccaatgcaatttacttcatatattttattatgactcctgagttcataagagattttttagatgctggaataaaaccccggcaactgctcaacgagctacaaccaattattacaaaattcactcaacgatgagcacacactaacaagtccataataaacatacaaatcggcgctcatatgtgagtgtgatgacaagcaaccttgtgtgcaacggatgctacatctcgcctcgtgaatgtaggggtgaatgaaaagctcgtgactcgttagctctcttaactcatggttgactcggctcagctcgttgcggttttataacgagctgagttgacattttagcttgttggaaataacgatcccgtgcgagctaactcgcgagctaagaatagcccaatcctgccacttcatacgagcccaacaagagtaaaaatggcccaacaaactgaccactcctcaaaataaaggccctaactcttagtctccctcccccctaattccttgctccagtaactaggcaccagttgcataggttctcggagcagcatcgccacccactggcatttcgcgccccaagcccctagagccgccacaccgccgccccagcccttgagccctcgtcgtcaactttgcccattgctagtagcctccactgggaagtgaggtcatggtggcccacctcgtcaatgcccgcggtagtcgcagctccacctctgcctcatcatcatggagaagaccaatgagtaggagcaagcaagtccaccactggtgccaccaagttcaaaatcaaggagcaaatgttagagcttgttgtcctcatcaccatcggcagtgcaacactgcaagccgatctgccatgttaattttggttggtgatttgtttgcttcgtcttttggttggttgcaatttcaccaggcttctagatctggtaaagctcgggtattccaaattggtaaagctcgagtattccaaattgatgtgtacagaaatttcgttctaggtctgtgatttttattcaattgcacaaaatgtttctggcctagttgctgtaatctttgagactttgatgtgtttctttgaaggaaagactagtcaaacgtgtattggccgtgaggcaaacgagctacctcgagcttccaagtgagccgagccggggttatagctcgttagggtaaaaagccgagccgagccaacttgatatccacccctatgtgattgtgcaggcgttgcggtgtagcatgaacatgggtgatcttgtatgtgaatgcgtcgtgtgagcacaagatcacccccacacttgttcttgtacctagggtgcttcaaagacacaaagacaaaacaaaagtgaaagcaaaaggactcacccggtgatgcccggtgggtcaattattttattaattttattgatgggtgcaattacacaaggaattgaaaaaaaaataaagaaaataactgaaataaaacctaacgcgcctatcggactccaaaggatactatggaaggtctaagggctagaagcacaggacatatcttcctttcccacaaccttatacaggcgaaagagcttggcacaaaggacacaactaaaggatgcaaggcttgtcctgagctcctcaagctctacctgtccctctgccacagtgtccatatgaattatgtaaaagaccaaagctatataaagaagaatatttcattaatactataagtcttatataagaaggaagagctactagagctatacccgaaatctcctgaagacccgaggactaagaaaactccactagcactagaacaataaactaaacttgagatagttctttatctttttcttgagtgtgtgttggagagtgaatgagcacccctttatataacctctcaatgacggttatggcagttggaaatgccggaaatgccctccaaccgtcattgagagttgtaacaccttgaaaatttcggtttagaaatacgaaattaaaaattcggaataaccaaaaaatcttttcaaacttccttgcatactggaatttattggattttatttcccgttttcctgctatatatgggctaaaagatgaacgtatgagaatatgcttgtattttgatttcaaatattatttattcaaagaaccatgattatgaaatatgtcaatatttgcaaataccaatcattttcctaaaatcccttctccatatattagaaccccttcgacatatttgttctataaataaagttatatattacaattttgaaaggaaaccctctatggggcagtccattaaaacaaatactactttacaaaggaaatattgttttgattattaactaagaatccttgtaaaggattaagtcttttggcaactatattgcaaataatagctactaataaagtatttactgaaagccctatttgtgaaatataattcttaaaatggcaattttaaaagaaaaggctttcttagataaagtctggtttatctctttgagaagcctagcctagcccgcataatggattttgtaattaattgtgtgtttagtttttgtgccaaaaatctcgattaaatcttatctcctaaaagtatgccccctgttcgacatcctcccctgtcccctctctgccccgtctgtttggtcaagcgctttggtgctaaacaaatcacagtcccgaagctctctgctcctatcgcaattttatcgctctctcaaaactcttatcctacggttaaattgaaatcgctctattgtttcgaactcgataattccctcgaaaaatctacgatcgttcgacggatttatttatcgtgcatcgattcaaatatcttcaattttatccctaccattgaaccctaccatgttgattggaattatatgccatgagtcacccctattacccctatttgatatcgagattcattcattcgagcgatcgcaaagaaatcctaattctaatccccgcacgacctttttgccaaatcaaactccaatgtctcatttagcggcctaattaccattatacagtcctatgtacagtcttggtgcatgttcgagttcaagtgccaattccaatttccaaattcgagactcccttgtaatttacaaaatccccgaggagatacaaaacaagtccagcagtactagttcaaataaatcaatgtccaaattatacagtaccttgcacagtccaaattataaatacagtccaatttacaagtttcacatacacatcccaagttcctattacaatcgggccatctcttttccctgccaggccaacccatccctcacagcaagtccattgttaccccctcggcatagcagtagcagcccactccctctctccttctcagcctaaagtctactttgctttcctcagccaacacagcatgcatgcacagaagatgtttgatgaaatgcctgcaagccatcacacacatttgactaccatcaaatagctgggaaccctccccaacaacaccccatgcaccatgcaccatgcacccaattcacagaactctccaccaaaaaccaacaaacacagtaaagagagttcacaccgaaaagaactgagctcaccaaaaggaattgcataccctgcctcctgcattccaacagccacaaacatatataaaagccgctgccaaaaaccatcacctctgctttgccactgccactgccactgcctctgcctgctcctccctgcgcacatgccgccgcttgctccgccgcgtctggccacgagtcgagcctcggttgggcaaggggttgaggttggccgccgcgccgtcccgtgagcttcctttcgcacgcaagtgcacgaactatgagaacaatcgaacctttgaacgcttgaactcttgaacgtatccaaaacttgcaaacgaacttgaaccatggacgtaaccaactaaaattcaaactaaaaactgaaaaacaaacctctgtgaaccttggtggagcacttggcgcgcgaggacgaaccgcgagccgagcctcgacgcccgtcgaccgcgcacggtgtaccgctactcggctgccgcgaggtgagcatcttctccttcccttgctcttctcccttgtaacatctgaaaatttcggttttaaaatacgaaattaaaaattcgaaataactaaaaatcttttctaacctacttgcatgctagaatttatttgattttattttccgttttcctgctatgcataacgtatgagaatatgcgtgtattttgatttcaaatattatttatttaaagaaccatgattatgaaatatgttaatatttgcaaataccaattattttcctaaaaacccttctctatatattagaacccctctgacatatttgttctataaataaagatatatattacagttttgaatagaaaccctctatgggatagtttgttaaaacgaatactattttgcaaaggaaatataattttgattattttctaagaatccttaaaaaggaataagtccttcggaaaataacttgcaaatgatatctaagtagtaaagtatttatcaaaatcttacttgcaaagtgaaaaataattcctaaaaggctattttaaaagaaatgactttcacagataaagtccggttttattcccccttaaaaggcctagcgttgatatttcttacaggggcggacctacccattgggcagggttgggcgaccggcccagctacggcccacgttgccccactcccctggatgccatatccatcagtccatcaaggaatagcccacaagtcagcccatcaagcaaacaagccaatgttagcccgttaggcatctgttaacgaccaaatttggtaagatatgaaccaggttcggcattggaatcgaagtggattcggcaaagacatagatttgaagaatagagtatgcatcggctgcgaaggcatcggctggattctgaatcggctgagatggcttcgaggctgcttctagaatcgatggacgtgcttcatgaggattgccacgatggagataaagctctcagataggtaattgtatctattaattaggatatcttatttaatttccttagagatatgtttgggtaaaagtctgccgcaaagacttatggtatcttagagtttgttagagataagagtcgtgtccggcaaggacatattttgtatctcgggtataaatatgacctgaacccatgtaatcaattaacacatgttcaataacactttcggcgcannnnnnnnnnnnnnnnnnnnnnnnnnnnnnnnnnnnnnnnnnnnnnnnnnnnnnnnnnnnnnnnnnn

SEQ ID NO: 35796 - DNA, 732 bp, Oryza sativa
  unsure (1)..(732): unsure at all n locations
tggtgcattatgaactcggttttaaattcttgagcaaagtaatttttatcggagtaattcaataaacagagagcacaagcaatttcctagctgacccctttattgtcgtctgttcatgacaattagcaggaattaatgccatggatgaaataaacagaggatggcaaatacaccgtgatgccattaacagggaaatgcaacaagaatgccatatagcaacataaaaccgattaaaaccatcttgttgttattccttccatccttaccggattctcaccggttcataaattggtggaggcgtgatgagtataattttagtggagggccattgctcctgcgaaagatcgaaaccaaaacagagttaaagcaaccataaagcagcagcatcaattagttcaagttggggaaaaccaatcgatttcaatccaagcagaaccttgaagtaggcgcagatggcgcggaggttgctctggtactcgtcgagcggcacgtgctggtgcacctgcatctgggcgctgtggagcgatgtgcgaaggaaggcgtgcgacgatcgcgtacgtgatttttctgccagtgatcccgcgtgcgtgttctgtcgttggatgcgatgcgatggatgattttcagtcgttagatttgaggaatgaagtatgaaagacgtaggannnnnnnnnnnnnnnnnnnnnnnnnnnnnnnnnnnnnnnnnnnnnnnnnnnnnnnnnnnnnnnnnnn

SEQ ID NO: 35797 - DNA, 593 bp, Oryza sativa
  unsure (1)..(593): unsure at all n locations
nnnnnnnnnnnnnnnnnnnnnnnnnnnnnnnnnnnnnnnnnnnnnnnnnnnnnnnnnnnnnnnnnnntgagatctatacaagatgatgaaaacctctaagagatggtagatacacgatataatgtagattaataacgagatctaactctatcggcaacttcctaacaaaagaaacagccgatgacaagttatatagcgtaactaacagagattataaagtatatatgataactcaacgaattacatagacaagattagagtgtcataaagatggaagcactattcccgagaacgcaaaccgccatgacaagtttacctctagttgaagatcgaatcgatgcagctcaacccgaaagcaagaactcgtcgaaataaaataaaagggtggcgatgcgccgaaagtgttattgaacatgtgttaattgattacatgggttcaggtcatatttatacccgagatacaaaatatgtccttgccggacacgactcttatctctaacaaactctaagataccataagtctttgcggcagacttttacccaaacatatctctaaggaaattaaataagatatcctaattaatagatacaat

SEQ ID NO: 35798 - DNA, 986 bp, Oryza sativa
  unsure (1)..(986): unsure at all n locations
nnnnnnnnnnnnnnnnnnnnnnnnnnnnnnnnnnnnnnnnnnnnnnnnnnnnnnnaacaggcccttaatatctacagccgatcgagtagatttagtcccttcttacttattaatgactgccgattgatgcatatatgacatcggctcaaagataaatgatatgtcatcagcatctagccgatcggctatcgtttatggatttaaccgcggtttctttgtctttgattcttgatgattgcaggatcaaatcaactggcacgctagcatacccaaaggcgagttttggacctgcactgcagttaagtagatctctcaggcctcgtgttttcacatcaacagttgccccatatggaggtcactatggagcattcaggcacacgcaaagatctggcagagtggattcttttggccatcaatgtatgatgacacaaaggaatttgttcggatatgtacaagttgccagaagcatggagggatccctgctcgcgatgcaatgccactgacaaacaatcttcaagtcgagctatttgatgtatggggaatcgacttcatgggacctttcccaaagtcctatgcctgcgagtatagcctagtggccgttgactatgtgtccaagtgggtagaggcaatgccatgcagggccgtaaacgccaagcacgcccgccggatgttccatgagattatcttccctcgttttggaactccgcggatggcgataaatgacggagggtctcatttcatcgataagaccttccgaaaatttttgcaagaacttggggcttaaaacaacattgccactccatatcattcccagacaagcggattggcttaaacgaccaacaaacaaatcaagaacattctacaaaagactgttaatgagatggggaaagcatggaagaacaagctacctgatgcactttgagcatataggactggttattaaacgcccatatggctgttaccattccaacttgtttacaggaaaa

SEQ ID NO: 35799 - DNA, 10584 bp, Oryza sativa
  unsure (1)..(10584): unsure at all n locations
nnnnnnnnnnnnnnnnnnnnnnnnnnnnnnnnnnnnnnncatggagggatccctgctcgcgatgcaatgccactgacaaacaatcttcaagtcgagctatttgatgtatggggaatcgacttcatgggacctttcccaaagtcctatgcctgcgagtatagcctagtggccgttgactatgtgtccaagtgggtagaggcaatgccatgcagggccgtagacgccaagcacgcccgccggatgttccatgagattatcttccctcgttttggaactccgcggatggcgataagtgacggagggtctcatttcatcgataagaccttccgaaaatttttgcaagaacttggggctcagcacaacattgccactccatatcatccccagacaagtggataggcagaaacgaccaacaaacaaatcaagaacattctacagaagactgtcaatgagatggggaaggcatggaagaacaagctacctgatgcactttgagcatataggactgcttataagacgcccataggcatgtcaccataccaacttgtctacaggaaaacatgccaccttccggtagagttggaacacagggcgcactgagctatccggacttgggaacatggatctaaagagagccggacaacacaggaagatgcagctctctgagctggaggaatggagggacaaggcctaccacaatgccaagatatataagaacagaaccaaaagatggcatgataaacaaatcaagcacaaggagttcaaagcaggggacaaggtgatgctgttcaactcacgggtgaagcttttcgaaatggaaaacttcaaagtaaatggagggtccatataccgtcgtcgacgcttcatcacatggagccgtcacgctgcgcgacaatgaaggtaacatctttaaggtaaatggccatcgtttaaaagttttccttgatccattagaagttgatcgtgacatagacgtggtaaatctagttgcttttagcttctacccggagtcctcaggtcctccttgatccgttaatttttaatgccatgagtccttaggcctccctctagttatcttaggtctagctatcatgatgaaaacaaaaacaaaaataaaatataatataataaagttggctccttgatcttccaaccaagtgagtcctttttgcttcactcttgtctttgtttttcttttttgtccaataaagagtcccatgtacaaagacaagtgtgggggtgatcttgcacatcaacaccataaatagagcaagatcaccctagaagtgatgagccatgacaaacaacacaagggagattgatgcagtcatacccaatgaatcgtcctctgttttatacagagtgcaggtttgcacaatttttcctttcgacatccattctatcttgagtttaattagattatcaattttaaaatatcgaagataattaaactcaagctagggatggtacaattatagtttatggtctccctgaaaataacatacatgcctattattctttgctcattacttgttgcttgtggtgacatatccaatagggaccccatgctatctaggtaattgatgaatgagatatagtatgatgatagaaatcttgctcttcatgttgcacacttggaaattttataaaaagaaaaaatataacgatgctaaactcctcattgatattttcattcccactagagccataggttgatcagtcatgattagcttgctacatacgctacttgttattacattgagctttgtcgaatattgtgagcctagtgaaatgcttttcatacttttatggtcaagatcacatatattccacatacatgcgcacatgcttgacttctacactggaagttagcattcctcatttgtcattcatttcatccatagtccacaaaataaatactccatgtcatttatgcctcttcctccaaagttctttcaaagaaaagagagagagagagagagaggcatttctatgcaaaaagaaagaaaaaaagtgctcatacaagtatggagcatgatgatgataaaaaaaaaaagaaaaaaaaagaaatagccatgcactctcccaaatttcaaaagagaataaatggacgacgaggtatacaaaaggagttattattattttcctttttctatccacaaatttaccatacacatacacatgcacttcttgaccagaaagtatgtcttgtatttctgtggatcaattatttgactttgcaatatatgtgatgcaagtaatgctctactcttttccatgccctgagcttcacatagccttattagatggtaggaaaagaaaaggcacaatcatatgcctttgtgaggaatcatacactttgagtgattaagagaatcaatggaggagcaaagcaaagttataattttgtgttacaaaaaaaaactccaagttgttcttcatgaaatgttagggtgacttgagtcaagattgttccatttctcaattgctcaagatcgcatggtagacactacaaagatccataagtacaggtatggctttgaataatttgtttgcatgattattagtaaggaagtcataaccctattgtatagtctatagccttcattcgggacgagcaaagattaagtgtgggggtgctgttgatggtccttaaatcataatatttgaccgtcaatacttgcatataatgaaataaaatatgttatccaacttagtggtaaggtttactactaattatttccactagtgttggtgagatatgtgtatgcaggtattttgagaagaaaatacatccgtgaagcgacaaactgcatctccgcgcattcaggacacatttacacagattggaggccccataagtcaattaaacaactccaaatgggcccaaccatgatgccaatgggctgagagcctcaaaattagtgtccacgaggaaaaacgggtccaacagagccctccgggtttggccgaaccaccagttcggccgaaccacttctgaggccgttgatcacgagattcgacgtggacggccctgattacttcttgatggcggttccggggtagtttggtcatttcacataggctgtaacagtcatacctacctataaaaggaggagctcactctactttccatcacacaactttgagctgagttacaagaggctctattgtatcttttgtacattacaataaggtagagagtgaggggatgctctggaggagtgcccggaagtttggcgctcatccgacttctacctcgacgagtgtagctctctaggaggaattctggaggagtactggacctctagtactaggactctttagtatttatactaagtgctctagtactaggactccggatagggaaggaagttcctgcgcaagtattagagtagtaattaataacttatgcgtggtgtctaggttaaagattacctttgtttgttgtgtatcccacggttttgtcagaggtagacgacaagtggtgatagccctgaatcccgtcctattaattctccacgttcggatacatcatagagctatagtcggaaccacgctggtagaccagcaggggtcggtgcccgaagcaacagataggaaaatacctttgcttagcttagataattaaaacacatagaaagtcctctctagcctgcctacctatagttgttgtccttggatcatcttagccttaggtagattacacatgttccctgagttcgatattcttttggggtcacccgaaggtgaagtgctacagcagtattccgtgcgcttgccgatttacctgtggtcgtaagaaataccaataggcaccggccctcccttggtctgccaggctatgtccagtcttgagctctatgatatacccgaacatggagggatacataaaggacagacatgactattaccacctaccggccatctcaatttttgggtagcaaacaacaaagaaaggtaatttctaacctagacaccacacttaagttattaattactccctccattccaaattgatctacatatagttttttttgaggttattcctaaatgatctacatatttgtgttcatttattaagtctattcgttatttgtgtattggagtaaatggacattgatgcatgcatccatgcacacaagtatttataacccacatgcaatatattgatttgctattggctaggaaatagtggggatggtgcatgcatagagtttgttgctagagtaaatatagtatgagagagttattagcttttcttggtcttggtgtactatgaaatatgtagatcaatttggaatggagggagtactactctagccttgtgcagaaacttcattctttatccagagtcctagtactagagcactcagttgcacactaagtgatgaacccgcacagatgagaatatacctcacttaaaataaactaattaaagaacataaggaaagtcgaatacttactttataaaaggaagcatccgccaaggtacaagcgagagaagaaggccgacaatcctgactttttctggtactccattggaagaatcccgacagtccaacactccttcgtataattcttggaggaactccaattttttggggcacaccttctggagcttcccttcactccctactcaagccaacatactaaagtaaagtctaaaatctaaaggtgagttgtactctactttgttctgcattttccaagtgtgaaggcctcctccttttatagcttgcaacgacagttagaatggcagttcttgatgagggatgttaggtcccgatcttctgataggtattgataaacagtcgatttgggcggagtcgcgacacaactcgatccggcttctgaacgaacacgctactaagccccgcaatcgcagcaccacgtctcctctggttatcaaccgtaccgaaacccggttgacctcgccgagaaggctaatccctgcatgcgaatcgaagaacacaagtaagaacaagatagattgcaaccaaattgcatatgaatgattaagcacacgaatttggggttccacaaaccgatctagcggcgaaactgttcttgacagaataatctaagcaaaacccaactctaaacgatgacggctactgaataaaaatgattagggacattctacggttgccctagggcgcacacccccatgggctaagcccacgacacagttataagtcccaaaacacaaatcagattcggactggatgatatacgtgacttgttttgcagattcccggcagctcggaaggaattttggcgtgggaccaaaaccatatgaaagtagactcaataagctttctaacaagtacttatgggccccaaaatttcttctagatcagcggctaggtccgtttgaagttgatgctgtcagggggcccagatccgaatccaaaacgtatagaactttatctattgtcttctatggaccaaaagtgatgtggtgagatgaaagaagacttggagaaggtcttggtttggtccccaatcaacttcttcaatcatccatgcattccttatgctcggactcttttctttcgcccaagcaagtacctctgcaaacgaaaacacacaaaactcattgtgtagcaacgtttgttcaaatatataacaagtaaatctaatgtagaatatatgtacctttggttgattaatacataaagtagtcatggttatatccgagctagttgtgtcctcatcagttctggtggtcggttcatccacaaccgtcattagggtgtaatcctagatttccacttggaaggccaggatgattggctacaaggtcggttgggcagaaccacgggttcggctgacatgtgggccccacctcctagttgctcctttggctaggagactaactagtgggcccttatggcagttaggattgtttagctcaactttaagtcggttttgacagtaaggtgggccggccctccaattcttatgctcgtgcgtgattgaccgaaggttcattttcgttgcatggcgggtgtattttctccttaaatgacctgcatatatatacttactgaagctagtggaaatggttagtaataaactcctaccactaagttttggtattatatttgacgtttcttatgcaggacttgacgattaaagtttgtacttaacgaccgtcaacaacacccccacagttatccattactcatccccgagtaaagctcatgggtcgactagagtaatgactttctgctcaatgatatgacacgcaaaatatttcaagatatacatgtgtctgtgaaccttgaagtgtctaccaccttggggttttctttgatgtttataaacttttactgtactcctcaattgattctctcgaatcactcaaagtgtttcattccacaccaaggcattgatgttggaaagtactaatcataattggtgggcatcaattttggaaacacaagcacgttatacttcgaaatggaaattacctgcatgcatgttctatggaaagtatatgcatgcaatatcttatcgtgttagacccgctaataggttatagtatcctatagtgcattgcacagatcttaaagcatttggattgtggatggccatggagcctgggcaccatggtgcaccaaagaaatgtactaactatatatatatatatatatatatatatatatatatatatatatatatatatatatatatatatatatatataaataactaacatgacgatgcgaagaagtatgtgaacatgtcgcccattataggtgtagtttaggagcacaatgcttatgataaaatggacaataataaacagtacaaataattacatacatggagggaagcaaaacatactatatggcactaaattctcagcttattactagcattcaattggttccttcttttgtttatcttatccaccaatgtaaataatccttttgctcatttggttttgtttaaactgaacttttcataacaagtgcgatgtatattattcactgctatgaaaataacagtaaccttgtttagttcataaaaaaattcagtacaaacatataaaacatcctactgatctccgcactggcatcaccatcgggtgctcttacacttcagaagatagtggcatgctttctcttccctccatcccaaggattacaaggtaaagataaacgggtaactgaaaaaccagagacagggaaccatttgtggcaagcttgggacaaggcaatctagcctacattcgaatcaagtataaatatcttacaatgtacatgtcaaagatttgaagttatcaaagagaagtaacaaagttgttatgatataatttacataacaggaataaagccaacatgtccacaagtaaaatacttaagatctaaactagaaacaaacacttcaggcatataagaataatactatagataagcaaaatttatgcgaactagcttgtcctgaatcactgaaaaaatgaaaattgtaggattgaaacatggcgatcaaccctaccggaggaaagaggggagggagggaggggttgaaatcgaaatcgaactttgaaatatcaaaactcaccttaacctcaaaagcaaaaaagacatgcatagtctgatatggtactattcaccgtttgaccattgctattcactagtttggaaatttcaattcagacacaaaatcactttaaacacaataaatacatcatatcaattattcatcacaccatattaattatcaccacgatttccaaaaaatatcataaatggtccttctccatcatgtttagagttctgctgattcactcatttacattaataatcgctaaaagattgctatgcatttattgcttttgcactttgttttatatgtcatcgatatgcattattgctttcaaaccttgtttatattggtttgctatgcatttattgcttttgaaccttgcttattgatatgcatttattgctttcgaaccatatttatatggtattgctttgcatttattgcttttgaacctaaaattacattgtttatatgatattgttaaacctttattgctttcgaacctaaaaaaatatgttgtttttagatggatgagcatagaaggcactcatcaagcccaaaataattaccagcaagttatatgccagatacttatattctagaacttcaccctttacatgttgtatgacgcatattggttatttttcatgtcgtgacatagtttcaacctgagacaaagagtgatagtctctttttcatgtacaaacttctttcacagttcatgaaaaataatcattgagattctctcttccaagctcacaacaaactaatatatctctgccaaacatctgatgatgcaaatgttctccttttttctaatttccttctccttctttgctctccctcctcaccttgtcttgctgctccttgtctgtcccagatatttctaagttcacatgtttgtgatgctgcactaccaatagttaattatacaaaactcggaaacaccccatcaccattccaaactttaagcctctaaaacactagcagacctcaatcatatgctctcctaacttaatttacattgtgggcatcgagcccaggagaccttccaagattatgaacaatatcagcagagagagctctgtttcgatgattttattctctatttctccaactggaaaatctaattgaattacaggtgaattatatagctccatagcagccaagacttggaacatgccatcccacattcccagcgactcaactcatgataccctcagaacatgccatcccacgatccgattgaatcggcctaagctaacaaactttgttgtgcacaccgcacatcacaagggaaaatgaaaaaaaaacagaggatttgattatcagtttgccatttctgaattaataactggcatacaacctactccattggttcttccttgggagcttcagcaatgttttcaccaaagagacggaaactacccttgggtacgccgttgagaggtgcagcccccatcaccagcaccctcccctcctctttgttggggatggaggatgtatgagggttgcggctgctaggaacagaaacattactgacatctattggagtgataagggataaaaatgatccaacaaaggcactgggaaccctcttgtcaccccatcgctcgtctgagttgtgactcttcatgtgccaaccaagtgcttgtccactgctgaacatcgttccacacttgcggcactcatatggccctctcctgctctgcctggcactgctgaccaatgagcgggttgcctccttggcaacggagacatctatggtgtgctgcactcccttgcccatagtcatctcattattcttgtgtgcagtcagatgaccaccaatctgcaaaggacagtcgaacatctatgaaccaacaactttataagcaattttctttaaaatttagttgcatttaaagacatatgggtgccctaagaaatttacctcagaaatgttgggtggggggacagtgatggtggcctgcttgtggaggccaacgatgaggtccccagtagccagctgcatgttgccatacgcctcgctgtgagcccgcttcgacggctccggtaactgttccaggcatcgggtggggttcctactgctgtggttgccagtggaggtccagctgggcatcagcacagccatagtgagatcacccacttccccatgatccttcttggcaattttcttagttgagatctctcttgctgtcccctttgctgccatggttgccaaacatggctggaagggccgctccccgtatccatgcagctgccgttctcgcaccacaattcctgaggctgagatccgctcttcggacaacattgccatagaagcagaggatgctggaggtggctgcatgtgatcgccagcttcatcttcacatcggccaccatcaatcacttccccatgagcttgtgcagccgccaacctccagatccacccgcctatcggcactgaaagggcagaggagaagcccaattccgatggatgttgcctgctgcttccatccacatgcccatggccatcttccacaccccaacgaggaagtgaaggcggcaacatcgagccacggcgccaaagtgcagtgcccccatggcggcggtcacctatgatcatgtggcgcttgcctccctcagcttggatgcgtggtggttggcgggggatgtggaagcgatagctcccaacagggcgctccgactccgatgaggagatccgggaaggggccatgggcgccgccgatgaggaggggattgattctggtaagagatagggtttctctggctaaaggatttacctgtggatactgcttgtgcgctggtactaaataagcggggggagggagggaggggggatggacacttgggcaggcagagtggtaaatcttgacattaaataagttatcatcaattgaccttatgaggaaggtattttactgcttcctattttgtataactgcacacatttggtcttggtccatggagaatgttgggtctcaacccttgttggcccaacatatgttgtgctgtattcga

SEQ ID NO: 35800 - DNA, 7727 bp, Oryza sativa
  unsure (1)..(7727): unsure at all n locations
nnnnnnnnnnnnnnnnnnnnnnnnnnnnnnnnnnnnnnnnnnnnnnnnnnnnnnnnnnnnnnnnnnnttaaacatatcgagaaatcaaatcgcaaacaaagaatgcaccatttcgtcataaaagaaatatatgatgcctagataaattagcttgtacttaaaaaatgaaaattgacatttcttctaacattttggtccaatcaaggataaatcaagaagagaaaggagctccctgtaccaaaagtactacctaaccaaaagtagcataatgagaatatatgatgcctagataaatcagtatgtaattaaaaattgaaaattcatattcttctaacattttcgtccaatcgaagataaatcaagaagagaaaggagctccctgtactaaggcccagtttatttcagcttaagattattgcaatctaaattattaaatcagattactctaagctagattataataagctgacatagaataagctgcgagctatttgtttctttggattattggaggcatctaagggtagtgggtctttagccacccaataatctgaaaaaagctcctccaaagaagattattatattatagtaatctggcttatatattataataatctatcataataatctacttgtttgtttcagcttactcctaataattcagattataataatcctaagctaaatcaaacagcgcctaaaagtagtacctaaccagaattagcataatgggatggttttaatgtttcacaaaatgagacctggtaatatgcacatgagtagtatatttttcccaaaaggcagaaccagacctggtcgtcgataatcaaaaaaaaatattccttcattggattgactggcacatacaaatagaaaggttaggccctgagatttagtagcattgaattgttgatcctagaaagcaatggggaaaaataggtacaaaagggtcaggttgacatggagttgatgccatggtgcccaattatgcatgttcaagttttgaacaggagatctagttttgccaaatcaattttaaacctaataacaaaatacagccatgtcatatcggataacctccatacagtaattttcattacacaaaaattaaacttgtcccttattttttttaaacaggaattggaaattgatcccatccagacaattgaacggagggagtagtaattagtatcaaaccagcatcccgagcctagtaacattgttcactgtcttatcgcatagaaataaatggcatggttccgatagtccattgttcacaatttcatggcacaaaaagaagctaattcaaactaacatatatgccactgtaaacgagttccatcgtctgcacactcatagttcaattttataataaacatgaccaaaaatggtatagccaggtgaatacattctccaacttgaagcacataatataaatttctcacatataatcagttgaatgcggctacaacttcatcttaagatcagacgtaatattggtgctccatcttagggttacctacaagcgtaatatttgtgctccatcttagggttttttttgtaacaatagaagaaaagacaacagttcatacatgattttgctgttttttttttacttaatacatgattttgctgtttacgattatgatttgcaaagcccagcaagcatgcataatgcatttgctatgaatcaaaacaaaccaaaactgaactaatacaatgtactatgtcacaatgagatgagttttgtccaggttcaatctcagaatatatgtgaaaaaaaatgagaaattttttttttgacttaaccttgtttgtaggggagggggctcggaggatggagagcatgatgtaggccggcgtctttaggatcagatgactctgtgcactgtagggtatgtctgtgttatagacggtgacgtgtacagagaagataggcctattcactgtgcattcccacacaatcgctgggacacgatcacctccacaccgtcggtttcgcctccatgcccctactgtaaagaggaaatatgaacagttgatctcatcttgcttatggcacataacaagtaataaataaaaatatttccagattcaagcatattgctggttcaaaactatattgggggatatgcatcatttatactccaaataaagccagcacaaaatcttaatacaggaaatatatgatcaaacccaagagtaaaaatgcaccatttctaattcggatgaatgacaatcaagtccattgcatctacatataatgaggcatgttctgtacactcggtcatcaattttattcagaaaatgacgatctatctcacaagtatatggactcgattattacataaatgctacacataattttcactgtaaattgattgattagacaagtacttaatcatgcatgggtggtacagtggcaaatagggaaacaaatcaataataatataattttgacccatattcctataaactattcaattctgatatatataaggccttacttgattcggcggcaattccagccaagcaatttgatgtcaaattgagcagtgaactgaaatctgtgtattggttgtagctggaaacattttaacttgtaatgatcgtttctcaaaactatctcttctcacaaacatagatgaagtgaaaaattgagcactacataaatctttataagaatttgtatgcaagaaaagactcccatattgaaacacagttgtaaatatgagtaggttccaagaagttgagtagctatacaagaaatcatggtaatagaaaaaaaccgaggaattgtaggaatccttactttcctcccatatcacagaaataagcactcaccttcagtagcatacaaaaggaaccaagggaatgatcaaacaccactatttttcattgggatttaccaaacccatgcactaaatggccaatgccatgaacctgttgccataattggaggtaaaaatatgagtagtaactgcactatatgcagtttagtaggaaacatggtagcatatacacattctcaagtgtaacagcaacatatactcctgtataaaaattcagcatactttaggttccacgtgtagtattcatttgaaaagggaacttcatggcattaatacaacataatcttttgatctaagcacaattcagaagcaagaaaactgaatgactgttatggagagtgtcaagttcgtcttgtccggttaaatatcttaactatagagtcttcagaaagagtgacaacaggaaggtgattccccatcttagtaagcagcaagaatctttaggcagaacagtcaaccatgaagctacattttttatagaacttctactctcaacagaaatacaaaaccattatgtttgatcagattgtttgcgcaatctgcaaagtaggctactggtagcataaatggcagcccttaacagttattaagcccatccatacatcaagtttaggtataaggtcacttgaaatagatccataccataatgcagatgtttgccagtcaggaaattgctgcatctttgtccagatgtctatgactggatggttcaattctttagcaactgtcaggcatgcctgtgcataagtgccagcagcctcattggttctttcaggtagttttgaagggtcatcttctccatacatgtccctgcaaggaaagacagggacagtcagtaaggttcgcaaatcctctttacaaaaaaaaaagggaacattgtttaatttgtaacttgaaaaaagaatcttcagatcaagctaagggccaccaagtggtgggtgactggatatatacccgataaaccaaatatgaaataatcccataatgtagaatacacatagttttacatgagaaatacagacaacatgatggtcaaattgcataccctgtactgtactggtgcattatgaactcggttttaaattcttgagcaaagtaatttttatcggagtaattcaataaacagagagcacaagcaatttcctagctgacccctttattgtcgtctgttcatgacaattagcaggaattaatgccatggatgaaataaacagaggatggcaaatacaccgtgatgccattaacagggaaatgcaacaagaatgccatatagcaacataaaaccgattaaaaccatcttgttgttattccttccatccttaccggattctcaccggttcataaattggtggaggcgtgatgagtataattttagtggagggccattgctcctgcgaaagatcgaaaccaaaacagagttaaagcaaccataaagcagcagcatcaattagttcaagttggggaaaaccaatcgatttcaatccaagcagaaccttgaagtaggcgcagatggcgcggaggttgctctggtactcgtcgagcggcacgtgctggtgcacctgcatctgggcgctgtggagcgatgtgcgaaggaaggcgtgcgacgatcgcgtacgtgatttttctgccagtgatcccgcgtgcgtgttctgtcgttggatgcgatgcgatggatgattttcagtcgttagatttgaggaatgaagtatgaaagacgtaggactgtgttggtgaattatatggtagaaaattgggaagcacttagattgtctttccaaccatatatattaaattagactatttatatataaaaaataaaaaataggagatgtttccttcgtccgtcaaaacaaaataaatagtgaaaaaaataaaagaaagttcgactcccgtcaaaacaaaataaatagcgaaaaaaataaaaaaaagtccgactccctctcagaaacgaaagaaaaagtccgactttatatccgatccccccttaaaaacggaaaataaaacacaccacacctctcggtctcggtttgagtcgagatctcaggcacactcctctcggtttcaatctataccgtgatatcccatacatcttggtgaaaaaaattgatgtgccggattgaagatctgtttgcaaaaacggaacctaccggtcgagagcattccatttttatatgattttaatttttgggtttgtacttttctatttgagtccctgtaatttttatatttacatttgagtccctataatcttgcaataagatacttgaggtcgtttttttgaaaaaataataaaagggagagaacgagggcataaaggtgcataaaaaaaaagaaaaactgcaaaaaaggaaaaaaagggaaaaaaagaaaacaacaacaataaaattttgtttccactaagtggcgaaaaaagcagtagatccaattcctataaaaggcaaaaaaaagtggtgaaaaataaaggctagatccgattcctttaaaaagggaaaaataaagtctgattcctataaagacgaaaaaaatctgaaaaaacatctaaaaaagtttgtccgattccctaagaaagtggctaaaaaaatggttcgtgaaaaaataaaaagctggttcgtacaaaataaaaaatgcacgcgagaaaaaaatggaaagggcgaaacaaattccgatttctaatcagtgtatatctcttctctatctctaatctaatctaactatttaaaaagagaaaatgcacgagaaaaataaaaacggttcaaaaaaatgcgtgagaaaaaagcgcaaaaaaatgctaaaatggttttccattttccataaaaaaaacatgcgagaaatattatttccatcgtcggtaatttttttaaaaaaaacatgcaagaaaaaaactgtaagaaaaaatgcgccatttctaaaaaatgatttgaaaaaaccgcgcaagaaaaaaacaccgtctattaaaaaacaaatcgctctgaaaaaactgtcagaaaaaaacactaaattgatggatgcttgagtcggataggatacatcgatttttttaccatctattacacggcttttatttcgtcatatattcccctgtattggaaaaaaagcaaaaaaagaacattaaaaaaagtgcaaaaaacgtgtgagaaaagaaaagcaaaaaagggagaaaaatatggttttcgttgtcagtaaaaaaaatcaaaaaaaacatgctacgaagaaactgttagaaagaaatgcgccatttctaaaaaatggtttgagaaaatcgcacaagaaaattatacaccgtttaaaaaaaacaagctgctcattaaaatacaaacattatcattgacatgattatgcatgaaaaacgtatattattattagaatttattcaccagttcagttttggtccctccagttgtcccatatacttactaaaccaaggctgaaatcagttttaagccatttaaaattgctggggaattatgatcaattatttaatcacttagtagattatttttagataaatgagaccaacaaaatgtttatctagaaagtattaattatatgatattgtatttgaccaacgttaatatggttttatgtcaaaataattattatttccttaaatattaaattatttctagaattcgaacatatttcactaaagattttatttcgatactataaagtgtgtgtttctttcccattgcagatgcctttttacctttttttccttttgtagcactaaaaaaactgaaaacatactatagtagagtgcaacaaagcaacgaaacgtttaacctctcttactaaatcccgttgcaatgcacgggcatatttgctagtatattaaacatgaaggaagttgactggctaggttgcacatcccttggaagttggagcaaatgtttggagacagtgtactccaaaatcagcatgacgtaaacggtcgtcatcttcacgtaaccactttgatcttctagctcgtctcgatagatgcccatcaagtgttgtacatgtgtaaacctagtgttgttctcgtcaatattgaaatatgttttagctagaagcgagttcacctcttgttgtagtttctttgtacggctacgtgtgatcggtccttgaaatggtgtaacggattagctctcatcagtgattaagtcagatgattgtcttgagtgttcatgtgacgggtggtgggacacatcactacctagggcttatattcatcatctttgtctgctccctgccggcaaaatctatttgtgcttcttctaccactgctatcgtctacccgactggtttccaccgtttcttctctacccacacctagtccccaccatgatccccgagtcagaagttcctcaccgattgcttggtgtcctccccatctcatcttccgactgaatgcaaggagaagagcatggctgaaacaaataaataagatatcttgcatttaattgaggacgtttaggtggaggaaatatttcgaatgcacagaagatcctaaggttcatatattaatggatgactttgaatagataagcaatagttaggtacatattagtatttagtttctttataaaaattactgacgtacaagtttgtcagtcctacattacttttctctatcacaaacttgcatggcttacattgtagcaaaaaaagtagtggcatgtagaaacaaggaggttgaagcccggggaatttaatagccagtatataaaagagcaacacatgataccagtgtcccaagctggtacattatactagattagaacagcttgtttgtgactgggaaaaccgatagtgtcatttggtccatcaccagtacgatcaacaaacaccgatctacgtaggcgtcctactgctccacctgtgatttaaggattg

SEQ ID NO: 35801 - DNA, 5887 bp, Oryza sativa
  unsure (1)..(5887): unsure at all n locations
nnnnnnnnnnnnnnnnnnnnnnnnnnnnnnnnnnnnnnnnnnnnnnnnnnnnnnnnnnnnnntccctccggcgtacgccgtcccgccgcctcctagacgccaagcgccgccgcgccagcccacggccgcacgcaccgccctcggctgccatccccgccgcccttggctgtcaatccagtcgccgcctgactcactcgctgcggcgtcgtcgcccacagccgccgccttggccgccggccacctcctccttcccccaccaccatcgccgcctcctgctgcgtcggcagcgatgctgcacgccaccccaccgccgcgccaagtgaagagggaggacagggacgtgcgacggcggccggcgaaggtgggatcaggccggcgaaggtgggatcgatccggatgggggcgggagaaccggatagcgtgaggagggcgtttctctctcctgttttggcggatgtctatttttggaggatgttttggagcgtcagctggagcctctttttttgcttccataagccatttctcatatggagggttggataaagagctgctggggatgctctaagtacctgtgtaggtaaggactgatcacccgttacttgtgtaggtgacagtagtagttcagcagtgtccaaccatctgtgatgaaaaataaataaataaataagtaaataataataataataataataataataataataataataataataataataagcatcaaacactcatcatcaccgtccagcctcaagcaaagggtgaccagattaggcggcccatttggtcatgatcgccatctctagtaacaaagagcttaggtggccaccagaaccggatcatgccggctcaaactcgtcttctttaaatttttagaggcactaggagcaactccaataaaatggccaaataggtagccaagttaaattttagcaattctaagaaaaaatcgtgctccaagagactctccaactggatgcccaagccatccggctggctaaacctgagttcccgctagccaaatctagccagtcaagccggctggccatccgctcatccagtgggacccatgttctctctcactctctctccccctctctctctcctagtctcctggcacaagcacgagctcggccaagcagcagcggcatccaaaacttgggcgatgcagctagcgttgcattgcaatgcattgcagctcggtgttctttgctttgcttgccgcagccattttttggccgcttctatagcagcttccttgctttgcttgccctcccatgacatgtcctctccctgacttgtgttgggtaaatcgatcgatgggcgccgcggcggcggaagaggtggtggtggtgagggccccgccgccgtcatcggggaataggaggtccaccaccgcccgatgttgttggtgcaatgctcccgccatcgtcgccggagctcgaggaggattgtctgattatcaagattgagtcgtgcagccgggtcttcgcgttcgtggatggcgccgtcggggagtccggcgaggagagggacgcgaagacggaggcgctcgttgaggtgctcgctgcggtgaggatgagcgggaagaagcaggggctggagagagaggggatggggcggcggcagcagaggggagaggggagagaaggggaggaagaagaggaagaagaaaaagttgcagagagtgacatgtgggtcccattgtcatagactcagaatagagagtatgaatagagaggctgttggagtagacaacaagtttgacttgccaaattagatggagagttggccaaatagacatttggagagtcagatttgaagagactgttggagatgctcggccctatttgattcagcttaggattattataatctgaattattagaagtaagctgaaacaaactgatagcttattatgatagattattataatctataagctagattactataatctggtaaaccactctacaggtgtttttttaaattattgggtgactaacagctaacaaacaaataataatccagagaaacaaacagctaacagcttattctatatcggcttattataatccaacttttagtaatctagttttataatttagattataataatcttaagctgaaacaaacaggaccttaggcttcaatcctaggtcccgcacaaaaaatggtcagcctacttaacaccgtgaaagaaataaaaaatcactatcatcaacaatttttgtgaaaacttgcatcataccaggttttcttgattttttttcctctgttgtgctagtgctaaataaatttaacgacggaaagtgattaataattatttatagaaccatgattgtgaattaaattgttttatagaaccacgacagaaagtgcttctctaggagtgcttgctctcaaaatgtctcctgcttctcctgtgatacctgatctgtctcctagtagtattataaggcactgtggagattatggtaccatatacccacagggttacattacgtgactggtaattcatagtaaaagataaggattcgggtattgtattatcttgtatgtcaaggaaatatcccataatcctagtcggttacgattgtaaagtatctataggggacttagaccgtaagggataaggtttttatcttataatcccgagtcgggggtgtaacaacctgaaaatttaactaatagtttaacatgtcaaatgctgtgtttctaataacattataggagtttctataactttcataaaaaaaatcttgagatgattcttatgtttaaaatggttttgccagactttcatttgggatgatatgaatctttagctactattatagggaaaacatttcttttccagaaaacaaatgaccctataatcttggtggcgaaatctataagttgctacgttaatgaagtcttatctttttttcagagagtgcattagcgctaataaaatctaccaacacattttaggagtagcttgactaatttaagttttcacttgcacgaggggaacaatgatataagagatcaagctgactcgataccagattgtcggtgatatgggcccgagggtaccccttaaggagggcgaaggccacccccagcccacgtggtgccccccgagggtgtcggtccctggggtggagcagcggctgcctcccacgtcaggggtcaggccgtcctgaggccctctatgctttgtttcgcgtgtgcgccctgggcgggcgctcccagcacccaaccaccacatttaatgaacaccgcatttaatgcggcgggcatgcgcactgacagaccatttgcagccggaatgacggatgtgacggcgtgcaggcctaggacagggcgccgtgcgcatgcgcctcctactagcagagggcatggcctatgcctgccccatcccgtcaccattaatgagcggctttctgcctctcatttggactcagaccagctttttccatgctggtctgtttgagagatccctaccccttggtggggccggacggccagtagtcgtcgacagttaaaaaggaatgacatgggtattcgcccgtgtcggccggcgtgatgggatggagcccatgccgtggtaaggcgcgcgtggcttcccatgtcgggaggacaaacacacattaattacctgtaaagaatgttgtcctttcccttgaagttaggtcttgggcctttgtggtaaccccttaagatataaaaggagaccaatgcctgcaagaaagggggatcgaaacctagagaaagaaagcacttgtattctcccaccagaatcaaccacgcacatgagtccctggtccgaacatgtataaaccgcatacatctccatcactcccgaggggcccgacgccctccgcatgtctttcccatcaactctcaaaccttcacccgtgtccctggtccgaaccagaaagggggtcccacaatccccagcttgaagagtttaccctccgacacaaataatccacaaagctccaccatttttctcccttttagcttttaagccaagtcgaaacctctttgtatttaactttattgaatgaccaatcggtaattttgtaacctcatagtctattcattaatttttcgcttattaaataatctacccgatcacacatagcttttggctagtagattgagtaactagtcactgtgtgcttgagtatatgttttgagtgaagtccaatttattggcttgaatgattttctttgttttgctgattggtacatgttaaatgaacatagagacgctgtaacaaatctaagcaacataaaattccttgaaggtcctcatgtcaattagacaacctaagatgacaactatgaaggtttcatcattttatcaccctttttactacctcaagtatatcggtcaagtataatcatacttaattaattagaaatctaatcggcaaaatgaagcaacttctaaatgtgcttaaagttgaacatgagggtataggttttataatttattaaaatactagattatttatcacaagttaatatatattttttagaatttttacacttagttttgacctccttaaaagtcaatttagttctcagcataccccttttcacctttttgccagaaataaaaatatttctaattttagagtgaaactttgaaaaatggaaactaggaaactcaggatatctccacatcagagcacataattttagcatttttctaactagttcaaactatttaaccaagaaggagagaaagaaattcctgaaaaattaaccaaaacagatgttcactctgcttcctacccatcctcctaacccttgcctagtgtaccacgtcctgccccacatgtcaatgtcctaggctaactccaccctgggtgcacgcaaaatgtcacgtggcacccacgacaggcatgcatgccgacacgtatctcgtgtggtggcaccgttcttcgcttcctctttgactccagctctccaagctgctccctctctactcacacttcaccccagagccaagaaatcaaagtgggagagtttccccttgctctcctcgccttcatcttcttgctggccgtcgggatgactccataactgccgcccaatgggtcatcgtcatcgccatttttctttcgttcccgactcaccgcagcacgccatagcctctgctctgatttcgccccgtttcttgcagccgatccccaggaacaccgacctcgccacgggagctctggagcgtggccacaccgtcgtcaaagcgcagccgtgggatcatgtcgccattcccgtcgccttaagctgaatccggctgagttgctgcgccactgattttgcctcatcgtcttctacaaaatgccccaagaatctcacggatctatgcagcgaggagggagatcgaccaccgccttctccgactccgacctagcccccccgtcgtcgattcctgttcaagcggtgagccatttgtcgattgtttgcagtagtaccaaccttaggtggtgttctatgtcataatcacgccggagagacgatgtaaaccacgtcgccgatgagatcacggccaacacacacacaaaaaaaaaactcatgcgaacagaggaacacggtcttgtttggtgctgctgaattgacagcttttccagactattccattgcttaaaataagctattacaaggaaagcaaccatagcctccaattaggccaaaacaagcagacatgcacaactaaccatatagagctactactaatcagcacacaaggattattcttaacaatctcctcctaagacttgctgtgctcattactgatgttgatcaggccgatctttgaannnnnnnnnnnnnnnnnnnnnnnnnnnnnnnnnnnnnnnnnnnnnnnnnnnnnnnnnnnnnn

SEQ ID NO: 35802 - DNA, 9476 bp, Oryza sativa
  unsure (1)..(9476): unsure at all n locations
cggtgagcatttgtcattgtttccagtagtaccaccctaaggtggtgttgtatgtcatattcacgccgaagagacaatgtaaaccacgtcgccaataagatcgcggccaacacacacacaaaaaaaaaactcatgcgaacagaggaacacggtcttgtttggtgctgctgaattgacagcttttccagactattccattgcttaaaataagctattacaaggaaagcaaccatagcctccaattaggccaaaacaagcagacatgcacaactaaccatatagagctactactaatcagcacacaaggattattcttaacaatctcctcctaagacttgctgtgctcattactgatgttgatcaggccgatctttgaacgtagctcatggaacttggtcttgcccagcagcttcgtcagaatgttgcccagctgttcttcgctcctgatgaactccacattgatcaggccattttccgcagcctcccgggctagatgatacttcacttgaatgtgcttactctgtccatggagtactggatttttggtcaaggaaatggcagacttgttgtccacccttagcattggcgctctcggtgtcgatccttgcacttctgccagcacacgagcaagccacaatgcctgacaagcagcatttgcggctactatgtattccacctcacagcttgactgcaccaccaccttctgcttcatggattgccaagtgattgggctgctgccgaggaaaaaaatcaccccagtcatgctcttcctagcatcgacatcaccagcataaccgctgtcactgaaccccctcaggtacgcctccttttccaccttcctgctgaaccaaactcccaaattcttggttcccgccacgtagtgtaggatgtgcttcacagcagcgagatggtcctctcgtggatcttccaagaaccggctagcatacccaacagcaaaagcaagatcaagacaggtgttaaccaggtacctcaggctcctgacgatgcttctatatgccgtcgcgtcgaccgacggctccgagctgaacttgctccgctttaaccgtgtctccatgggcacttgacattgattgcacccttccatgccacacttttccaggttcttggtagcataagctccttggctgagcaaaattccacttgcgctctgcttcacctcaatgctcaggtagtagtgaagttgaccgagatcgctcatcttgaatgcagcagccatctccttcttgaattgcctgatgtcgtcgtagttggagccagtgatcatgaggtcgtcgacgtagaccccgaccaccagctgtgcgttgccgttccgcctgacatagatggcgtgctccgatggactcctcttgaaaccgagtgactgcagtgtgttgtccagcttcgcgttccaggcgcgcggtgcttgatgcagcccgtacaacgccttccgtagcttgagcaccttgtgctccttgtcggcgatgacgaacccggccggctgctccacatagaactctttctgcaggtccccattgaggaacgcatacttgacgtccatatggtccagctcccaccccttgtgcgccgcgagggcgatgagcaggtgcaccgagtccaaccgcgccaccggagcaaacagctcgtcgtagtcgatgccttgccgttgcgcatagcccttcaccacgagacgcgccttgtgcttgcacactgctacatgctcatccctcttcaccatgaacacccatttcaacccaatcgcacatcgaccaggtggaagatccgccagcgaccaagtcttgttgtcttcaatcgcttccatcttcgccatcaatcgctctgcctcatcgaacaaggcaagctcatcagagctcactgcatacagctcctccgccaccaatgcacatggtgcgaagccacatggcgaggctggcccgatgatgtcgttgatgctgcagaaccggagtggggcatcatcatcgtggtcagcgtccaggtagtcattgtcgatgcctgctggtgagccggtttccagctccgtgtcgcgatccccactgagatgcggtgattgctcacctgacgtcggctcctcgccaccagccctgccaggatgcggcaactactcccccggctctgcagtggcaccataaaccactgaggctgtcggctccatagtggagtactccaccgtgaagatgttgtcgccaccacctagctctccatcatcgctgctagtgccccagtcccactgggcttgctcatcgaacaccacgtcacgcatcacatgaacacgctttgtgacgggatcgtaggcgcagtacgccttagacccacactcgtagccgacgaagatcatcttgcggccacgatcctcgagcttcgtcaggtgcggcgttgtgttccggatgtagatgatgcagccgaacatctgcaggtggtgtactgccggcttcttcctgtgccacgtctcgaacgggatcatgccgtccacgctcttcgtcgaacacctgttcagcacatacacagctgtgcttaccgcctctccctagaaccatccgggcagtcccttcaacttgagcatgctccttgtcgtcaccaccaccatgtcgtttcggcgctcgacgacgccattctgctgcgagctgtagggcgcagttgttggcaactttttgtgacaagttgacaagcacgatcgcagcacctaaacgccttgcggcgatctcagagtcgccaaccacctcaatctagccaaagctaaaccaagatgggttttgataactaaaccggctagcggagccgattctaggtagaacgatggatagctactcgtctcgtgggaaggttttcaggacaaacctacaaagaggtgtcgcaatctcgcagcggcgtcggacgagttacggcgcaaatcgacaaagatggacaaactaaactagaactagaagcaaaagtaaaagaccgattcgattgattgatagttgattgatttttacaatgaaccggccatgtcccttaaatataggttggtcttgccctctataggccctcctccacgtccaactcgggatagaatccaaaggaaacccgaaatatgccttcccgagcaaggaaacctcgtgacccgacgaaacagtcctggacttggactctgccggtcagaccgaccacacaccacttgtctgaccggagttcaagccgtggtctgacaggcctatacacggcggtcagaccgtcctccagaggaaaacaccagtagacttccaaactttggcaactttccctattttattcctaggtgccaaatttgagtgtaaacacatgcccccctacctttttgatgaacaaggtgaatctaaaagcatagaacatcttttggtcttagggtgataatccaattaccgggccataggacttcctaagcatcttgccaaacgctcaggaagtatttcttcaagtatttcccattgattgctcgctaaaaacgctctccttgaagtgtctccaaaaaatacatgttcccccgaacaatgccgcatacccaataaggaccctcccaactaggagaccatttaccgaactctctggatcgaggaaccaaaggcaaaattgtttttcaaaccaagtctccaacttgaaataactttgctttcacccttttgttgtatgccttggccaccctcttcttctctttctctatctcttccaaagccttcaagcgcttgtcgatgacttcatcaagattgtctcccagcaaggtcttgtagtcttcacttgataaatcatcttgcttgatataccgaagagagccaagattcacctcaaccggcaaaatggcttcttgaccataaatactctcaaaaggagtgactttagtggcaccaagtttagatatcctatgcgcccacaatgcctcagaaagcacttcatgccacttctttgggtgttcctcgatcttctttttgactaatttcaacgtcttattattggactcggcttgtccattagcctgagcgtagtaaggagaagaactcaacaatttaataccataagattcggtaaaactcttcacttccttagatataaaagaagctccttgatctgtagtcaatgtttgcggaataactaatctatagataatatgcttcaaaataaagtcaattacctccgtatgagtcaaattcttgagcggcatggctttggcccacttggtgaagtaatccgttgcaactagtacgaacctatgcccctttgatgacggaggataaatttgaccaatgaaatccaaagcccaacctcggaatggccttggtttgatgataggattcaacacggcggcgggcgccaattgaacattgccgaatcgttgacatgcttcgcatcccctataatatttgaagcaatcttcaatcatcctcggccaatagaaccccgctctcctaagcaaccgattgatgagttccacaaattccttcatgtacctctcccaaagccactttagatgtatgctttcagctacacagtactccacgaactcgatcgaggtgaattcacctccgcgatcagtacagagtcccttgagctttcgtccggattcgccttctgcacacgcctgggtgtccttgacggcagccgctgcacaatcctttgaaggaatcgcggctacccacatgtatcggctaaggtcgtccaccaacagcaggaaatacttgttcccccatggtgtcgccggcgtgattggaccgcacaagtcgccgtgcaccagctccaacagctgtcgtgcacggtactcggcctgcacaggaaacaaggtacgtcgttgtttcccggcttggcacgcctcgcacagctgctcgagctgcccgatctccagcgatccctgcaccaactcctcccaggctagcttccgtagcgctgccatgttgacgtctccgaagcgctcatgccagcaccatgccacctcgtcaccatgcccatgcagcgccaggcacgacggctatgccaacttgatgtggagcatgtacagccagtttgccgtgcgctttaccttcgccagcaaccgttggtagggctcccgaatccacatcacgctgtcatcgatgtcgaccttgcaccgggcctcatcgagctacccgacgctcacatgttcgtcgtcaatcgtgggatatagtagatgtcagagaacgatcggagctctccattcttgcacacaaacacgatggtcccgcggccctcgatccatgccatcgagtcgtcgccgaagcgcaccggcccaagcaccgccgtgtccagcttcgcgaacgccgctcgggatcctgttggtatttcttaacattacagataaaatccgcaagcgcacggaagataccgatgtagcacttcacctaggagtattctcaggtatcgatttccacaggaaacaggtattacttccttatcaggttcacccaaggacactaagctaaggtgggcaaaggatagagaagatttcctagtgagaaacagtgtctacagaaagcttaattttaatcctaatgcaatactccaggcactggcaacattgttcccaaatgtcgctctactacgtacccaggtagggaggacttaagtgccacctctacacccacctcaaacatactgtgggatacgcagcaattactagctattgattacctaaacaccacgtctaagcaattaatatatactcttctagtgtttataactcactaaagcaatcactatattttagttgattatagcaaacaataatcccgtatgatgattaggtactaaccaagaggtaattctcacaagtaaatctaaattactcagaaagataattatattgaaagcagagtaattaacagaataaaagaaacaggagaggattaccgacaactccggaattcctccgacttcttctactctactctcttcctaattctagtatacaaaatagtacaatagagcctcttataattcagctcaagcttgaaaatatgtgttgagagtgaaggagtgaagctcttaaataggcaggtaatgacggttgtggaacggaaaatgtccgaagtgccctccaaccgtcatcaagaatgtatctgggacgtccacgccaaaccacgagatcaatggtggagagatgggttcggccgaaccctggcatggcccaacaggcccagaatttggcctgtggatgcttcttgctctaattatctgtttcttgcaattttgggctgattctctagtattttgatgtagtctaaagcccatctcttgtatggatgggttctttcttcactttagtctgatttccctcccaactttggtggtttatgacctgcatcaaataaacaccaacacttgtggaatatgttagaaataaatcctatcactatgttggatgtcttattatctgagttttatgcaggtattagccgtatgaatttagcacttaacagccgccaacagatcccgacatgtggttgttggcaacagtgtccaggacccatgtctctgcatcgcgctccttctcctcatccaagtgggcaagcaccttttcttccccgagcaggatctaggtgccggatgccaccgtcgtcgcctcaggtccgccggatcccgtcgccgccaccgagttcctattctgccctccgcatcactaggtcggcctacaggagcggaatcaccgacgagttgcgctggggaactccaaggggcgatgttaccactggtgcgggcagcgccgacgcgctcatgtcttgcagggataccgccaccgcaggagaaggggatagagttggcgacgatttcaggagaagcagcgcggcctcccctttcttctggacgacatgggccacttctttcttgggcttcgagtggcactcgcgagcccaaaggcccaacttggcaaaccgcctacactcgttgcatgtgcacttgctagagttggatggcccacttgatgatgagccttttccattgccatgaccacgcccacaactgtgttttcctcctccaccttgccctgtgccgccgttgaagccgttgccggagtggttctctgcttccagcttctcgcatcgtgcgtcccattgctcctcagtgaggtacagcaacgctggtggctcctcgtctgcatcttccactgccggagccgcccggtaaggccttcaacggtgagcatcgacacatccagcaaagttgtgatcacgaccacgatatgcttgagatgttttggcacgctgcggatgatcttgttgacgatcatgctctcctccagcttttcacccaaagtagctagagtcgcggccatgccgttgaagtgtagcacgaaagtcttcaatggcctcgccatcgttgaatgttgccagatcgaacttgtgtcggaggttctgcgccgccgtcttcttcacgcggtcatccccaacccgcatggtcgctatcgaggagtgaccctctctagcgggagatcgtgagacccccctttcgtgagttcggccgggggaagaggctcgcttcgggagataatgtatccaccctgaaccctgcaaaaacgcacacgggcaccgggattatacaggttcgggccgctatcaagcgtaacaccctacttctgtgtgtgggatttatggatgagtgttacaaaggttccaaaactccggagagctcgcctgccttctcttccaagagcttaggtctattccgtctcgtcccctttcttggtgggcaaggtccttcttttatatctcaaagggataccacatgcaccacctcaacctactcttctatcaagcgaggacccaccctatcttgaccggacctcgatccatgccttcgtccggaagctaagcctcagctcgttcttgagcgggacccagcgccgtcccccacctgacacgggggacagtcctgtcattccctcataaatgggtgaagacttgtggcgaccgtccttctcgtggagggagctccgaatcatgcctctgacgggacgggtcatacctatctccactccggggcccgagggtcgtcaagggtcggggcggagggcgcggcgccggggtccctcggggggtttagacacgctgacggcggcgcgagcctttcctcgaaggtccccggggggagtggggctcgtgccgacgcgatgcgcgacaactcatcagcgactgcgttgttgcatcggggcacatgccggagctcgagtccgtcgaagtgacgttccatgcgtcgcacttcacggacgtatgcgtccatttgcgggtcggtgcactggtactccttggagacttgattcacgaccagctgggagtcgcctaggacgagtaggcggcggatgcccattccgaccaccgccctcaatcccgctaggagtcctttgtattccgccatattgttcgtggctcggaaatcgagccgaacgacgtacttgaggacgtccccacttggtgaagtcagcgtgactccggcccctgcaccttcaaggttgagggagccgtcgaaatgcataacccagtgcccagcacgaatgtcggcgtttgggtcctctccatctccggagagggagggaacgttggacggaacagggtcctccactggggtccactccgcgatgaagtcagccaggacctggcttttgatcgcgtgccatggttcgaaatgcaggtcgtactcagcaagctcgatggcccacttcacgacccgaccagtaccctctcggttgtgcaagatttggccgagagggtaggacgtcactacggaaacccgatgtgcttggaagtagtggcgcaatttccttgaggccattaagactgcgtaaagcatcttctgggcctatgggtatcggggtttcacatcccggagtgcctcgctgacaaagtagacgggccgttgcacctttcggtggggccggtccttgttgtcaggggcaagagacccggggtgcccttgctcaggggccccaggggggtctcgggtcatgtcaggactataggcctcgggaccacccgccagagcctcccttcctcccacgggggcctcggggtcctcccgggggttgggggcttcaggtaccgagccttcgggggatgaagggccatcgccagtcgaggggctcccggtctgctctcgtcgcgctcgactactagggtggcactcaccgcgtggggggtcgcagccaagtaaagcagcaatggttcctccgtccctggggctaccaagatgggaggggaggtcaggtaagctttcagctgattgagagcttgctccgcctcctctgtccacacaaacggcccggggcgcttgaggagtttgaataggggcagcgccctctctcccagcctcgatatgaatcgacttagcgcggccatgcatccagtgacgcactgcacatcaataagcttgctgggggggcgcatnnnnnnnnnnnnnnnnnnnnnnnnnnnnnnnnnnnnnnnnnnnnnnnnnnnnnnnnnnnnnnn

SEQ ID NO: 35803 - DNA, 3798 bp, Oryza sativa
  unsure (1)..(3798): unsure at all n locations
nnnnnnnnnnnnnnnnnnnnnnnnnnnnnnnnnnnnnnnnnnnnnnnnnnnnnnnnntatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagccaaggaggtatttttaataaatggaattgcatttcatgagtaatttaaattggaaaaggttttaaaagtctcttttggctttgggcctaaagtcggcccaaaaccttctctctctcctggcccagtccggcccgaagatgagccggccgctcgcgcgcgcgcgttcgcccgctgataggtggggcccacctgtcagggccgtcgtcttcctcgcgccgtcgcccgcccgaaccctagcgccgcgtcgccgtcgtctccttccaaatccagccgcccctttccatttccggtgaaatcaatagaggggaaatgatcttcgggatctcctctaccttttctcttttggaatcgtcggctaaatcgtttggaaattcgcggattcgatctcgaatcggattcgtctctctctccttcgaaccctaatctttccttctcgtcgccggtcgccgtgggccttcgccgccgccttccaacccctataaaaggacccccccaagcccgccgctacctgccgccaccctcgccttcgcctctcgtcaccggtagagccctagcaccgtgtagcctagcgccgccgtcgtcgctgttcgtccagccgtgcgtcgccgtcgctctggtcgtcgttgccgctcgggaaagtcaccgtcgtgatcgccaagtcatcgccgacctcgtccgcccctccgtcgtcaccgtaggccaccggaacaccgtcgccgttgtcaagctgaaggtcaccgccgtttcttcctcgacgccgtcgccgtccgttgatcttccgccgttgttttggtcaccggtgagttcgccgcgtcgccctctacgtgttggtgtcctccgttcgcatcgtcgcgccgtcgttcgccggcgagcttgcgcgcccgagccgccgcctgtggtgacgtcaccgctgacgtcgtcgtcgtcgtctcccgtggtccggccgtggaccggtcgatctcggccgttcgttttggatggaaagatttcagccgttcgtttctgtgagccgccgccgtgcacccggttcaccgcgaaccctagccgctgacgcaataattcccttttccttttcaaaaataattcattattgcgtcataattcaattaaaatctaaataaatgatttaatccgatttaatctttgaaaattcataactaattcatctagctcggatttagttggttcaagtctctaaatttttctaaaattgagatctacatgttaaaaatatccacatgtacagttcatgcttgtttatgtgctgttttggtgttttgctcctttctgtttagattccgacgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaactatttgaatagccgtgcccgcagttatgggcgggtctaacaatgtctttcgtgagtagtttcacacttctcaccataataaaagatgctataactggtaataatttgtttagctcctggtttggaatggtatattcctggtttggagatagatctgtacagccgggcatggttgttcaggatggttgggcctgagcagcatgggtgtgctgtttagtgttgattaaaattgatgattaattactctactgttttataattctcaaatgtttgctaaatgctgcttttgcaaatgagccctatattatgccattctttggtgtccttgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatctttttttttccgctgcttagatctttattgattgagaggaactatctacctctgtaatgacattttatgcgcttattaattagagtaacaattgtactctattatcaatttgttattgtgtgcctcagctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgctctcctccctttctcttttaattaaaccaaactaatagcacatgcacttcataatctcttttagtggttctcattcaaaatttattctagtgttgttagtactgtacatctattactgtactaatggctcatttaacagcaaatgttttacaacattgttttattttgctgcaatgaaataaatttagcatgttgattttataactttcttttattttcttttggaacctgttgttcaaaagtacaaaatttgtgaccttgtttcaacttatcttgcaagcttggtttactttatttacttactttttactttgattttctaactttattcaaattaatctaaaaacttgtgctattaattggataaatgtcttaactccctcctttcacttgtctttagatgctgcgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35804 - DNA, 1828 bp, Oryza sativa
  unsure (1)..(1828): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattttgtgaaacattaaaaccatcccattatgctaattctggttaggtactacttttaggcgctgtttgatttagcttaggattattataatctgaattattaggagtaagctgaaacaaacaagtagattattatgatagattattataatatataagccagattactataatataataatcttctttggaggagcttttttcagattattgggtggctaaagacccactacccttagatgcctccaataatccaaagaaacaaatagctcgcagcttattctatgtcagcttattataatctagcttagagtaatctgatttaataatttagattgcaataatcttaagctgaaataaactgggccttagtacagggagctcctttctcttcttgatttatcttcgattggacgaaaatgttagaagaatatgaattttcaatttttaattacatactgatttatctaggcatcatatattctcattatgctacttttggttaggtagtacttttggtacagggagctcctttctcttcttgatttatccttgattggaccaaaatgttagaagaaatgtcaattttcattttttaagtacaagctaatttatctaggcatcatatatttcttttatgacgaaatggtgcattctttgtttgcgatttgatttctcgatatgtttaagattgaagtatttccttgttgattccttactcacagctgaacaaaaaagactccgagatgctatattgagaacggcttgtctatatgatggaaggaatcactatatatgtgatgactgacttccaaatatgcattacctgtttctattgttgacccatgactggcttgtacaattagttcagctgaagttgtaaaacaattattacagtttcactccatatgtgtctataatcattttctgtgtaatctgtaagtattactatgccacttgtaagaaaaaaaaagtgatgtgactgtaaaaaataaaaccaatgcttaattcagctataaagacaaatagaattgcaccgtagcgtttagcacgggcatattactagtaaggagtaatggataaatgattgaggactgttcagaagccaaacagacgcgcgactcttctcgggaattcacttattgtgacttttgagctagcctatgtccagtaaactcccaagacctttcattcccatctaggagggttgttcctaatataaatatcccctatattttataatttagggacttttgacaatgagaatatgaacccctttgtttagctgtgtgctaacaaattcagagagagatctttacccctttgctcttttaatttccttatgagattatagaagcggcgttcgacgccacccaattggtgctcctggtccctttgaggatttttcctcaattgattctaggttgtgttggttgataacttagagtgtggttgggcgaaccctcgattcaagttgccgtaatagaggcggtatggtggttggcttcaagtacaattgtcggattgcactgttatcttggttgcttgcaggtagttatcttggtctctttga

SEQ ID NO: 35805 - DNA, 926 bp, Oryza sativa
  unsure (1)..(926): unsure at all n locations
nnnnnnnnnnnnnnnnnnnnnnnnnnnnnnnnnnnnnnnnnnnnnnnnnnnnnnnnnaaagaaaatctttgtgtgtacaacatcataccaagaaagtacacaaataaaggtgctctctcacaacatcatatcaataatttaccatgagcagatctatattggctctctcaactttaattctatacaatacaacatgataccaagaaagtacacaaattcaaaacccgggcattattcttagcacaattgaagctcgttaccaaaagctaatcaacaggatgaaactcaccgttgcttgattcactcccttcacggcagtagtgcttccaggcgcccctccatgcctctgactgctggccgcagcggaggcagcggctcacgtagtacgaccggagcttctggcagccaagaacacgatcctgaaccaattccccattgacggacaggttgcggccgccatcggatgtgtccaagatggcaacttggtcgtctccgcaggtccatgagagggttggctcggagacggagtccaaagccagggaggaagagcacagaaggaggaggagagcagggaaaagaggaaaagatgccatcgatactgataaacaatcttcttgaccctttcgaattcacagagatatcatcttcggaatccacaaatcgaatgaaattaacgcgagcacaagattgctaactcgtgatctccttttccttacggaaatgaaaagaaaatcctagtcaagaacaagggggagaagaaagcaagggtgagcttagaattttgtggggaacgaactgcctgctagaacaccaccaaaccccgagaagcagaaaagggaatcgagggggaagatgaagacttggatttaannnnnnnnnnnnnnnnnnnnnnnnnnnnnnnnnnnnnnnnnnnnnnnnnnnnnnnn

SEQ ID NO: 35806 - DNA, 540 bp, Oryza sativa
atactctgatcagaggtgtacaacaggacccacacgaaatgaacaaagatcaaatgctacataccccgtcgagtgtggtacacaagtgattcaagcttattacatgcccgttcttagccccaccccaaccacctataccacgctggggttcccgacgactcagtcgtgcgtgcgcgatgtgaccaaggcgggtgcgccacgcgggaggcacccccgtccaaacctaggcactcgaggccctccaaaggctacctgcctcacgactctccaacgtggtataaatgatcacagtagaactagtaagaacaagccggtcccaaataaggcatgtggtaagtacgtagggtgcttgattagatgtcaaaatgttcggtccttaacgacctagacggggctacttgcatcaggggaaaccaacctcccattatcgccctatcacccgtccgaatccaacataattcatcaaccattatttagtgtaagtgctcaagttttatgcccaataatgcaagttgtctatataccacaattaatagcact

SEQ ID NO: 35807 - DNA, 754 bp, Oryza sativa
  unsure (1)..(754): unsure at all n locations
tgtcattttagttcatggtaacatatgatcacatccatagtaatagaagtatgcaccaagtgtaacatcactggaattaattgcaaagaattggtatcaaagaagaagccattgaacatacccatctgatagttattctctcttcagcagcccgcttcagttctaccggtcggcgagcagagagaatttccacaagcagtatgccaaaggagaagacgtcgctcttaggagtcaactggtatgttctcagatactcaggatcaaggtagccagcggttccttttacttttgttgagatgtgtgtcttttctgtgtcactggggccacttcttgcaaatccaaagtcagacaccttggcccggtagctctctgtcagcaggatgtttgatgacttcacatcccgatgaattattgtcttctctgttcacatcggagaaattatcagatagcaatacagtattattaaaatcaaacttcatcaaaataaaaagtgtgaatttcataaaaccgcagcaatagcaaatgatttcatcaatatgaaattttctcccttatgtgtgtatggcatgtgggcccgatttgcataaagcatgtgtacgtcatgtgtatgataggtggggccaaaattgtagagatataaagttacagctttttgataaaatcgtatgctattgttgcagttctctgaannnnnnnnnnnnnnnnnnnnnnnnnnnnnnnnnnnnnnnnnnnnnnnnnnnnnnnnnnnnnnnnn

SEQ ID NO: 35808 - DNA, 1597 bp, Oryza sativa
  unsure (1)..(1597): unsure at all n locations
nnnnnnnnnnnnnnnnnnnnnnnnnnnnnnnnnnnnnnnnnnnnnnnnnnnnnnnnntttgcaacagaggcccgaagaccggtccttatatggccgaggtgctactatcaaaaccatgcaccccgagcccagcctaaaacccttttgaggattttgaatagagagggaggtgtgaatccaattccacaataatccaaccatttcacagtgtccaggtgatgagaatattcccaaagtctagagttgtaaaaccacctaatgttgcctaattaaccagcgaagcatctacctaaattcatactagtggtaccaggcatagggtacccactagttgggggttttgtttgttctagggtgaacaaggtaataataacaatagcaataataaggtcatataaagataaataggcatggctaaataaaacagtgataacgcgggaatttaaataaagcgataatgcattaatttaaatcaaaataattttataaactgggattcaatatgttcaaggatgatgtgacttgccttgctcgctttcccaaatgtcggcttcaacctccactaagagcggatcttccgaagctgcagcgtctacacgaccaacggaaaagaaaaaggcttttactctaataaactccatataacaagcaggaacaaagcataaaaatgggttcttgacttcttaaggaaaaattagagacttgaacggtccaattccgagttcaaatggccaagttatggccatttgaagtttatatgctctttaaatagatatttgcgaatttctttatttaaattttaatttaaaaagggttcagccgaggggagagggcgcgcagaccgggtccacgggagtggggcccacgcggcaacctcacggtccacggtggaccaggtgcacccgggctcacaccggccggcgccgtgggtcccacgcgtcagccgcacccgagggcatgggcggctgacggccggaccccacgcggcagccactcggcgggaggcggcgcgcccacgccccgatggtcgccgccggcgaccaccggtgcggcgaagcggcggccgagagaggggagggaagggggaaaggaggcgacggtccacggctcaccccggggcgatggcggcgacggaggaggcggccggagcggagggaggcggtggcgcggcttgggtcgacggggacagcggcgctccggcggtcggcgaccgaaacggagaagtggacgaggtcggcgaggatgcggcgaaaccgaaggaggcggcgccgaggtgggaggcggtcccgggcgacgacggtcggcggaccggagctcagcggcgacggccgagagagagagcgacgtcgcgagctcgaatccggcaaggagaaaggcgggcgagaggcggaaacggacggaggaagcgcggggagggtttaaatagggccggggcgagagagggcggccggaaaagaaaggaaaccggcgcggcgttctcgggctccatcaatggcgccggcgggattaggagaggggtttccaaacgaatccaagggagagagggagggaaattttgggggaaagggagagggaatcacggggagcaattcccccc

SEQ ID NO: 35809 - DNA, 1402 bp, Oryza sativa
ttttggaggctttcacacagattttaattattctaggcataatttagaggatgtattttagggtcgttttgggacgtgacagacactaattttgaggccctcagcccattggcatcatggttgggcccatttcgactccaactcctttctaaaagatttaaattaagcaagggtgagtacaaacgtactcagcaagccaccactacagaatgcatttagtgcacacaggggttcaaggatggcttggtttatttgcttaaagcttgttttcacaattcatttcacaaacctacgacttagcagttttaactgaaaacaacgttaagttggagttgtcattaatcatcgagggttcatccaccttccccaagcctcgctaggtcaggtttaccctcgcattctgttttatatcctctttcatcatatcgaccttcccgcacagtgggcaaggtcagatagtttgttccatctctaatcttaagcaaggtcacatagtcaagagtagtacaagtcttggcactcattatccacgagcacgtctatccgaatagattggtttactcacagtgcagtggatgtacgcctttaatcccgcactctgtgacttgcccaacacatgggcctagacctaacacatgagactcgtcacggcccggcttttcagtcattctcacattgcggcacccgctccaaggactatgagcccccattgcatctcgatacaccaaccctacctcgagccagaagtgaggggagtcatggcactcccgagagcagggaatatttaacatatatatatacttatagggtgcattttaggtttttaccagtattttccaatcatcaacacttcaacaacaacactatactcgtacagaacctaccatgactggggtgtcgccccacgagaacttcctagtccatcgagtctctacccacttgttgatgtgaaaacacggcagcttgggagatctgctcaggtccaaagctagcctcgagtgcgtcaagggcgtgccaactgatttgatcctgcaatcagcaagaaagaataaaagcagaatcagtcgaccaatagccaatcggccgatagcgtatcgttgatggtctcagcagatagagttaaaccaaattggctatggactggatatatcaaagaataataaactctcaacacgcccaaaaggctataatactgtatatggagtttaatagattgatttaagacaacattatgaaagtagacgatgagataatatttagagcatgaaaaataaagtactagctaatactctagtacaaatctatataaacaaattaatccatataaacatatcaaatagaaatcaggcatgaagggcaggagtctagccgacactgtctaaagcttgatatgcttatataa

SEQ ID NO: 35810 - DNA, 2927 bp, Oryza sativa
  unsure (1)..(2927): unsure at all n locations
nnnnnnnnnnnnnnnnnnnnnnnnnnnnnnnnnnnnnnnnnnnnnnnnnnnnnnnnnnnnnnnnnnntatcgttgatggtctcagcagatagagttaaaccaaattggctatggactggatatatcaaagaataataaactctcaacacgcccaaaaggctataatactgtatatggagtttaatagattgatttaagacaacattatgaaagtagacgatgagataatatttagagcatgaaaaataaagtactagctaatactctagtacaaatctatataaacaaattaatccatataaacatatcaaatagaaatcaggcatgaagggcaggagtctagccgacactgtctaaagcttgatatgcttatataaaaggatctatctatataagtggggaatatacatgaaacagggagtgaaacatgcatattaggtaagattggctgaaaccccgatactatcgttattatgcctaattgcaggctagtttgcatggttctaagcacaactagggatgatgcatctcaaagtatgaaaaagaaacattcaatctagacaatcaagcaattagacacttttcaggatggtagatgcctcaactaatctcactcgccgcggtgtagcgtctgttgattaattgagataggggcaaattaatacttttctcgttgtttctctttcaatctgcactagatataataaaataaggggttcggtatccggtagctaattaccaggtttttgcggtatcctatagccaattcacgtatttgcagtgtctgacgggtaattacacatcttttaggtgtcctgtagcaaattttgccatcattattatgcctaattgcaggtgtttgcatggttctaagcacaactagggatgatgcatctcaaagtatgaaaagaaacatgcagtctagacaatcaagcaattagacacttttcaggatagtaaatgcctcatctaatctaatctagcatgccaatttaaccgaaaccaacataaaccctcaagcgagcagcagccaatagagctaaattgagaaggtaagattagattaactaagacatgctagcaaagactcgcgatatcgagcctaacacgtctaaagcgacatgttagccctgatagcgcaggccattgagacgggttacctcttgcgaagaactcgctagaaaacgagaaaaataaacgggtggcgatgcgtcgtagttgtgttggattggctctcctattacaatgctatggggttcatatttatgctccgagtacaaacttagtccattatggacacgactcaatcatttctaaagttaagatacaaacaagaccatatacagcagtctcttaccaaatctctaacaaaccgactcaatattctaactaatagatacaattgccttaattgagctctatctcttattggcaatggcaattatcccaatctaggcccatgctgagcccaagttatgttatatcggctgtattggctatcggcttcatcaaccttgatcaacttcatactttgttttctaccgatacggtattcagctgatgcacagtccaactccaagttcagttcaattcaattaccaaattcacttcgatcttcttccttctactctgaatctgatgacaaattccattgttaacacatgccccccccccaatttctgtttcagtagaaacatatccctttaggaaaatatatgtttggatcagtttatcaaacgctttagtctgcaacttgcaacatcttgaaagatgaggcaatcaactatggaggcccttggtggtttgtgcaattatggatcaatatgtataaaaggttagcagtagacatatcatcactagccttatatcagctttcccaacaattcatgctgatggtgaagaggctaacacaaggagatatatgtcttttggagaagcagttattgtatatcctggagagaaccaatcggttgatggcttcaaagactggttcttcatattctactagtgagcgtgcacgtgcaaggcacatttttcaccatttatgatcttctcaagctgaatttatcaattgtgtcaaattagaatcttaagatccatctaacatatgttgtttgtttccatctaaaatgttaatggaaaaaatagaatgtgccgtttccatctcaatttcaaaatagaaacataaaataaatactgagctcgtcttacctagcatgactcaaacctatcctatctttttgttattttctattttacaaatttttatgttgttttcaagtttataggatgcaattggaaagagaaatatacaatgtgatacaagttatctcagtggggggagagatgtctctacccccccccctcaagcttggctttcgctcaggatccttggtaaggattgaatcgctgaaagcggaaatatgcttgaaggtcatcatgctgttgctgcgtcatgttgttgatgttggcaaattgagcatcagcagtctgttgccattcttgcgtctgtgctatgtgttccatgaggttgtattagatctctcccgtttgcacattcaccattctcctagtgatttcacccaagtcccaacgagaggaacttgagcgccattcacctggagatggaggcataccacttgatctagggggttggttgtgcccccactgtatgtcatgaggcacattgtcgcgtcccaaaatgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaa

SEQ ID NO: 35811 - DNA, 633 bp, Oryza sativa
caatatggctattgcagaatctttcttggatggttgtcctgacccaaagaaattgcttgaaattctaggcaatgttaaggttagtgaatttgcattagtttgtttgacttttgatgttcatatttccattgaggctatgtactagaaatatccattcttttgtcagtagagaactctacagctaagttactgtttgtacaggagtttctgattttttttgggtgaaatttctgttttccaaatgtacctaaaattttcttggcaacaataattcaaacctaaaactatgtttactttttttttcttatataaattcattccaattgtaaatttggttatacaagaaatgatataattttgatgtttgtcactttagtccaatcatttagttagtgtcaattatatgttactaactatacttagttctcaaaaggacagtcttcttgttctgccctgttttccttcatccattcgccgggggtcttatcattttgcacaactcatctatgtttcagttccaatttcaaatttgttcttttccttcttctgggttgatgaagatatttgtcacatgctacatgcacgaaaatttattttggtttgggtataggaaaccttaacatctacatttta

SEQ ID NO: 35812 - DNA, 542 bp, Oryza sativa
  unsure (1)..(542): unsure at all n locations
nnnnnnnnnnnnnnnnnnnnnnnnnnnnnnnnnnnnnnnnnnnnnnnnnnnnnnnnnnnntatggttgctttccttgtaatagcttattttaagcaatggaatagtctggaaaagctgtcaattcagcagcaccaaacaagaccgtgttcctctgttcgcatgagttttttttttgtgtgtgtgttggccgtgatctcatcggcgacgtggtttacatcgtctctccggcgtgattatgacatagaacaccacctaaggttggtactactgcaaacaatcgacaaatggctcaccgcttgaacaggaatcgacgacgggggggctaggtcggagtcggagaaggcggtggtcgatctccctcctcgctgcatagatccgtgagattcttggggcattttgtagaagacgatgaggcaaaatcagtggcgcagcaactcagccggattcagcttaaggcgacgggaatggcgacatgatcccacggctgcgctttgacgacggtgtggccacgctgggtaccgagctcgaattcgccctatag

SEQ ID NO: 35813 - DNA, 752 bp, Oryza sativa
  unsure (1)..(752): unsure at all n locations
gttcttgctggtctagtggaagtatcattggtacatgtgtcccgtcaatagagccaacacaattctatacaaatacaaatatacccttgattaagtctttttatgtacaatgattggtttaactcaaagtaaaaaaaaaatcaaaacatgaatctgttcatacctcaaaaaaggggtgaaattttggtcttctcaagatatgatgggggtgtaggaaaggtggccgtatatatacacatgtaagttgtgtaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatccacaacaaataataaatctgatggtttggtnnnnnnnnnnnnnnnnnnnnnnnnnnnnnnnnnnnnnnnnnnnnnnnnnnnnnn

SEQ ID NO: 35814 - DNA, 1004 bp, Oryza sativa
  unsure (1)..(1004): unsure at all n locations
nnnnnnnnnnnnnnnnnnnnnnnnnnnnnnnnnnnnnnnnnnnnnnnnnnnnnnttttagattcaccttgttcatcaaaaaggtaggggggcatgtgtttacactcaaatttggcacctaggaataaaatagggaaagttgccaaagtttggaagtctactggtgttttcctctggaggacggtctgaccgccgtgtataggcctgtcagaccaccgcttgaactccggtcagacaagtggtgtgtggtcggtctgaccggcagagtccaagtccaggactgtttcgtcgggtcacgaggtttccttgctcgggaaggcatatttcgggtttcctttggattctatcccgagttggacgtggaggagggcctatagagggcaagaccaacctatatttaagggacatggccggttcattgtaaaaatcaatcaactatcaatcaatcgaatcgttcttttacttttgcttctagttctagtttagtttgtccatctttgtcgatttgcgccgtaactcgtccgacgccgctgcgagattgcgacacctctttgtaggtttgtcctgaaaaccttcccacgagacgagtagctatccatcgttctacctagaatcggctccgctagccggtttagttatcaaaacccatcttggtttagctttggctagattgaggtggttggcgactctgagatcgccgcaaggcgtttaggtgctgcgatcgtgcttgtcaacttgtcacaaaaagttgccaacaactgcgccctacagctcgcagcagaatggcgtcgtcgagcgccgaaacgacatggtggtggtgacgacaaggagcatgctcaagttgaagggactgcccggatggttctagggagaggcggtaagcacagctgtgtatgtgctgaacaggtgttcgaccaagagcgtggacggcatgatccccttcgagacgtggcacaagaaagaagccggcagtacaccacctgcagatgttcggctgcatcatct

SEQ ID NO: 35815 - DNA, 1186 bp, Oryza sativa
  unsure (1)..(1186): unsure at all n locations
nnnnnnnnnnnnnnnnnnnnnnnnnnnnnnnnnnnnnnnnntactcttgtctatggctaggatgggttggaaactatgtcacgtcttccgtctgtataccgtggtggtatgtggcacgtggttacacgtgaggaagatgtgtcttgtaggtaaagatgtacacctctgatcagagtataacctattcgaatagccgcgccctcggttatgggcaagccgagcaatgtacccaagttagtgtttttaattcttcaaacctgcttaacaactaaaatgtggaatggttggcctgggttggcttgggacgagctgggacccaaggtcgggttgccagttcggtctgaatcatcgtaggccttgggttaaggcaggttcgtgtgggttcacggccttgattaataatattgtatagctctaggaccgtatttacaaaatagctttgagcaactaagtgtcttttaatgctgtttactgcaaaccctaaccccctatattataactcccttgtactcccttacatttattctgcacttgtgggtgtgtcttgttgagaacggtggttgtactcagtcttgctcaatttttcccaaagccagaagaggagttcctggaagatgaaggctttggtgtctagctcgtgcctgccgtcaagcgcctgtggtcgtcgccctagtcttccgctgtttttcgtttgtcttcctgtgtgctgggccttcgccgcccatgtaataaattaattgtttaagcttccgcttgttaaactctgtattgtatcaacttttggtgtaccttgcctcctgggacaaggaataatacacgcatgtaaggaacgcccattgggttatttccagtcgtgacagtgtccacgaggaagaatgggtccaacggagccttcccgggttcggccgaaccaccaatttggccgaaccacttctgaggccgttgatcacgagattcgacgtggacggccttgattacttcctgatggcggttccagggtagtttcgtcatttcgcataggctgtaaccgtcatacctgcctataataggaggagctcactctcatttccaagaggctctattgtatcttttgtatattaaaataaggaagagagtgaggggaagctctggaggagtgcccggaagtttggcgctcatccgacttctactttgacgagtgtagctt

SEQ ID NO: 35816 - DNA, 636 bp, Oryza sativa
  unsure (1)..(636): unsure at all n locations
nnnnnnnnnnnnnnnnnnnnnnnnnnnnnnnnnnnnnnnatcgagcccaacgacgtacttgaggacctccccacttggtgaagtcagagtgactccggcccctgcacctttaaggttgagggagccgccaaaatgcataacccagtgcccagcacgaatgtcggcgtttgggtcctctccatctccggagagggagggaacgttggacggaacagggtcctccactggggtccactcccccatgaagtgagacaggacctggcttttgatcgcctgccatggttcgaaatgcaagtcgtactcaacaagctcgatggaccactttacgaccccgccagtaccctctcggttgtgcaagatttggccgctagggtaggacgtcactacggaaacccgatgtgcttggaagtagaggcgcaatttccttgtggccattaagactgcgtaaagcatcttctgggcctatgggtattggggattcacattccggagtgcctcggttacaaagtagacgggccgttgcacctttcagaggggacggtccttgttgtcaggggcaagagaccccgtgtgcccttgctcatatgccccacggggggctcgggtcatgtcaagactatatgcctctggaccacc

SEQ ID NO: 35817 - DNA, 588 bp, Oryza sativa
ggagcctctttttttgcttccataagccatttttcatatggagggttggataaagagctgcttgggatgctctaagtacctgtgtgggtaaggactgatcacccgttacttgggtaggggacagtcgttgttgagcagtgtacaaccatctgtgatgagaaataaattaataaataagttaatgatagatactcctaataatagtgattataataataataatcttattaattagcgtctaacactcataatgaccgtccaccctcaagcacagggtgaccaaattaggcggcccatttggtcatgaacgccatctttagtaacaaagagcttatgtggacaccataaccggatcatgccggatcaaactcggtttatttaaatttttagaggcactatgagcaacttccataaaatggcccaataagtggctcagatgaattttaggaattcttataaaaaatcgtgctcctagagactctctaactggatggccaagacataccgatggataaaactgagatgccgctagacaaaattattcagtaaagtccgctggtcattcgatcatgcagtgggacccatgtt

SEQ ID NO: 35818 - DNA, 622 bp, Oryza sativa
atatatatatatatatatatatatatatatatatatatatatatatatatatatatagttagcacatttctttggtgcaccatggtgcccaggctccatggccatccacaatccaaatgctttaagatctgtgcaatgcactataggatactataacctattagcgggtctaacacgataagatattgcatgcatatactttccatagaacatgcatgcaggtaatttccatttcgaagtataacgtgcttgtgtttccaaaattgatgcccaccaattatgattagtactttccaacatcaatgccttggtgtggaatgaaacactttgagtgattcgagagaatcaattgaggagtacagtaaaagtttataaacatcaaagaaaaccccaaggtggtagacacttcaaggttcacagacacatgtatatcttgaaatattttgcgtgtcatatcattgagcagaaagtcattactctagtcgacccatgagctttactcggggatgagtaatggataactgtgggggtgttgttgacggtcgttaagtacaaactttaatcgtcaagtcctgcataagaaacgtcaaatataataccaaaacttagtggtaggagttta

SEQ ID NO: 35819 - DNA, 479 bp, Oryza sativa
  unsure (1)..(479): unsure at all n locations
acacggcggcgggcgccaattgaacattgccgaatcgttgacatgcttcgcatcccctataatatttgaagcaatcttcaatcatcctcggccaatagaaccccgctctcctaagcaaccgattgatgagttccacaaattccttcatgtacctctcccaaagccactttagatgtatgctttcagctacacagtactccacgaactcgatcgaggtgaattcacctccgcgatcagtacagagtcccttgagctttcgtccggattcgccttctgcacacgcctgggtgtccttgacggcagccgctgcacaatcctttgaaggaatcgcggctacccacatgtatcggctaaggtcgtccaccaacagcaggaaatacttgttcccccatggtgtcgccggcgtgattggaccgcacaagtcgccgtgcaccagctnnnnnnnnnnnnnnnnnnnnnnnnnnnnnnnnnnnnnnnnn

SEQ ID NO: 35820 - DNA, 540 bp, Oryza sativa
  unsure (1)..(540): unsure at all n locations
aagtcgccgtgcacaagctccaacagctgtcgtgcacggtactcggcctgcacaggaaacaaggtacgtcgttgtttcccggcttggcacgcctcgcacagctgctcgagctgcccgatctccagcgatccctgcaccaactcctcccaggctagcttccgtagcgctgccatgttgacgtctccgaagcgctcatgccagcaccatgccacctcgtcaccatgcccatgcagcgccaggcacgacggctatgccaacttgatgtggagcatgtacagccagtttgccgtgcgctttaccttcgccagcaaccgttggtagggctcccgaatccacatcacgctgtcatcgatgtcgaccttgcaccgggcctcatcgagctacccgacgctcacatgttcgtcgtcaatcgtgggatatagtagatgtcagagaacgatcggagctctccattcttgcacacaaacacgatgnnnnnnnnnnnnnnnnnnnnnnnnnnnnnnnnnnnnnnnnnnnnnnnnnnnnnnnnnnnnnnnnnnn

SEQ ID NO: 35821 - DNA, 1869 bp, Oryza sativa
aaatccgagcgaatccgatgaaaagagagagggaaaagagggggaaagagggagggaatcacggggagtgatttccccctctttatggcgcgcggggacggcgggatgcggcggattcggcggcggcggcggcgctagggcacgggcgggcggcgggcgcggcgcgaggtaggcgatgacaggtgggccccacccgtcagcgagggtggcgggcgggcccgcctgtcggcggcgcgcgcgcggggaggaggccgatgggccgcgggggagaggagagagagggagggagttgggccgagccggcccaagagggaaagggggggggaaagaagacttttagggattttctttttataaaacctttttaactttgtttatttcttctcaattattatttgctctgaaaattccactaaaatttatttacgcattttaggcttttaggaaatatacaaaaatcctccaagccttatttgacttttaaatttgcacattttaattgttgaaggctttcacatgaattttaattattctcagcacgatttcgaggatgtattttagagtcgatttgggacgcgacaaacctaccccccttaaacggaatctcgaccccgagattcggaagaactggcgaagagaccgggatgggctgccttcagctcgtcttcacgctcccaagtagcttcttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaacgatacggaaaggacccacataccgaggtgcgagcttccctttcgtctgaaacctgtgtacacctcgcaatggcgtgacccgaaggtacacaaagtcatccactgcgaattccaagtcacggcgacggttatctgcataacttttctgccgggactgtgccacctttagattatcccgaatgattctgactttagcttcagcttctctcaggatatcagtcccgaacacttggctttctccaacttggtcccacaatagcggtgtccgccatttgcgcccgtacaacgcttcataaggtgccatttgtatgctggcttgatagctgttattgtaggagaactcggcataggggagactcttatcccaggtcttcccgaaatctagtacacatgcacgaagcatgtcttctaggatctgatttagacgctcggtctgcccatctgtctgcgggtgataggcggtgctgaaatttaatcgagtacccagctcttcttggagcttcttccaaaagtgagaggtgaattggcttcccctatcagatacgattttcttgggaacgccatggagactcacgatcctagcgaagtagagctccgctagtttgttccctccataggtggtcttcacaggaataaatcgagctaccttggttgggggtgcaaagaaaacaactggttgttccggccctcggtacagagtaacagtgcgtctcgcgcaatccactactccttggaattgagccaaccaattcatcccaagaatcacatccaaattcttggtgtctagcagaatcagatccgagggaaaaggaatcccctgaatttctatagggacggcagggctataatactttgctgtcataacccctccaggggtggtgatgagcagagggtttctaagcctttctacccccaactgatttctc

SEQ ID NO: 35822 - DNA, 6951 bp, Oryza sativa
  unsure (1)..(6951): unsure at all n locations
gcgcccgtacaacgcttcataaggatccatttgtatgctggcttgatagctgttattgtaggagaactcggcataggggagactcttatcccaggtcttcccgaaatctagtacacatgcgcggagcatatcttctaggatctgatttagacactcggtctgtccatctgtctgcgggtgataggcggtgctgaaattcaatcgagtacccaggtcttcttggagcttcttccaaaagtgagaggtgaattggcttcccctatcagatacgaatttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgttggcacacatcacatagggccacaaactctgcaatttcccgcttcatgctaacccaccagtatttctccttcaagtctaagtacatctttgtactgcccgggtgaatggaataagggctctcgtgagcttcctgaagtatcaactgtttaagttctctgttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacgactaactatgcttagattcagggcttccatctgttgactaagttcgggtggaatgccacggacgttaagagtgttgcaatggctctttcgacttagagcgtcggcaaccacgttggccttaccaggatgatagtgaattcccacatcatagtctttgataagttctaaccatctcctttgccgaagattcagatccgactgggtgaagatgtatttcaaactcttatggtcggtatatatttcacagcgatttccaatgagatagtgccgccagatttttagagcatgaaccaccgcggctaactccaagtcatgtgtagggtagttgccttcatgaggtcgtagctgacgtgaggcataggctactacatgaccgtcctgcatgagcacgcaccccaatccttggcgcgaagcgtcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattttggagaagttctcgatgaatctccggtagtatcctgccaaacctaagaaactgcggacttgagtaactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgagtgtgagtatatcagaatgtcatcaatgaaaaccacaacaaacttatccaagtattccatgaacactttgttcattaagttcatgaagaaggcaggtgcattggttagaccgaatgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctctacaaaaatcacaggagcaccccatggggaagtactcggacgtatgtatcccttttctttcaactcttccaactgtttctttacttcggccagttcatttgctgccatacggtagggtcgcttgtgcagaggagtggttcctggagcaagatctatccggaactcaatctctcgtttgggcggcataccgggtagttcttccggaaacacatctccgaactccctgacgatggggatttctgacagtcctatctgatgaagttctgaacttctgatagaggttgagggtgcaaagaaaacaactggttgtgccggccctcggtacagagtaacagtgcgtctcgcgcaatccactactccttggaattgagccaaccaattcatcccaaggatcacatccaaattcttggtgtctagcaaaatcagatccgagggaaaaggaatcccctgaatttctatagggacggcagggctataatactttgctgtcataacccctccaggggtggtgatgagcagagggttcctaagcctttctacccccaactgatttctccccacgaatggcacaaatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttcttggagcggggaggcgcttggccttgctgacgccttggtttcgggcatttatccgcaaagtgcccgggctcgaagcagttgaagcacagacgctgctgaccttgagcgtccctgcggccttgaccagactgcacagttggcgtaggaggatggggtgcacgagtcccctgctgattctgctgttgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagctccttgtgcttggcttccaagcggatgctcttgtccaccaatcgttgaaaatccggatagtccccagagactagacggacggacagctcagggtccattcctgccaagaacttctcttgcttctcctcatcttcccgcacatcctccggagcgtaacgggccaggttgttgaactcatgcaaatactccatcacggagcggttgccttgcttcaactctcggaattcccttttcttaagggccacgactccagcgggcacatgggtccttcggaaagcggcggtgaagcgagcccaagtaatcggttgtccctctggctgcgtagcctggaagtggtcccaccatagagatgcgggtccctgcagttggtgggcggcgaagatgactttctcctcatcgctgcactgcaccgtgtctagctttttccccacggcatgcaaccaatccaacgcatccacggggttgttggagcttgagaaggtaggtgggcggatgcggaggaactcggcgagtttagagtgttgtgggggtggtggtggagcattatgttgtggcggattttggaggtggtggaggaaagcagtcatcatgttggcttgctgggcgaggatttgggtgagaatggcgttggtgtctggtggtggtggcggagccggaggagtaggtggaggtgggttgccctggtggttgtggttgctgctttcgggttggttgccatcaccggtgttagcatttctcctggtcgtcaccatctgaaaaccccacacagaaccagcaaacagagaaagagctaacaattaaaactaaccacccacgactaccataattcttaaatttattactgctattaaattggttcattaatgttcaagttgcttaggcaaataaaataagacaggctccgacacagttataccacacaccggcataaccatgccccacacgactcaaaaaaagacaaacaagaaagaacacacgcgcaaacctactaactgctcgtctactgctgcgacgggccaggacggaaggtgagcaacagcgcaccctccgtgctaccaacgccggaggcttccccctcctggggaaccacgggcgcgggctcggcacgaggggtctccacgaagcaggtccacgccagggactgacgaacaagctcgggcctggaggtgctcttgcgggcggtgatcttctggctgcggcagacacggcgacgcttggggcggcagacctctccctgggcgatcttaagctgatgcagctgcgcctccaccgcatctaggtccttcttgagctgcaggttctcctgacgcagctccaggatcttcatgttgttctcaaccatcccgcgacgcaccatctgatggaagtcgatacgagccgcgtcgtacgcctccaccatgcgcgccaggtgcacgatggtagcgtcatcctccgagctagcatcccggaaggtggcgtagtcgcaggctcctccgtgacgagggtggtagcggtagggcgagtgctgcaactcgtctgggtagcgctggtgaagggtgccgatggcgaggagagcggcgttctggcaagcggcggggaaggagtctccacccgcggtgactgtcagcgaagtccgctcgggagagccagcgaggatcactgcagtgacctcccaaccagcgtggggctctgcatcgtcaccctcctgatccggaagcggcctggcctggtagtccactccatgtggataccccaaggccacgcacatgccccgcagctccaagacgaaaccagtcatgtccaaaccacgacgggtgacgctgccggccatctacaaacaaaaacaaaaagagaaacaacattttaaagatcagattttgacgataaatgaagcagcaagacagagagagactagacagttttcacaaataacaaaggatttttatttttgaaaatattgctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaggctaatttgtaaacgcgatcctagaactatacaatattattaatcaaggccgtgaacccacacgaacctgccttaacccaaggcctatgatgattcagaccgaactggcaacccgaccctgggtcccagctcgtcccaagccaatccaggccaaccattccacattttagttgttaagcaggttttaggaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaagaaccaaaccattctaaaggatccaggtgatatgaatatttcccaaagtctatagttgaaaaaccacctaatgttacctaattaaattgcgaagcatctacctaaaattaaactagtggtgccatgagtagagtgtccactagttgaggttttgtttaatctagggtgaacaaggtaataataataacaataacaataataatatggtcataacaaaggtaaataggcatggctaaataaaacagtgataacgcgggaatttaaatgaagcgataatgcaataatttaaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagttatggccatttgagtttatagttnnnnnnnnnnnnnnnnnnnnnnnnnnnnnnnnnnnnnn

SEQ ID NO: 35823 - DNA, 2012 bp, Oryza sativa
aaaaaggaaggaagtttggcccgagccggcccaagagggaaagggggggggaaaagaagacttttagggattttctttttataaaacctttttaactttgtttatttcttctcaattattatttgctctgaaaattccactaaaatttatttacgcattttaggcttttaggaaatatacaaaaatcctccaagccttatttgacttttaaatttgcacattttaattgttgaaggctttcacatgaattttaattattctcagcacgatttcgaggatgtattttagagtcgatttgggacgcgacaattatcttttcggtactcgtacagaggtgtataccaatcacaagagtttaaagtatatctttactcagccagatctggacatgagacaaaggagatggttggaattaattaaggattatgacatgggaattcattatcacccgggaaaggctaatgttgtagcagacgctcttagcaggaaaggctattgcaatgctacagaaggacgacagttgccattggaattatgcaaggaatttgaaagattaaatttgggaattgtcagtagaggtttcgttgcagccttagaagcgaagcccactctaattgatcaagttagagaagcccaaattaatgattctgatattcaagaaatcaagaagaatatgagaagaggaaaagctattggtttcttggaggatgagcacggaactgtatggttgggcgagagaatctgtgtccccgacaacaaagatttaaaagatgcaattctgaaagaagcccatgatactttatactctattcaccctggtagtacaaaaatgtaccaggatctcaaggaaagattttggtgggcaagtatgaagcgtgaaatcgcagaatacgtagcagtatgtgatgtttgtcaacgagtcaaggcagaacatcagaaacctgccagtttgctgcagcctttgaagattcctgaatggaaatgggaagaaatcggtatggattttatcactggtttgcccagaacgtcatctggccatgactctatttgggtaatagtcgacagacttaccaaggtggcacatttcattccggtaaagacaacttattccggaagtcgcttagcggaattgtatatggcaaggattgtgtgtttgcatggcgtccctaagaagatagtgtctgatcgaggaagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagatttcggtggaagttgggataagaatctaccttatgcagaattttcgtataataacagttatcaagctagtcttcagatggctccgtacgaagcactgtatggtcggaagtgccgcactccgcttttgtgggatcaaacgggagaacgtcaggttttcgggacagatatcctaagggaagcagaagaaaaggtgaaaatcattcaagaaagattgcgtgtggcttagtctcgtcataagagttatgccgacaatcgccgcagagatttgagttttgaagagggagattatgtgtatattcgtgtcacacctcttcgaggagttcatcgttttcataccaaaggaaaattggcaccgcgttttgtgggaccttataagattgtcagtagaagaggagaggttgcttatcagttagagttacctcaatctttggcaggagtccatgatgttttccatgtgtcgcaattgaagaagtgtttaagggtacctaccgaagaagctaatcttgaacagatagaagtccaagaggatctgacctatgttgagaaaccaatccgtatcttggaaacaaatgagagaaggaccaggaatcgagttatccgtttttgcaaagtccaatggagtaatcactcggaagaagagtcaacttgggaacgagaagatgaattgaagt

SEQ ID NO: 35824 - DNA, 1369 bp, Oryza sativa
  unsure (1)..(1369): unsure at all n locations
ttttctgggatttatttgagctaaggaagtatttttaataaatggaattgcatttaagaaataatttaaattgaaaaaggttttaaaaagttctcttttggctttgggccgaaagtcggcccaaaaccttctctctctctccccggcccaagtcggcccagttcgcagccgcccacgcgcgcgcgcgcgttcagtcgctgacaggtgggtccgtcgtcttcctcgggccgaaaccctagcgcgccgccgccgagctgccgccgccgttcctttccaaatccggccgttcctttccgtttccggtgaaattgattgaggggaaacaatctccgggatctcctctaccttttgtcctgtggaatcatcggctaaatcggtttggaaatcgagggattcgagttcgaatcggatcgggctctctctctccaagccgagctttccttcgccgttgccgtcgccgtgggccttcgccgccgcctccgagtccctttaaaaggctccccggtgtctcctctacccgccgccaccctcgccttcgcctcttgtcgccggaaaagctctagcaccgtgtgccctagcgccgccgtcgtcaccgtcgctccagccgtgcgccgccgtcgctccagccgtcgccgtcgctcgggaaggccgacgtcgtgttcgccgtcgcgtcgccgtcctcgtcctccccttcgccaccgccgaagaccgccggagcgtcatcgccgtcgtcgacccgaagagcttcgccgcttcctcctcgtcgccgtcgccgtccgttgatcttccgccgtcgttttggtcgccggtgagttcgccgtggcccgcttcgtcctggtgctttccgttttcgtcctcgcgccgccgttcgccggcgagcgtgcgccgcccgagccgtccgccccgccgagccgccgccgccgtcggtgacgtcattgccgacgtcatcggggtcgtccgccgtgagccgccgtggacccgatcgatctcggccgtccgtttggattggatcgaatctcggccgtccgttcgcgtgaaccgccgcccgtgcgcccggtccaccgcaaaccctagcccgctgacgcaataaaccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttgttgaattnnnnnnnnnnnnnnnnnnnnnnnnnnnnnnnnnnnnnnnnnnnnnnnnnnnnnnnnn

SEQ ID NO: 35825 - DNA, 1954 bp, Oryza sativa
atggggagtgatttccccctctttattgcgcgcggggacggcgggaggcggcgggattcgcggcggcggcggcgctagggcacgggcaaggcggcgggagcggcgcgaggtaggggatgacgggtgggccccacccgtcagcgagggtggcgggcgggcccgcccgtcagcggcgcgcgcggggagggggccgattgggccgcgggggacaggagagagaaagggagggaagtgggccgagccggcccaagaggggaaggggggggggaaaaagactttttagggtttttctttttataaaacccttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcataattttgaggatgtattttagagtcgtttcgggacgcgacatctaagcagcggaaaataaaataaacggcgcagacggctccactccacaggcaacttgaccagggctacacctaatcctccacaccatcagcatcattgtagaactcttcctctgatgaatgatcgcaaggtgagtatatgacatactcagcaagccacgcagcaaatatgcaagtgcacaggataacaaaggatcgcataatagggtttcatttgcaaaagcagcatttagcaaacatttgagaatttaataaaacagttaagtaataattaaacaatattaatccaacactatacaacatacccggctgtacagatctatctccaaaccaggaatataccattccaaaccaggagctaaacaaattattaccagttatagtatcttgcattatgatgagaggtgtgagacaaatcacgaaagacattgttagaccccgccataacccggggcacgggtattcgaataagtttactctgattagaggtgtactactgtacccacaagacacacgcccacatcatgtaccatgtgcctcaataccaccacggtacctcggaaaggagttgtgacaataccccttatacaacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggctaatgtttcacaaccgaaactcgtgaaccggtccttaattgtcatgagcacgaccatcaaaaccatatgctcacaacccaccattatcaggttttagttggcacattaattaattaaccaatcacgattgaccatcgtgaactatcattaagccatcattaaataaaagtgaatcataagttatcccaatagtgtgctaatgtttctaagcagggctaagcaatcatatctaatatctagctgaaccaatatatatagcccaactagtcaaattttaataacccgaggtatcaaggagtaaagtaatcaagaacaaaaagggctataacaaacaataggttaattccacccaatgacattcgtaaatagatgcaatagttgaatagaaacaacagctttaaataggatcaacatgctcaaagggttgttcgggatctgtgtgacttgccttgctggccttggaactcttcaaactcttctcctgcgaaaacggactctccggaaacgtcggaatctaaacagaaagaagcaaaaacaccaaaacaatacataaacaagcatgaactgtacatgtggatatttttaacatgtagatctcaattttaaaaaaatttagagacttgaaccaactaaatccgagctaagatgaattagttatgat

SEQ ID NO: 35826 - DNA, 1093 bp, Oryza sativa
gttcgggaaaaatgaatccgagacgaactcgaatccctcgatttccaaaccgatttagccgatgattccaaaggagaaaaggtagaggagatcccggagagtgtttcccctctatcaattcggccggaaacggaaaggggcggccggatttggaaggaaacggcggcggcggctcggcggcggcgcgctagggtttcggcccgaggaagacgacgggcctgacaggtgggacccacctgtcagcgaccgaacacgcgcgcgcggcgcgggcggctacgaactgggccggactgggccgagggaaagagagagaggaagcggttttgggccgactttcggcccaaagccaaaagaggacttttttaaaacctttttcaatttaaattatttcttaaatgcaatttcatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtccttctctcatttgtttccaagatacggattggtttctcaacataggtcagatcctcttggacttctatctgttcaagattagcttcttcggtaggtacccttaaacacttcttcaattgcgacacatggaaaacattatggactcctgccaaagattgaggtaactctaactgataagcaacctctcctcttctactgacaatcttataaggtcccacaaaacgcggtgccaattttcctttggtatgaaaacgatgaactcctcgaagaggtgtgacacgaagatacaccatatctcccttaggatacaa

SEQ ID NO: 35827 - DNA, 1393 bp, Oryza sativa
gccgtcgacccggggtgagccgtgaaccgcccatttcgtttccaccatccctcccctctctcggccgccgctccgccgtgcctatggccgccgccggcgaccatcggggcgcgggcgcgccgcctcccgtcggccgtgccggcgaggccgccttcgggcgcgccccgcgagctgccatgtgggcccggccgtcagccgcccgcgcccgcgggtgcggctgacgcgtgggacccacggcgccggccggcgtcagccgtgtgcacccggtccaccgtggaccgagaggctgacgcgtgggccccactcccgtggacccggtccgcgcgccctctccctcggctgacgcaataaatccggtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgcttcatttaaattcccgcgttatcactgttttatttagccatgcctatttacctttgttatgaccttattattattgttattgttattattaccttgttcaccctagattaaacaaaaccccaactagtggacactctactcatggtaccactagtataattttatgtagatgcttcgcaatttaattaggtaacattaggcggttttacaactctagactttgggaatattcatatcacctggacactttggaatggtttggttattgtggaaatggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgagctgcggcccggtagtcgagatgtcatggcacagggccggtgtcctgctgtgtcacgcccggaatttctatccaaaattccaaacgcttacatgtgtgttaaaccctcgtccaggaatcaaccgagacacacaatgacaatattg

SEQ ID NO: 35828 - DNA, 386 bp, Oryza sativa
  unsure (1)..(386): unsure at all n locations
ccgacaatcatacgccgttcgatgaataccctcaaataaccgaagcggtgtgggaggaattctgctctctcaagaccttccaagagtttagggaatcaagcgaggcacatcgcctactacaacagcggaatgagcacccgcatcggctgggcaccgcagggtacatcggcaaggaggcaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35829 - DNA, 1433 bp, Oryza sativa
ccccctcggctgattcctggacgagggtttacacacatgtaagcgtttggaattttggatagaaattccgggcatgacaagttggtatcagagctcccttgaccctaggttatgccaaatggttacccatagaagccctctaaaaatattggaaaagtagaactattcttctccctttctcttttaattaaaccaaactaatggcacatgcacttcataatctcttttaatggttctcattcaaaatttattctagtgttattagtactgtacatctattactgtactaatggctcattttccagcaaaagttttacaatgttgtttcatttaatcttgctgcaataaaataaatttagcaagttgattttataactttcttttatttcttttggaacctgttattcaaaagtataaaacttgtaatattgtttctgacttttcaaacttatcttgcaaacttggtttactttatttatttaccttttactttgaatttctaaaattaatccaaaaacttgtgctattaattggatagatgtcttaactccctcctttcacttgtctttagatgccgcgctacaagcctgagtacttgtttggtgttgagggatttgtccaggagttgcgtacaatgtcctttgtcattggatttgggactgcccctttttatgcccagattcctcatgatcgtcatgaagagaggtgccgagtcaaagtcactttgaacagtagtagtgaagatattccatcggtgatgttcgaagctggaggaagaaactatatccacgcatgtcaggaggtggcaaggatcgccataggagagctccgtgatcgctacagtgatcagttggccgacactgagtatcgttaccatccccgccaaccccaggggagtgaccgtggcagttaccttgagactgaaggaattgagaatgatgttaccaccagacatttggttgagatgctgtgggctatggatgaaagtcgtgcggagactgtgttagtagctcaagatcgtgaagattggaatcgtggtaagatttgcaagctagaagacaaggtggatcgtttggagaaggaactagccgcgttgaagggagaagcaccgccgcagaaggccaagattcgtcttaccgcaaggaagagagctttatttgtcccacgctatcaattggcgccaaaggtccgtgtggtggagaaagaagtagccccagcggatcctccggtcgtcaatgtaagtgatgatgaaggagaagaatcgaagcgcacccattccaagatcgagtggggagcaactcaagatgatgaagacgagccgaacgagccttcaatcaactccgatgctcggaagaactagagtgccttgttaagccgttgtcttagatcgttgtgttagtttgcttgttttaaatttgcttgtgtgggtcttg

SEQ ID NO: 35830 - DNA, 1770 bp, Oryza sativa
  unsure (1)..(1770): unsure at all n locations
gcagaaggccaagatttgtcttaccgcaagaaagagagctttatttgtcccacgctatcaattggcgccaaaggtccgtgtggtggagaaagaagtagccccagcggatcctccggtcgtcaatgtaagtgatgatgaaggagaagaatcgaagcgcacccattccaagatcgagtggggagcaactcaagatgatgaagacgagccgaacgagccttcaatcaactccgatgctcggaagaactagagtgccttgttaagccgttgtcttagatcgttgtgttagtttgcttgttttaaatttgcttgtgtgggtcttgcatgtgatttacatcagtgatgggatgtaagtgcatgcgtttgtttgtttttttttttgagtgttaggaagttggtgagtttagtgttgtgagagtcttcagtttgtaataatgaaactcagttaagatcaataaaagttaaagtaattccctgtcctaagtagtttttccccggttcctcttcttgtgccctgtccatgccagatggtgaacactcgcagcaacgggaatggtcccaacctcaacaaccccaataacaacaacaatggagagaatccaacccttgctcaagttcttgcacaacagactcagttaatgaacatgatgatgcagcaacttcagaaccagcagaaccagggaaataaccatgcacctccccagaacaagctagcagaatttcttcgtgtgaggccgcctattttctctagtaccactaatcctgttgaagctagtgattggttgcatgccttagagaagaagttggatttgcttcagtgcactgatcaggagaaggtctcatttgcatcacatcagttgcatggccctgcctctgaatggtgggatcacttccgtctgaataggactactgctgaacctatcacttggcttgaattcaccgctgcttttcggaagacgcatataccatcgggagtggtgtctctcaagaagaaggagttcaggtcgctcacccagggatctcgctctgttacggagtatctacacgagttcaatcgtctagctcgttatgctccagaagatgtgcgcaatgatgaagagcgtcaggagaagttcttggaaggacttaatgatgagctttcttacccactcatgactggagattattctgatttccagaaattagtggataaggctattcgtcaggaggacaagtataatcgcatggagcagaagaaacgccggattgctcaattcaagatacaacaggggaataatcagaagccgcgtcttacttttgtaccccagtccatgccacatggaggttcttcatctgttgttcgtccgcagcgtcagttcttcaacaacaatgctggcaacaacatccgcaatcaagctccacgtcctgttgcagctccaacacaacaaccgcctgccaagagggagcaaggcagcaagcccgtggtgtgtttcaactatggagacccaggacattatgctgacaagtgtccaaagccccgacgcgtgaaggttgtccctgcctagagcaactctactataccagcatcaaaggcccgtgtcaatcatgttgcagctgcagaagctcaagacgctccagatgtgattttgggtacgttccctgttaactcagttcatgcaacagtgcttttcgattctggtgctacacattcatttctatctatgagttttgcgggaaatcatgggatggaagtagaagatctnnnnnnnnnnnnnnnnnnnnnnnnnnnnnnnn

SEQ ID NO: 35831 - DNA, 1047 bp, Oryza sativa
aattgattgcaaatgggtatataaaattaaaagaaaagcagatggttctttagacagatataaagcaaggttggtagccaagggcttcagacaaaggtatggtatagactatgaggatactttcagtccagtagttaaaattgcaacaattagacttgttcttggtattgctgtctctagaggatggtcactaagacaattagatgttcagaatgcctttttgcatggtattctagaagaagaggtttatatgaaacaaccaccagggtatgaaggtaaatcaaccttagtttgcaaacttgataaggccatctatggattgaaacaaccacctagagcctggtactctaggttgagtcacaagttatttgaactaggttttacttcgtcaaaggcggatacttccctgttcatttataataaaaatggaataactatgtatatgttaatttatgtggacgacattattgtcacaagttcctcaagtgatgcagtcatagccttgcttaagaacctaaggtctgattttgccttaaaggacttgggtgagctacattatttcttgggaatagaggtgaagaaagtttctgatggtatactgttgaatcaagcaaagtatgccttagacttgctaactaaagttggtatgaaagattgcaaatcagcttccacgccgctagctgtgacagagaagttgatggcacacaaaggaaatcctcttggtactgaggacagtactcggtacaggagtattgtaggaggactacaatacttaacactcaccagaccggatttggcgtttgctgttaataaggtatgtcaatatcttcatgctcctacttcagaacatttgtcggctgtaaaacgtatactcagatatatcaatggaactgttgatgttggtctgcactttaagaggtctagttctactctagtcagtgccttttctgatgctgattgggctggtagtctagatgacagaaggtctacaggagggtttgtaatttactttggacctaatattgtgtcatggagtgctaggaaaca

SEQ ID NO: 35832 - DNA, 2020 bp, Oryza sativa
gctaaaagctgcttttgcaaatgaaaccctattatgccatcctttgttatcctatgcacttgcatatttgctgcgtggcttgctgagtatgtcatatactcaccttgcaattattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacagctaggaggcgacgacgaaggcccatggcggccggcgacgagatggaaagctcgagctcgaagagagaaaaaccgatccaattcgaactcgaatccaccgatttccaaaccgatttagccgatgtttccaaaggagaaaaggtagaggagatcccgaagatcatttcccctctatcaattcggccggagaaggaaatgggcggccggatttggaaaggaacggcagcggcgcgaaactagggtttcgggcggcggcggcgcgacgaagacaacgaccctgacaggtggggcccacctgtcagcgggagagagagagaggagagcggcggctcggactgggccggctgggccgaggagagagagaagggttttgggccaactttcggcccaaagccaaaagaggacttttaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaaggcttttaaaatcatttctaaaaattccaattaaacaacaatttatatatttaggatttttagggtgtgacataaggttattgaaaggctttgccgtgacgcgtctcctgtgttgggacgaggctcatgtgttgggcagtcatggatgtcacatcctgattttcgcctcaggatttataaattatttaataaattaataatagaatttatattaaatgttcatcaatttacaagtgaagttaaatgcgggaaataaaatttcctaaataaaaagcatggatggatttaattcttattaaattctccatggttaattatactctctggaatattctcggatttttcggagctcaattattaattttaatcatacaaagagaagttcagcaattatttaaatattaaattaatcatataatgatctaattataattgttaagtgcttttcctgtttaaaatccttaaattataaattgttgtttaaaaggaattaatagaaatgattttaaaagtttaaaagagaagatcttttcttttaatttgctaaagttcaatataaaattgggttagataaaattttattaaacactttgcttgttcctctattttctagatttttctgggaattatttgagcaagggaagtatttttaataaatgaaacaacatttcacgaattattttaattgaaaaagttttaaaaatcctctcttaggccgttgggccgatttcggcccaactctctctttcctctctctccccgcgcgcggcccacgccggcccaagccgccgcccgcccctctctcccagccgctgacatgtggggcccacatgtcagggccgtcttcctcctccggccgccgccgcgcaagagcccgaaccctagcgccgtttcccgcgccgatttcgcccaaatccgagctcgattccttcgattggttgaggggttttgttcctctcgatctcctatttcttttcccccaagaatcaaaacgaatcggggagttttggatcccaatcga

SEQ ID NO: 35833 - DNA, 10654 bp, Oryza sativa
  unsure (1)..(10654): unsure at all n locations
aaaacgaatcgtggaggtttggatccgaatcgaactcgttttgttttatccctaaaaaaaccgagttcgatttcttcccgattcgattcctctcgtttgcggcttgatctcttcgatccgagttcatataaagcttctccttgatctcctcttccgtttgccccctttctcgagctctcccgtgcctcctagagccgccgccgcgtgcattaggtttgccgccgccgccggccatcttcggtcgcgtcgcgccgccgcctccgtcgtcgccgccgctcgccgttgccgccaagaggagcgccgtcgtgtgaggaagctcggccgccccttcttttccgccgccgaccaccggagccccctcgacgccgtggacccgaaccgccgcgccgccttctctcgtcgccggccgccgtcgtgcatcctttgactacgtggtgagtaccaacgggttcgcctcgttgtcctctacgcgtagatggcctccgtttccgccgtcgacttccctagcgccggcgagctcgcgaacccgagccggccgccgttgggtgacgtcagcgtgacgtcatcgcaagggctgacgtcatcagggccagggctgacgtcatctttctctctttttcctttttcccgttttttctaatagattaaaactttggaaaatcataactaaataaccgtagatccgttttaggtggttcaagttgctaaatttttctaaaataaagatctacatattaaaattgtccataaattgaattaaatttgtttaattctttttaattgggctttaattagatttaatcttgtaaaattcataataaattcatttgaagtcggagtaaggccgttcaagtctcataattcatctaaaattatgatctacatgtttgtttactttttatgtactgtttatttggtttttattagtctttttcttcgttttacgtgttagtttgtcgtttccgtcgttgcgaaggttcgtgagtgcgtcggaagtgatcaggaagattaattgaagactgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccttattccttgataccttgggtaataaattgattagcttgaaccttatgtattggtttggttcagctaaatgttatatatatttgcttagcaaagcttagaaacattagttcactaatgggatgaatcatatatactacattattatttatggtcatattgaatggtagctcacgatggttaatcgtgttatgataattaattggtaattaaaatatgattattggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattattgtgcaccagactgagaagtggcgagaagtccatgggggtcgctggggagtccatgccttgtttataagggggtgattatgatccaagtacggtgcactgtggtgagttgtgttatgcgaggggtattgtcacaactcctttccgaggtaccgcggtggtactgaggcacatggtgacatgatgtggggttgtgtcttgtgggtacagtggtacacctctggccagagtaaaactattcgaatagccgtgcccgcggttatgggcgagttgagcaatgtttttcgtgattagtctcacacctctcataataattatagatgttataactggtaataatttgcttagctcctggtttggagttagatctgtacagccgggtatggttgttcaggatggttgggcctgtacagcatgggtgtgctgttaagtgttgattaaaattttggattaattactccactgttttatttctcttaaatgttttgctaaatgctgcttttgcaaatgagcctatattatgccatcctttggtatccttgtgcacttgcatacttgctgtgtggcttattgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgatttagttattatgatggatttgtatattaaattgtcagtttgtgtacctcggctgattcctggacgaggattttatgcacaaattagttcggaaattactagtgaatttccgggcgtgacatctaacttgatcaaacagagtaggtttagcttgtaaagcggccacaaaacctttgttgactattcccaagttcaagttttcaaattcttggcataactcccaaggtaaacgtcgaccttctgacatattacagtagcttttcctgctaagggcatcggctacaacatttgctttccccgggtgatagtggatttccatatcatagtctttaatcaattctaaccatcttcgctgacgcatgttcaagtcaggttgagtgaaaatgtacttcaaacttttatgatccgtatacatctctgtacggttaccgaaaagataatgacgccaaatcttcaatgcatgcaccacagctgccaactctaggtcatgcgtaggatagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttagaaactttgttcacaatcatccgtccacttgtacttcacttccttctgaagcagacgagtcattggtctggcgatctttgaaaagttctcaataaaactgcggtaatacccagcaagtccaaggaaactacgaaattctgaaaccgtcttgggttgcttccaacttaacactgactccacattgcttggatctactgccactcctccagacgagatgacatgacaaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaacaggtcatcaattctgggtagaggatccttattcttgatagtgacctcattcaacgctcgataatccacgcacattctctaagtatgatctttcttctccacaaagatgactggtgctccccatggcgaagtactgggtctaatgtatcctttctgaagcaaatcatccacctgtctcttcacgtcagctaactcattagctgccattctgtatggtctcttatggatagggtttgttccaggtaccaagtctatccgaaactctatgtctctcttaggtggcatacctggcaaatcctcgggaaacacgtctgggtagtcttgtactataggtatctcttgtagaacaacttggttcaaggtcacaccatgagatttaggagaggacgcaaagaaagaaacagtttccccattgctactggttaaagtcaccttacggttggcacaatctataactcctctgtgacgagataaccagtccatccctaggataacatctagatctttggattctagcaagataagcgaggatgggaaaggaacttcttctatttctatagtaacagaaggacaatactgtgtcgaaaatacttgattacctggggtattaactagtaaaggtctcccaagactaataacttccatcccatgattgctcgcaaaacttttagacaaaaaggaatgtgtagcaccggaatcaaaaagcacagttgcgggtatagagttaacaggaaacgtacccaaaacaacatctggtgcattctgagcttctactgctgcaacatgattaacacgtgccttcggtactggaacattggagttgttcggggctggagcgttcttcacgcgccgaggcttaggacacttatcagcataatgtcctgggtcaccacaattgaagcatatcactggcttgcttccctgttccttcctgacgggctgattctgagctgaagttgctgcaggacgagcaaccatgttgcggttgtcattgccacgattaccagtattgttgttgtagaactggcgttggggacggacaactgatgaagatcctacttgagggtacgatggagcttgaggtccagtaacgagtcgcggtctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcatttagtccctccaagaacttctcctgacgctcttcatcggtgcgaacatcttccggagcataacgagctaaacggttgaaatcatggaggtactcagtgaccgaacgagatctctggttgagtgctctaaattctctcttctttagagctacgacacccgctggtatgtgcgtcttcttgaaagcggccgtgaactcctgccacgtaataggctctccttcagccctgccttggcgaaaatgatcccaccattcagcagcaggtccatgcaactgatgcgaagcaaaagaaactttctcctgctcagtacactggatcaagtccaacttcttctccaccgcatgcagccaatctcctgcttctactggattggtggtgcttgaaaaggtagggggtctcacacgtaagaaatctgccaacttgttttggggaggtgggggtggattctgattctgattgtttgcctgctgattctgtgcctgctgcactaacagattgatcagttgtgtttgttgggccagaatctgagctagcgtgggatctcctccatcgttagtagctccacttccacttccacttccacttccggtgcgcgtgttcaccatctgacgataagcagaaacaacaggaaagaacgacagagagacacccttagaacgaagttatttaattaatttaaattctatattactcttaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacaacgaactacggcaacgatctaactaagcgactactcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctctttcttagtgtgacgcgaagcttgggtgttggcggcggcgtttctcctttaagttcagctaattcgttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacagatataggttccatagtcttgaccatgaggcttgtgaggatgatactggaaagctgatgaatccaactcttcttcaaaacgttgacgcaactctccaatggccaccaaagctacttcttgacaagcatggctgtacgatcttcctccagcttcaaacttaatggacagaaggtcttcacgatcactagccaacgtcacacgaacacgacacttctcttcgtcggggtcatgggaaatttggcgatactcgggagcaacttcatagcctacctcaaaagccatcaacctcagctccctgacgaatcctaacacctcgatcaaatttctcggtgaatgtggcggcatctaaggaaacatagaagagaggaattaatgcatatttttctaagttagctgcaccaacttgatttaactgattttttgccnaaaagggaagaaaataaaatttaaattccttatgatttattttaagcgcagtacagtgtcaccccaagaaagatgagtagtactagtgctatcatgattgtatcaaacccataatagatgtacagtgcggcctaatcaataaaatttggtaaagagaaaaaaagaaacattttggaagaacaactttttgcttttaaaagaaaagaaattgaatttcaataaattttgtgcttaaccttgcatgtgctgccaacttaattaatttataagagaatagagaagagcagttctattttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatattgataatagagtacaattaaataactatttaatattcgcaaataataaaatattacagaggtagatagttcctcccaaaaatataaaacattctacgcagcggaaaaataaaactataacaaactacggaacagctatgacgactccactccacaggcatcttaaccgagaacaagcctaatcctccagatcatcaccttcactgagatactcctcttctgatgaatgaatattgcaagaatgagcatatgacatactcaacaagccacacagcaaatatgcaagtgcacaggataacaaaggatggcataatatagctcatttgcagaaaacagcatttaataaacatttaagagaatagtaaaacagttgaataattaatcaatattaaataaacaccatacaacacacccatgttgcataggcccaaccacatttgaacaacccaaccccagttgaacaaattgaacctccaaaccaggaattgtccattccaaaccaggaattaaattaattaccacattattaccattaatgagtagtgtgagactaatcacgaaaaacattgctcaactcacccataaccgtgggtacggctattcgaatagtttaaactctgatcagaggtgtaccactgtacccacaagacacaaccccacatcatgtcaccatgtgcctcaataccaccacggtacctcggaaaggagtcgtgacaataccccttgcacaacataacccattacagtgcacctttcctggatcataatcaccccctttaaaacaaggcatggactccccagcgacccccatggacttctcgccacttctcagtcgggcgcactataatgaaccatgctatacaaaagataaagccgttgcccatgctggcttgtggttggcacgataaatgtttcacaacagtagctcgcgaaccggtccttaattgtcatgagcacaaccatcaaaaccatatgctcacaacccaccttatccaggttttaattatcaattaattaacatcacacgatttaccatcgtgagctaccattgaatataaccctaattaataataataattttgtaatataatttatatttaacccctttagttaactaatgtttctaagcatggctaagcaaacatacatatagcatttagctgaaccaatccaatatataaggttcatgctaatcaaattataacccataggaaaataaagtcatcttcggccattaattaattgggaaaggttcaccacccgatgacattcgaaaacaatgcatagttgaaataaaataatagctttaaacgggatcaacatgctcaaagggttgtttgggatctgtctgacttgccttgggcttccacaaacgcttcggaacctttctcaacggaacgctttcctccgaacgtcggaaacttaagcattataacaaaatcaacaaaacagttcaaaaacaagcataaacagtacatgtggatatttttaacatgtagatcttgattttagaagaattagaaacttgaccacctaaaacggatctaccgttatttagatatggatttccgaagttttaatctattagaaaatcgggaaaaagaaaaagaaaaggaaacgatgacgtcagccctagaggagatgacgtcagccctggagatgacgtcggcatgacgtcagcaacggcggccggctcgggtccgcgagctcgccggcgctagagcggtcgaccggacgattggaggacacctacgcgtagaggacaacgaggcgaacccgttggtactcaccacgtcgtcaaccgatgcacgatggcggccggcgacgagaaggaaggcggcggcggctcgggtcgacggcgacgagagggctccggtgatcggcggcgaaaaaggaggggcggccgagcttcctctcaccacggcgcacctcttggcgatgacggcaagcgacggcgacggcggagacggcgcggcgacgacgccgaagacggcggcggcggcggcgaacttggaacacgtcgcggcggcgctaggaggcacgggagagctcgggagagggggcaaacggaagaggacaacgagaggaagctatatatggcattggattgaagagatcgagctccaaacgagaggaatcgattcgggaagaattcaaactcggttttagggataaaatcaaaacgaattcgattcggagagaaaactcaacgattcgctttgattcttgggggaaaagaaagaggagaacgagaggaacaaaacccctcaaaaacccggaggaatcgggctcggatttgggcggaatcggaggtggaagatggcggctcgggctcggtctcggcggcggccggaggttgaagaagggcctgacatgtgggccccacatgtcagtgtcccgagagagaggggcgcgggcggcggcggcttgggccggcatgggccgcgcgcggggagagagagaaagagagagtcgggccgaaaacggcccaacggcttagggagggggatttttgaacttttttgaataaaacaatttgtgaaatgttgtttcaaatattaaaaatacttcccttgctcaaataattcccagaaaaattctctaaaatagaggagcaagcatagtatttaataaaattttatctagctcatttttatgttgaaaattttcctagaaaattagggtttagctggtaggcttttaaaataatttctaaaaatgatttaaaatctgcatttttaatttagtcgatttttagggcgtgacattgatcaagttagagaagcccaaattaatgatcctgatattcaagagatcaagaagaatatgagaagaggaaaagctatcggtttcttggaggatgagcatggaactgtatggttgggtgagagaatctgtgtccccgacaacaaagatttaaaagatgcaattctaaaagaagctcatgatactttatactccatacaccctggtagtactaagatgtaccaggatctcaaggaaaggttttggtgggcaagtatgaagcgtgaaatcgcagaatacgtagcagtatgtgatgtttgtcagcgagtcaaggcagaacatcagaaacccgccggtttgctgcagcctttgaaaattcctgaatggaaatgggaagaaatcggtatggattttatcactggtctacccagaacgtcatcaggccatgactctatttgggtgatagtcgacagacttaccaaagtggctcatttcatcccggtaaagacaacctattctggaagtcggttagcggaattgtatatggcaaggattgtgtgtttgcatggcgtccctaagaaaatagtgtctgatcgaggcagtcagtttacttcaaatttttggaagaaacttcaggaagagatgggttctaagctgaactttagtactgcttaccatccgcaaactgatagacaaactgaaagggtgaatcagattttggaagacatgttgagagcttgtgctttagatttcggtggaagttgggataagaatctaccttatgcagaattttcgtataataacagttatcaagctagtcttcagatggctccttacgaagcactgtatggtcggaagtgtcgcactccgctt

SEQ ID NO: 35834 - DNA, 1734 bp, Oryza sativa
tcgactctagaggatccccaacataacccattacagcgcacctttcctggatcataatcacccccttttaaaacaaagcatggactccccagcgacccccatggacatctcgccacttctcagtctggcgcactataatgaatcatgctacacaaaagataaagccattgcccacgctggcttgtggttggcacgataaatgtttcacaacagtagctcgcgaaccggtccttaattgtcattagcacaaccatcaaaaccatatgctcacaacccaccttatccaggttttagttatcaattaattaacatcacacgattgaccatcgtgagctaccattaaatataaccattattaacaataataattatgtaatataatttatatttaaccccttttagttagctaacgtttctatgcagggctaagcaaacctaaatatagcatttagctgaaccaatccaatatataaggttcatgctaatcaaattataacccataggaaaataaagtcatcttcggccattaattaactgggaaaggttcaccacccgatgacattcgaaaacaatgcatagttgaaataaaataatagctttaaacgggatcaacatgctcaaagggttgtttgggatctgtgtgacttgccttgggcttccacaaacgcttcggaaccttcctcaacagaaacgctttcctccggaacgtcggaaactaaagcaattaaacaaaaatcaacaaaacagtacaaaaacaagcataaacagtacatgtggatatttttaacatgtagatcttgattttagaagaatttagaaacttgaaccacctgaaacagatctacggttatttagttatgattttctgaagttttaatctattagaaaatcgagaaaaagaaaagggaaaggagatgatgacgtcatgctgacgtcagcaatggcggccggttagggtttgcgagctcgccggagctagggcggtcgaccgggtgattggaggacacctacgcgtagagaaccactacaacaaaacaacccacaaaacaacccaaaggagacatcttatttgtaagatagagacgttttatttcgtctcccacagataactgagacgcttttataaagcgtcgtaggatcgtctctgtttgcaccgtcttaaaattatggagacgctttttaaagcgtacctatattatttaagacgttgctagagacgtgtaaattgcatctctacaaaaatatagagacgcttttatataggcacgcacatcttaatatatttgatattaatgctttcatctaggctcgaacacagcacctgcaggttacaaagttcatgcactaaccaagtcattaacgtgacaatcttgaaggtaaatagatagttttttttatattgcaactctgcaaacatgcgttctgtagcagttctcttcttttttaatctaagactgaatattaaatatttatttttttgtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatatcctcaactaataaagcgtct

SEQ ID NO: 35835 - DNA, 18328 bp, Oryza sativa
  unsure (1)..(18328): unsure at all n locations
nnnnnnnnnnnnnnnnnnnnnnnnnnnnnnnnnnnctcgaacacagcacctgcaggttacaaagttcatgcactaaccaagtcattaacgtgacaatcttgaaggtaaatagatagttttttttatattgcaactctgcaaacatgcgttctgtagcagttctcttcttttttaatctaagactgaatattaaatatttatttttttgtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatatcctcaactaataaagcgtctcaaacatcgtccctattttaatttcacttataaaaaagagacgacttatagaatgacttaagtgaaacgtcttaaaacaatggttttgttgtagtgaacatcgagacgaacccgatggtactcaccacaacgtctatcgacgaacggtgatggccggcgacgagggggaaggcggtggcggagctccggtggtcggcggcgaaggaggacgggcggccgagcttcctcacctccgtgcgcacctaacggcgacaacggcaagcggcggagacggcggacgcggcggcgcgacacggccgaaagatggccggcggcggcggcggctaaatgcacgtggcggcggtgctacggtgcacgggagaggacgagagagggggcaaatggaagaggacgacgaggggaagctttataaagcattggattgaagagatcgaactccaaacgagaggaatcgactcgggaaaaatccaaactcggttttagggataaaatcaaaacgaactcgattcggatgaaatcctcaacgattcgctccgattcttgggggaaaaggaagaggagaacgagaggaacaaaacccctcaaaaacccggaggaatcggagtcggattgaggcggatttgagaggagaaaggcggcggcaaagcggcggctcgggcggctcggccggaggtaggggatggatccgacaggtgggccccacctgtcggcctccacgagagagggaagcgggcggcggcggcagctgggccggcttgggccggttcggccgcgggagaggagggagatgttgggccgaattcggcccaacgaccaaggagggggatttttttgaactttttaaaataaaacaatttgtgaaatgttgtttcaattattaaaaatacttcccttactcaaataattcccagaaaattctagaaaatagaggagcaagcatagtatttaataaaattttatctagctcatttttatgttaaaaattttcctagaaaattagggtttagcttgtaggcttttaaaataatttctaagaaatgatttaaaatatgcatttttaatttagtcaatttttagggcgtgacatgctgctaggggctcagttctgcctgcctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgtgcaagccgagcaatgtacccaagttagtgttttaattcttaaaacctgcttatcaactaaaatgtggaatggttggcctaggttggcttgggacgagctgggacccagggtcgggttgccagttcggtctgaatcatcgtaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtatgactcctttgtactcccttgcatttattctgcacttgtgggtgtgtcttgttgagtacggtggttgtactcagtcttgctcaatttttcccaaccccagaagaggagccccttgaagatgaaggttttggtgtctagctcgtgcctgccgtcaagcgcctgtggtcgtcgccctagtcttccgttgtttctcgtttgtctctgtgtgtgctgggccttcgctgcccatgtaataagttagctatttacgcttccgcttgttaaactctgaattgtatcaacttttggtgtaccttgcctcctgggacaaggattaatgcacgcacgtaaggaacgcccgttgggttatttccggtcgtgacattagatctttattgattgagaggaactatctacctatgtaatgactttttattcgcttattaattagagtaataattgtactctattatcaatttgttattgtgtgcctcggctgattactggacgagggttcacacacatgtaagcgtttggaattttggatagaaatttcgggcgtgacatatatgcatatgaccgacgctaaggagttgtgggatgcactgaatactaaattcggtgctactgatgctagcaatgatctgtatatcatggagtagccccttgaagtgatgagaaaaagaaaactgcgtcttttccgatctacgtgtagtgctagatgctgggtgccatggatcgagtgatcaaatcagaatttatttacgttcagaactcagttgactgcttctatagataaggcggaatgtccttagttcagcattatagcacatagtctccaacgctacgccatatgtcgcttagacttgaccttttctcccgccccctaaaatcttcggctcctcgtttttattcaattatgaaattactcattttgatggagatttatagcatcattcaagtaaatacaaattgagatcgtagaaacatgagcttgcagtttcatgactacaagatggctgacaaccgttttgtagtcgaacaggctcatgagatacaaaccatagctaaggaactcgaactccttaagtgtgtcttacccgacaaatttgtggccgggtgcattattgcgaaactacctccatcatggagaagtttcggtactgcattcaaacacaagagacaggaatactccattgaggggttgatagcatctcttgatgttgaggagaaagctcgggaaaaagacgccgcgtctaaggatgatggtgggcagtccagtgccaatgttgtgcacaaggcctagaacaagagcaaggggaaatataaagctcaacagaccaccaacttcaagaggcagaagaagaacaacaacaatcctaaccaggatgagaggatttgctttgtgtgtgggcaacctggtcatctggctaggaagtatccacagcgcaaggggatgaaggcacctgcagggcagacttctaagtctgctaatgtgaccattggcaacactggagatggaagcgggtatggtaatttacctactgttttttcagttaatcagtctactaattggtgggttgatactggggccaatgtacttgtttgtgctgacatctcattgttttcttcttatcaggtcgcacggggttccaccttcctaatggcgaatgggtcacatgcttctgttcatggtgttggcacggtagatgtgaagtttacttcgggaaagatcgtgcagctgaggaacgtgcagcatgtcccttctatcaacaggaatcttgttagtggctcccgtctaactagagatggatttaagttggtttttgagtctaataaagtagtcgtgtctaaacatggatattttattagtaaaggttatgagtgcggaggcctgttccgcttttccctttctgatttctgcaataagtctgtgaacaatatttgtggaagtgtggatgatgaggctaatgtttggcactcacgtttatgtcatattaattttggcttgatgtctcggctttccagcatgtgtttaatttctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatgaggtgttgacgaagggtggaaaacaatatttcatgacgttaattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgacgaacatgacatcatacatgagaggactcctccctattctcccgagtctaatgggattgctgaaaggaagaaccgcacactgactgacttggtgaatgccatgttggacaccgcgggacaacctaaggcatggtggggggaggcattgttgaccacgaatcatgtgttaaacagagttcctaacagaaataagaacaaaacaccatatgagatatggattgggagaaaaccatcactttcttatttgcgcacatggggtgttgttggtcgctctgaagttaaggtgaattgtatgtttcaattgatctcccgaaggtgatgtcaagatgaaccccacacctgctccttggctattgagcgcgccatcgaacgccattgtccatgtttcattgtcggtttgactgtctaacctattattaggcatagtccaatcggctatgacatcggcgagaacctcggacttgatggctgttcgtggtacaaagtggacgtcaaactggcttagctcgactacccatttcgcaatgcggccgataacgtctttgtttctcatgacttcgccaagagggaaggcggagacaactgtgaccctgtgggcttggaagtggtggtgtagctttcttgacgtcatgattactgcgtagagcagtttttggatctgtgcgtaccttgtcttcgcgtcgtggagagctttgctgacgtaatagactggtctctgtacattttctctttcgacaacaatgacagtactcacagagtagggtgtggcggtaatatagaggaataactcttcattaggttggggagcaacaagtacagggggatttgataggtagcacttgagtgcgatgaacgcttcttaggcttcttgtgtccatacaaatttgtcctgctttttagcagtgcgaagaaatgctgtccttgttctcccatcctaacgacgaacctacttagtgccgccatgcatccggttagcttcagtacctccttgagtcttgtgggcgacttcatgttctcgattgccttgatcttctcggggttcgcttctattcctctgccagagacaaggaacccaagcagtttacccgacggtaccccgaacgtgcacttctcaggattgagcatgaggcgatattgtctgaggttgtcgaaggtttcccgtagatcgtcaatcaatgagtcgcatgtcttggttttgacaacaatgtcatcgacgtaggcctcaacattgttacccagttgatcgctaagtgccccttggaccgtacgctggaaaatatttcctgcggttatcagtccaaacggcatttttacgtagcagaatacaccgaacgatgtgatgaatgttgtcttttcctcgtcctcttttgccatgcttatttggtggtagccggagtaagcgtcaagaaagcttaacagctcacaaccagctgttgagtccactagttggtctattcgagggagagggaagtgatccttggggcacgccttgttgaggtcggtgaagtcgacgcacatcctccacttcccgttggccttccgcaccatgactgggttggctagccactctggatggagtacttctctgatgaaaccagctttgagaagtttatcgagctcttctcgtatggcctgtttctgatctggtgcaaatctccgcagcttttgctttactggcttggcaacgggtcgcaccatgagtttgtactcaatcacctccctagggacccctggcatgtcggacagttgccaagcgaatacgtccgcattatcgcggaggaaggtgatgagcgcgagttcctatttctcgttcagtgatgccccgatcttgactgtcttgtcggggttggcactggagagtggaacgattttaattgcgtcgtctggttttggcatcttagtcgttttgatcattttcttgggtggctcggctgtggcgggtgggctgggcgtgtgctcgaccatgtcgaggctctgcttgtcgcattggaccgccagctttgtgtttccttgaatagagattgttcccttcggctcgggcatcttgagtacctgatacgcgtagtgagatgcggccatgaacttcgcgagtgcagttcttccgatgatggcgttgtatgctgtatcaaactcagcaacatcgaatgttatcttctctgctcgaaagttgctcgcttggccgaaagacacaggaagcgtgatctagcccagtggcttggacgaagactaaggagtgattccatggaagggttgatcggtaggcgtcaactcgtttcgtggaatgcccattgcgtccaaggtgctggcaaagagaaggttgatggagctaccgccatcgacgaagactcgcgctaccttgatattccgaatagtgggttcaaccacgatcggatatcgtcctgggataatagcagttttggggtggttctcatctgagaactcgatgttctgttcagaccacttcatcttgggtgcaaccccctgccatgtcgaacaaacctcacgttccacttttttgtattctcgctttgaagagtacgctgtggaacctccgaagatgtgcgagacatgaagatcggaatctggatacgccgagtccgagtcctgagtggttgcctcagtggccttctcaactacacgtactcgcttgcccttctccaaagccagctgctttgccaacgactttttgaagatgaggcactcctccagagaatgtttgtccgacttgtgtatggggcaccatattctcttcgtatcactgccttgtgggtctgggtgtttgggcgggcgcttgtattcagacacgaggacttccgcttgagctttcctcttcccactcttgccgcttttcttcttgcttgattcgggtgtgtccttggctggcttcttctctcctcccgcctttgactcgtcgttcttgcgtctcactgcgtcgtctgcatgggcgcatcgatcgacaacctcaaacaaacttcgagtcgttgtgattcgccttgttgccaactcctgggtagtatagcgatctctgacaccggttttgaaagcacgaatcacagaagcatcggtgatatcggggatcgtatttctgcactcattaaagcgccgaacaacacgtgtaaatcgtcttcgatcgcgtggcgcttgtaagttccctggaagttagcgacgaattgctaccacaaatctgcccatgaagagatcgagtagggtgggaggtgcatcagccacgaacgcgcagaacctttcaacgccgttggcaaatagtttgctaacgcgttgtcgtctgccccagcagcgtatagtaccgtggagtagacctggaggaattcttcagggtcagtactcccatcgtacttctctattgctccgggtcggaatctctcgggccatcggacatcacgtagagaacggttgaaagctctacacccagtgcagggggcggtgggttgtcggcgattgtgtgtcctccgtggatgtctatcggatgacgaagatgaagatgatgacgatgatgacggtggttcactcggctccggtgtgcgattccgagggcgacgtttaggttctcgagaattctgtcgtcatccaccattgttgtcctagcgccgatccccattatcatcaccgtcatgttgacgccctcgaccagcatcgtctggtgtccgctgttcgcgatcgtcgcggtcgcggcagttgtgacgattatcgtggtcttggtcttcgttcgagcgacctcctcgctgtcacgcccagaagtttcccctttttcttgctttaaaaattggttaaataaattgcccgaagaaattatcttaattaacctagagctaactccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatttaatcctaggaaaatccttctcctctttttctttttcttttccttcctttttctctagatgggccatcggcccatctctctccccgcgctcggcacccctttcctgggccggcccgctcctcctttccactccccgaagtcctccctccctccctttctctttcgggcaccgacaggtggggcccacctgtcggtcgtcccctacctccggtcgttggagccggagctccaaccgcccgcgctgccgccttctccgctccacgtcgcgcctccactccgcgcccgcacctcgcgcccacgtcgccgccctctcccccgcatctcccgcgcgcgcgcgcgcccgcaagtggtgggggatttgaaatctcccaacaccctcttctctctcctccacctctccacgtcgccggccaaataggggccatccccggccgtttccgcccctccctcgcccataaaaaccctcactcgagctctctctctcattttccccattcaccgtcctctcccacgccctctaccgccgtcgcgccgcgctcgccgagctccgcccccgccgcccatctcctgccacgtgccgtcgccactagggccgccgctgtgccaagccgccgccgccgctagctccgccgccgtgtgggccatctcggccaccgcctcgcgtcgccggaaccccaccggaaccccatctccctcgcgagccggtgagctatccattcccctccgtctccggccagccactttggtcgtcgtggtcgccttatccatccctaactcctctcctcccctcctctaagtgtcgccgccgctcgtccgcccctcctcttgtcgggtcgtcgtcgccgcctttgtcttccgctccggccgccgtgtcgccggtgagtccttcctccccctcctttcctcaccttcccgcgagcgccggccacgccgctgctccggccatgcgccgccgcctttcggccgtcgcagccgcttcccgcaccgccggtcaccgccgtcggtggccgtgcctcgccgccgcctcgccttggtcggccggtcggccttgaggccaagctgagcctggccggcgcctccctcgcctcccctttgagccaccgcctggtggggcccacctgccaggcgccacctccctccctttggagccgctgacccgtggggcccacgtgccggtgccccccctttcgctgacgtcagccttgggctttattgcgcaataaaataattaaggctttttctttattagtaaaaacacagtttatcttttaaaattcttaagtaattcatccgagctccgtttaagtccattcaagtctcagtaaatcaagaaaaatgcaaagaatccactaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttagattggcgccaccgcaagggtgtcagttaattaaaatattctgaatggcgggctgtgagtgcatggttttgctggtcgcacccatggcagttaaggaccggttcacgggaaaccctgggagacttaccgtgctgaccacaagcgggagtgggtaactgcttgatctgaagtatagctcgaccctttcctaggcaccggtggtgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttaggtggaggatcttgtcacgatttccccctttgcagtatcatggtgatacttcggggcatggcgacatgtgtggaatcgtgtcttgtgggtacagttgtacacctctggcgagagtaaaactattcgaatagccgtgcccgcggttatgggtgatcaaccagatttaccgtgattagtctcacccctagtttagcgtaatgaactggtgtagttcaggtggttggttgggcttgttgcaacgtggtgtagcgttggacagtgattggttaaaattgattaattactacagctattttactgctttcaactactgctttgaaatgcctgctttatgcaaaagaacccctagcttcctttggttatatcctgcatcatacctccttttccggtatgacttgctgagtacagtgggtagtactcagtcttgctctcttttcccccacaccagagttgaagttcttctcagatggagccgcctcagagaggttggtttcgtcgctgccgtcaaggtttgcctgtggagtggggtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacaatcagcttagaaattctggttcgagaatttctgggtgtgacaagttggtatcagagccgaccttgaccgtaggacaagccaactggaaacctaagagccctctgaacccttttttttcatatgcatatgctcttttgcacttggatttgtttcaggaaaatttggggttttgcctctttggtttgtgggaaaaatcttggtcgttcattcggatcggatttttaaaattagctcagtgtagggttttagaaaaaaaaatctatttgggggttttaaaattagctcagtttaggtttgttgcttgtgggttagtcggcggtcgatatcatgtgtcagtggtatgactgcctcaattaggagttgcgtgcctctttttcagtgttttaatcaagattaagataattacacttaaattcataagcaagattagtttctaagccccctgtttttcttccttttctcatatttctccctatccccttcagatggagacaaggaatggttaacgggactccaacaatgccagtggcagcgaagagccgatcaatggagcacgtgccaacagtgcatctgacaacagtccgtccccatcgcctgagaacccaacaattgctcaggtgttgaacaatcagactcagataatgacaatgatgatgcaacagatgcagcaacagtaccatcaggtgttgcagcaggtgcagcagcaagcacagcagcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacataccagctgcaaggccccgcttctgtttggtgggacaactacatggtgacccgtccagctggggcagaggttacttggacagagttttgtcatagtttcaataaagcccaggttcccgagggagttgtggcgcaaaagaagagagagttccattccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtctaacaaaatgaaccgtaagaggaaggcagcctagttcaggactccccaggggaagtgttagaagcctcgtttcacaatgggatatcagggtggaccttccaccatgattatccgacagcaccgtccctaccacccgggtagcttcaacaagaaccaccatagtggcagtcacaacaacagtgagtagcacagcctcaaccctactccgagttcactaaagattccagcccaatcagttcagccacctttgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggtgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagcccacctcattcttctcgaatccaaggacctagatgtcatacttggaatggattggttgacaaggcacagaggagtgattgattgcgccagccgcaccatcaagttgaccaatgcaaaaggagaggtggtaaccttccagtctctagtgccgcagaagccagggatcagtttaaaccaggctgctggtgaagaacaagaggtagcagtggagaaaaccactaagaagctagaggatattcccatagtcagagagtatccagaggtttttccggacgatctgacaacaatgccaccaaagagggatatcgagttccggattgacttggtacctggaactgcaccgatccacaagaggccttacagaatgggagccaacgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaataaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatacacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatccagcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactagcaactacccgacgcatgatctagaattggccgcagttgttcatgctttaaagatttggcggcactatctcatcggtaaccgttgtgaggtatatacagatcacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttctgttgaggatgaacaaggaacaatctggatgggagaaagattgtgtgtacccgaaaacaaggaattaaaagacctgatactaaccgaggctcatcaaactcaatatttcattcatcccggtagtacaaagatgtaccaagacctcaaagagaagttttggtgggtcagcatgagaagggaaatagctgaattcgtagcactctatgacgtctgtcaacgagtaaaggcagaacaccaaaggccagcaggtttgctacagccacttcagattccagaatggaagtgggaagaaatcggaatggatttcatcaccggtttgcccagaacgtcatcggggcatgattctgtttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaaaccaatttacttcaaagttctggcagaaattacaagaagaattgggaacccggttgaatttcggcactgcttaccatccacaaacggatggccagaccgagcgagtcaatcaaatactagaggatatgttgagagcctgtgcgcttgactttggtggagcatgggacaaaagcttgccgtatgctgagttctcttacgacaacagttaccaagctagtctacagatggcaccgtttgaagcactgtatggacgaaggtgtcgtactccgctcttctgggatcagacaggggaacgccagttgtttggtacagaagttttaaatgaggcagaagagaacgtcagagctattagggaaagattgagaatcgcgcaatctcggcagaaaagctatgcagacaaccgccgaagggagctcgctttcgaaacaggggattatgtgtatctccgtatcactccgctcaggggagtacatcgcttccagaccaaaggaaagttggcaccacgctttatgggaccatacaggatcttggaacgtagaggtgaagttgcttaccagcttgagcttccctccaacatgcttggcatccacaacgtgttccacgtctctcagttgaagaaatgtttgagagttcctgaggaacaggcaagtccggatcacaccgaaattcaggaagatctgacatatgtggagaagccgactcgtatcctcgaaaccagcgagagaaggaccagaaacaaagtaataagattctgcaaggttcagtggagccaccactcagaggaagaagccacttgggaaagagaagatgagttgaaggccgcccacccgcacctcttcgccagctcttccgaatctcggggtcgagattccgtttaaggggggtaggtttgtcacgcccagaagtttccccctttttcttgctttaaaaattggttaaataaattgcctgaagaaattatcttaattaacctagagctaactccataattaataaatgcaattaataatcggaaatagcgtggtggaatttttcttgagttccccatgctccaatgcattaacaagatttttagtggaattttcagagccttagaaataattttaaccaattaaaaatcaccaaagtgcaatatttaatcccaggaaaatccttctcctctttttctttttcttttccttcctttttcactagatgggccgtcggcccatctctctccccgcgctcggcacccctttcctgggccggcccgctcctcctttcccctccccgaagtcctccctccctccctttctctttcgggtgccgataggtggggcccacctgtcggtcgtcccctacctccggtcgttggagccggagctccaaccgcccacgccgccgccttctccgctccacgtcgcgcctccactccgcgcccgcaccttgcacccacgtcgccgccctctcccccgcatctcccgcgcgcgcgcgcccccaagtggtgggggatttgaaatcccccaacaccctctctctctctcctccacctctccacgtcgccggccaaataggggccatccccggccgattctgcccctccctcgcccataaaaaccctcactcgagctctctctctcatttcccccattcaccgtcctctcccatgccttctactgccgtcgcgccgcgctcgccgagctccgccgccgccgccgcgccaagccaccgccgccgctagctccgccgccgtgtgggccatctcggccaccgcctcgcgtcgcccgaaccccaccggaaccccatctccctcgcgagccggtgagctatccattcccctccgtctccggccagccactttggtcgtcgcggtcgccttctccatccctaactcctctcctcccctcctctaggtgtcggtgctgctcgtccgcccgtcctctcgtcgggtcgtcgtcgccggtcaccgccgtcggtggccgtgcctcgccgccgcctcgccttggtcggccggtcggccttgaggccgagctgagcctggccggcgcctccctcgcctcccctttgagccaccacctggtggggcccacctgccaggcaccacctccctccctttggagccgctgacccgtggggcccacgtgccggcaccccccctttcgctgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccactaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggtatagctttagattggcgccaccgcaagggtgtcagttaattaaaatattctgaatggcgggctgtgagtgcatggttttgccggtcgcacccatggcagttaaagaccagttcacgggaaaccctgngagacttaccgtgcttaccacaagcgggagtgggtaactgcttgatct

SEQ ID NO: 35836 - DNA, 1041 bp, Oryza sativa
tgccggcaggtcgactctataggatccccatgtacccaagttagtgttttaattcctaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaataatgacgccaaattttcaacgcatgaactactgcagctaactcaatatcatgagtagggtagttcttctcatgcggacgtaactgacgagatgcataggtaaccaccttcccatcttgcatcagaacacaacctaacccaagtttggatgcatcacaatacacctggaaacccttttttggatcaggtaaaatcaagataggagctgatattaagcgattcttcaactcttgaaaactctgctcacattcttccgaccacttatacttcacatctttctgtagcagtcgtgtcatgggcttagtaatcttggaaaaattctctataaacctccggtaatatcctgcgaggcctaagaaactgcgaatctgtgaaac

SEQ ID NO: 35837 - DNA, 1288 bp, Oryza sativa
ataaattggacaagatgttggaggaccacagaacttcgttgtacccaagttgcgagcaggggcacaaaaagttggataccactctggagttgttgcaatggaaggcaaaaaatggggttagtgacaaggcatttggcgatttattgaaactcgtcaagaacattcttccggggggaaagaaattgcccgagacaacgtacgaggctaagaagatagtctgcccgttaggactgaaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgttgcgatggcacgctgaagagcgtcaacatgacgggatgctgagacactcagccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacct

SEQ ID NO: 35838 - DNA, 770 bp, Oryza sativa
  unsure (1)..(770): unsure at all n locations
gtcttcagatggctccgtacgaagcactgtatggtcggaagtgccgcactccgcttttgtgggatcaaacgggagaacgtcaggttttcgggacagatatcctaagggaagcagaagaaaaggtgaaaatcattcaagaaagattgcgtgtggctcagtctcgacataagagttatgccgataatcgccgcagagatttgagttttgaagaaggagattatgtgtatcttcgtgtcacgcctcttcgaggagttcattgttttcacaccaaaggaaaattggcaccgcgttttgtgggaccttataagattgtccgtagaagaggagaagttgcttatcagttggagttacctcaatctttggcaggagtccataatgtgttccatgtgtctcaattgaagaaatgtttaagggtacctaccgaaggagctaatcttgaacaaatagaagtccaagaggatctgacctatgttgaaaagccaatccgtatcttggaaatagatgagagaagaaccaggaatcgagttatccgtttttgcaaagtccagtggagtaatcactcggaagaagagtcaacttgggaacgagaagatgaattgaagtcagctcatccgtatctgttcgccagttcttccgaatctcgaggacgagattctgtttaaggggggtaggtttgtcacaccctaaaaattcaaattatataaattgtnnnnnnnnnnnnnnnnnnnnnnnnnnnnnnnnnnnnnnnnnnnnnnnnnnnnnnnnnnnnn

SEQ ID NO: 35839 - DNA, 15931 bp, Oryza sativa
atctgaaaattgtcgtgctctcaagtttccctgcaatgtatgagagatacgagactgaagtcagaccagttggtatctaaaggtagccaagaactaaagaaattctacaaggttgattccaattcatgtgatgaacagattggagaggccctattgagacaaaatctcattaaaatgtacctgcaaaaagaacctctttgagaccgtaactgagtcgtgaggtacctgttacaatgttagtgacatacatggctttgtcaaaatcaaaccagattctgtaatacctgtggaaaataaaagaaatatagtttctaactttctatgcacactagctagcagcactacatgatatgctaacactcaagcacaaatgttagaaagtaaaagcaaaactgcgccgatgtaaaggctgcaacagagctcacttgattacatttaaatgtgtgatagcttatcgaaataagcaccttggtttgatggcaaggggataactagcaagactatccttgtacgtcgttcgtctcgatttctgagccacgaacaatatggcggaatacgaaggactcctagcgggactgagggccgcggcaggaatgggcatccactgcctcctagttctgggcgactcctagctggtcgtgaactagctatctaaggagtaccaatgcaccaaccagcagatggacgcctacgtccacgaagttcgacgcatggaccgccacttcgatgggctcgagctccgacacgttcccaggcgcgacaatgcagtcgccgatgagttgtcgcgcatggcgtcagcacgagccccactcccccaggggcctttgaagaaaatctcacacagccgtcggcgcactcggaccccccgagggtgcctaacgccgcgacccccaccctgacgcctggtgagccacaggcctcggggcccgagggggtcaaccccgaccccccatgtcaggtcgcctggatggccgacatccgggcatacctcgacaatcacactcttcctaaggatcgcgccgaagccgaaaagctcgcgcacatctccaaacggtacatgcttgtagaagggaccctctaccggagcggcgccaatggggtcctcttgaaatgtatctctcgggagcaaggcgtagagcttatcaccgacgcccgcgagggaaaatgcggggcccactcggcctcgcgcactttggtcggtaaagccttccgtcaaggattttagtggccagctacactccaggatgcccaggactgggtcaggtgatgcaaggcttgccagttctatgccaagcaaacccatcagttggcccaagctttgcaggtcatccccttctcttggtgttgacggtcattattgatcagtttcgaccgtcaatattaccaaaatagaagagaactagtgatgcttgcaatgcatatatctgttagaataataatattccactagtattaggtataataaccttttgcagagaatgacaataaagtggaggagaatcgacatcaacttagaccataaatcaatcggacgatatcaaaaaccagacttatgtatgaatgggccaaaaactcagtattgacacgacacactgggccaaaattcacaagtctatggagaggaacaccagaggaggtcactagccaacttgtgggctggttgggccagcccagggttcgggttcgaccgaaccaatgccaacgctgatggatgcagggtttcgagggaacggtagagattaactccctatggtggttggagggtattaccgacctttccaaccaccataaccatcattacctgcctatttaaggagttcactatcttcacttcaacacatacctcaagcaagagctctctcatttctctcaaatttagtttagtagtatctagctggtggaataggaatacaatagaaatcaggagtccggaagccttcggaagagttcgggtatggctctagtagctctcctttcctcttttgtaggctttttacttttattagaatactcttctatatacatttatggtattgaaatactttctgagtatatgagtacctactttacattatgttcatgttatactgaatatacagctagcttatctgggagatgctttggtgcgggtataatgtttgcatatgcaattactctatgtcatgacgatgatattagagtagtatctggtagtttaggcgtggtgtatagattacgggatatcattatttgggattatatactgcggatgagaggtggaccgctgatggtgacagctcagtatgggtattcctccacgccggtatataatcctaagttaattccctggggagggtattcccccgtatttagctccggttgtatggtcataacgggctgtcataaggaactcggcagtcaggggtggcttctcaaagtaccaggagggcatcggatagaggatattagctagtatatcggttaactagaatgtatgtacactatgtacattagaagtataggaatagattttctctctcttttctttccgcttagcttagataatatattatgagaatgagtagctagagcttgtgtgtcactctacccttggattatcttaacccctgcttagaatatgattatcacaactaatatataaattattagtcaagttctctctacatgatcttcccacgggataaaataaatacgatacccttggaatactctcgggtgaaatgctacaatggtatatccgtgcgcttgcggatgaactctgtaaccataaaataacagaagtatttctgcgctattgctgggaattatatttctagtaatgacgttaagaaataccaacaagcatttctggcgccgttgccagggaagattcataatagagattacctgcaataatactttatatttacctctgtataatcattttcctttgcatgctaacattggttgttttcacttttttttgtgaaaacagggtagtgcatgactggtttcaacttgccggaaaacttcaaagaaaatccagatgctttcttccggagcgtcaggccgcgagtcgctgctccgcagaaaactctatcgataaagaaaccagccgtaccagcgccatcgaactttaagactatggctaacaagactctctggcaccgaacgtgtgatggcttatcgaaataagcaccttggtttgatgtcaaggcgataacccgcaagactatcctcatacaaaataggaacaaagggcataatctcagtgtcattggagcaagcagaattcttcctagatgaagcgggtgcaggcgcatcataagagaacctgtcatgttctagaggtgacagccatatgcgaaacttcctgacagaatgctgacattttaactgggaaccatcatggacttggatctgctaagatttttctttatcttcgacatgcagcgtctcatctgtctgtttgacacgcagcacctcatcaagatcatacaggttttcgataacccgcttcgttggatcatagagacccaatttactccctgtgttgagcagaatccttccatccttcggatcaacagccatcggaaccacgacattagctccaagggaataaccaggccaacctttcagacacactctgtatgctctatcccattgaccatgctccatcttccaaatatccaattcctcttcaaacggattagcgagaacaacgcaaagcattccttcaagctctaccacaaatgattcgcaagggcttctgttgtgtcttgttagagcacacgaagggcactggatgacaacaaatgtcttggtcgcgatctcgaacgagagaatggcgcttgtcttactctggctcaaccttggctcactcatccagtacagaaatccagccaagtaagccggaggcatgtcattcacaggcagaggcgggctgtaaaaaatcacacgtgtgacgcgatttacaggtaaaaagcgagcatgttatgttgtaacgacaaggttttgaagtttcttcactgatagaaatgacatgcccctgcatcagtggatcgaaccccaggccgacattcttattaccggtagtaaaagcatgatcgtgacgaaatctatcactaggtattctatttggaatgtagacaagagcccctcgggtactgcggacatagcggtaacctgtacaagggttgtatagataatcctccagctcagtgcttatgagattcatcccatggcaaggcttggagcaaaccacctttgcatcaagccatgtatcttactaggagattcttgaagcaatttttctatgctggcaaaactaaaacctgatgatccacctgtgcccatgcccacaagcctgatctttggcctcctgtccctgttgttatacatgtggtatccacgagcgaagctccaactttcaataaatctatgccactgcttagagacaagtttgaactgcacggcataatcacccggaagccgtagtagggcctcctttatcaccttggcaaggggagatgacaatgctatctcttcattggttttacacacaggagcaagactgtcttcaaacaaactgatcagtccaagagcagaacgtgcagtttggtaaggcaaaggagttcccttgatctcaaggattgtttctagtgtttcagatgtaggatcataggcgatcgccttgcgattggatgtagcaatgattacattcttcttccctgacataccactactgccagcagaaccaataactctgataaatctggtttcattaaatctcgggcaacatgctccgtcgacaaatcgatgcgatgctccaatgaccaatcactggagtaaagatcattcagcttccaaatctccagcgtagacgacatgcgacgaaggtcccggaccatgcacaggttaccagagagatccaccaagtgcactcctgaaacctgaaagggcggtgacctgaccaatctgaatgtctcttctgtcacagagaaggataagatggcagcatgtggcctcaagaaagagaacaaagagccagtaagccagtgaagaaacccatccacaaacactggaagaagtttatgttgttgtgaagctgaaatagaataagttccagcagtgcggaatttgaaaggtacacctccactagctggtctccatgagtcaccatgcttgccccctagagtgtatatctgacacttggtatgcggttctccagaaattatctctcgaaacagcctaaccaccttgtactcccctgtccgggcatcgaatcccagtccagcagatccagatggcacggtttggcaaggtggcagacggctgatcgacctggttgccgcattgagaacgtagtactctagtcccatagcatcgtgcagaagggtgaggccatggcacggtgtaggcgtcatggccatgaaatcgccgcgcacattgtccagattgaagagcagatcacgatgattgtcaccgccggggactgaccgcgacagcggcgaggatgtgtgcaccgatgtggagccgaatcccgcggtctgcgagacgaagaacagcttgggtggcaacggcttgatcttgttcttggccgtgtggaaaccgcggaattggtcggaagagagagccgtggcccaggacctgcaaacggctcgaaaacgtaggacggattcgacgggtagccattggagcacctcaatcatcatctcttctggcagcactaccgttgcaccactggctggtgaaaccttcctcctcttgcagctcatcatcaccatggatacatcggctcaaattcgccaaaaaaaaaaagtacggcagaacgaagttgcttgtatatcaggacaaggaaggtaaatgttgagttctgaattaaacagggtcaatacatatagaaatataaattaattagccgaaaaggtccaatgcacaatacggtgagaatatataacggattgataataatttgatataggtgtattattagacgaaattagactcatacgggaaaggaacgaactcttctttgcatccaaattgcagatctaacgtggacatggaggttcagaaaaaagcttcaaccttccagacctagaacagaagcttgccctagaggtaaaccaaattcgagaacaggtgcgtgttgtgtagagagatgatcgatcgagatgctcaccaggatgctcctgctcgcgagattgatggagatcggcgcaggtggcgggcgaagttccctcgcgggccgacggggaggagagatactcgagggggagaggcacaatatttttcggcacagatgaatttgacacgttttgggctggtggccgaggcttgtaagttgtaacaccacacggtttcatcaaattttgcggcttgaaaagaaaaatctaaacatccaataagctttgctcactacagatttcatttttgcataaggcccatggggataggcatacgctcaaaaaatcaggattttgcatgcgttcagcccaaccacatgcgaaaaaaaaaaattttcatgcgggcgcttaagccaaccgcatgaaaatcaaaatattgtgaaaaaaataaaattctcaaaaagaagaaacctagccccgccgctgacggtctgccacagctggttgcctaatcccaaaccctagcccgcccatcggcctgccacctgtcgccgctcctgtcacgaccggaaataacccaacaggcattccatgcgtgcgtatattattccttgtcctagagagccgtggcccaggatcggcagacggctcgaaaacgtaggacggattcgacgggcagccactggagcacctcaatcattatctcttctggcagcactaccggtgcaccagcaccactggctggtgaaacctttcttctcttgcagctcatcatcaccatggttgtcaagctcaaattcgccgaaaaaaaagagagtacggcagaacgaagttgcttgtatatcaggacaaggaagttaaatgtcgagttctgaattaaacagggtcaatacatatatagaaatatagattagctgaaaaggtaccacaatacggtgagaatatataccggattattttgatataggtgtattattagacgaaattagtctcgtatgggaaaggaacgaactctttgcatccagattggaataaaccaagagcggatctaacgttccagacctacagcagaagcttgctaggggtaacgcaaatacgagaacaggtgcatattgtagagagatgatcaagatgctcacaaggatgcggcggaaggagcaggacggacgatctcgcgggatcgagggagatcggcgcaggtggcgggcgggcgacctcctccaggggaggctggaggcacaatgattttgggcacagttgaattgtgctaggaatctgatacgttcgggccttcgggggcttggggctggcggccggggctttcaagttttaacacgacacagggtctcatcaactcgcgagagctaattcgcgcgtgcgtgatagcggcacgcgtttaggccataaggcccacagcgctggctcgtacgcacgcagacggcgttcacgtccatattttttttttcgaaaaacctaaacctaacgtacgtgcctttttcgtttctctttgcctttttttctgcgatctttttattttagaagttgaatctttcatcttcaattttagttgaaagttttgaatttgagttaaaagtttttaagatttgagttgaatttttgaattttaagataaaagttttcaaatttgagttaaatgtttcgaattttcaaatgaatgtttttatatctgagttgaaagttttcaaatctttagttaaaagtttttaaatccgagttgaaagttttcaaatatttgacttgaattttttcaaatcgagatttgaaagtttcaaaatataagttgaattttttttaaaaaattggattaaaagtattcaaatcttgactttaaaattttcaaatctgagttaaaagtttttcaaaaatcttgacttaatgttttcaaatccgagtcgaaagtttttaaatctgagttgaaagttttcaaatttggattgaaagttttccaaatctgagtcgaaagtttttaaatctgggttgaaagtttcaaatccgggttgaaagttttccaaatctgagttaaaagttctatttatgtattattttatttaaaaaaactaatactaacaattatcattagcgctaattaacgtcatcaatgctaatcatgttattagcgttgaggagaggtggaattgggacgtgcgtggctgcgccagttaggcagctagcgcacccgcgcccattagcaagcccctcatcaacttgcggctgaaaagaaaaatataaacatccgatcagttctgctaaactttaacccgattaattataaccgatgcttctacttatatgtcccttcttccgcattgtctcctatcttctttttttttttacgactcacacgagacggtgcggttctactgatagagcagaaaaaaattacaagattacaaccttggaaggtcgtaaccaggaaaaaggaaaaatatataccaccacccacacaccgatagcgccaacacataggtccgggagaaggctgtaccggaccggctgccgctagccatgaccgaccgccgctaggccaacaaaggagcatagacgagatcgcacaaaaaacgcccttacaaccaatacaaagcccaactctatcttagagcgtgcttgcaccaatcgttcgagtggttttcagcaaggggatgcctaaatgacatctccaaggagagaagtgatggaaaaccaccgccgccatctgtcagggactcaaaagagccaagactgggctttcgcccgcaactacccttgagggatgagacggcacgacaatgcccttaggaggggggatgaaccattgttttcggtctggccaaggcggggctgggttttcacccgccgctcatcacctgcgagtccacggctgacccaccgatgatccaacaccgctcaacctctaccgacatgtgggaccactgcactggcgccccccgctagccagccttcttgcgccgaagaccgcgccacacccaccagtagctctccttgcatcgtggtcgcctcctttactaccgaccgcgcctcatcgcgccccgctggcctactcaaccaccagacgcgcgtctggcgctagtccggcctcccgccatcagtcgcgcctgtcgcaccaagccggcctgcaccgtcaccagacgcgcctttcgcaccagtccggcctcctaccatcggctgcgcctctctgcgccaagccggcctccgatggtcggagtccgacccttgctccaatcgctgtcgcgctggctaggtgcagccatctgccaagcccccagctagccgtctgagaccaccatgcctcccccagcagtcacggtcaccaccaccgtgcctccacccatcgcagccacagtagtcgctgctgctgacggccagccacctcgccgccgtctagccactagcgtcgttgccacagtagccggcagccgatgctaccgttggccagccacctgttgtcgccgctgtccagtcgctgccaccaccatcgccatgagcccgcgaactccgcagcgccgccaccactgcgggcttgcctcacaccagatctgcccgactccggcgcgactggatccggcccgctgtcaccatcctcgccgccggcttccatccccgccatcatctccatccccgctgccgtcggtccccatatattctccttcttcggctgcccgttgtcgccaccttcccgagtcgcgccggccctagaggtccctgccgtcgcaccgtcgctgacagccgcgccgtcctcctgccaggccaccagccaccatgaagccttgctggctcacccagccaccggcctcctggcaacaccgttggcgcgccgccaccagccagatccgccataaggggtggcaaatgggggccccgcctcaggatccgtggtcatcgccaccgcctccattgatccgcagccatgaagttcccaccgctgaagggacctcacagcgtcaaccgtcacgctcttgcgtcgccctacccccgggacggctccggaggcgacaagtccggccaccccttcccgctccttcttcctcctccacctcgccgctgcctgagcggtcgccagcaaagaccgtaaggatggcggcggcggggcttctcgccagcctgctccggtggccaggggagtcgccccggtggcggcggcggcgaccgctagatccgtgccgccccggcctgatctggcggggtggcggccggcggcagggacagtaatgtcagcaacgaagaaggggattgtctccaatcttcgctttgggataaaaaagaaatgagatttaaaatagcagaaatgttgatagagagcgcaacaattacctgggacagtctttcacacggatccgtcggcagggagcggcaggggttgctacatcggcccgatttggtctgtcgccgccgtctcccaaaaatgagtaaaggaggggactgaaagagcattattctagaaaccatcgctagcggactactactgggtggttctgtcccaaaataatcgggattaataaattggttgacacgtgtctcacgcttgttgataggaaatggattactttaagagcaaggtcaatagtgtagccaactactggctccaaaacatctatagccaatctaatagcccattcatcaatagttaactataaaaatatactgcaccattaatacacggtcccacctctcatacacacataatatcttggagtccgtgttgcaaccggctacaaatctgtagcccgctttcttctctctcttctcttttcttctcgatatatggttacagccggcttatagcctgctattgtacctgctctaaaaaactgtcacgcccggaatttctatccaaaattccaaatgcttatatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacagcgcagacggctccactccacaggcagcttgaccagggctacacctaatcctccacaccatcagcttcactgtagaactcttcctctgatgaatgattgcaagatgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattttaccagttatagcatcttctattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcacaacacaatccactacagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataaagtgagtcataagttatcccaatagtgagctaatgtttctaagcagggctaagcaattatatctaatatctagttgaaccaatacataaagctcaactagtcaagttataataacccaaggtatcaaggaataaagtaatcaagaacaaaagggctataacaaacaataggttaattccacccaatggcattcgaaaataaatgcaatagttgaatagaaacaatagctttaaataggatcaacatgctcaaagggttgtttgggatctgtgtgacttgccttgctggccttggaactcttcaaattcttctccggcgaaaacggactctccggaaacgacggaatctaagcagaaaagaacaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttgcggtggaccgggcgcacgggcggcggttcacgcgaacggacggccgagattcgatccaatccaaacggacggccgagatcgatcgggtccacggcggctcacggcggacgaccccgatgacgtcggcaatgacgtcaccgacggcggcggcggctcggcggggcagacggctcgggcggcgcacgctcgccggcgaacggcggcgcgaggacgaaaacggaaagcaccaggacgaagcgggcggcacgggaactcaccggcgaccaaaacgacggcggaagatcaacggacggcgacggcgacgaggaggaagcggcgaagctcttcgggtcgacgacggcgatgacgctccggcggtcttcggcggtggcgaaggggaggacgaggacggcgacgcgacggcgaacacgacgtcggccttcccgagcgacggcgacggctggagcgacggcggcgcacgactggagcgacggtgacgacggcggcgctagggcacacggtgctagagcttttccggcgacaagaggcgaaggcgagggtggcggcgggtagaggagacaccggggagccttttaaagggactcggaggcggcggcgaaggcccacggcgacggcaacggcgaaggaaagctcggcttggagagagagagcccgatccgattcgaactcgaatccctcgatttccaaaccgatttagccgatgattccataggagaaaaggtagaggagatcccggagattgtttcccctcaatcaatttcaccggaaacggaaaagaacggccggatttggaaaggaacggcggcggcagctcggcggcggcgcgctagggtttcggcccgaggaagatgacgggcctgacaggtgggacccacctgtcagcgatcgaacgcgcgcgcgcgcgcgggcggctgcgaactgggccgacttgggccggggagagagagagaaggttttgggccgactttcggcccaaagccaaaagagaactttttaaaacctttttcaatttaaattatttcttaaatgcaattccatttattaaaaatacttccttagctcaaataaatcccagaaaaatcttggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaaaacgctgctcaattctaatttacagatcgacacgtgtctcgttcgtttgttacttcctccgtttcaggaaagtcaaataacctgaaacggaggcagtagtaaatagattactggctatagggggttttcagttgcaatatattcgtagtaatccatttacaaacgaatctaatagccgatacgcacggtcacgagagtacggtttgttgcaacgtgggacctagtgcatcgtggcaacatggtgtctgttggtatttcttaacgacattactaaaaatataattcccagcaatggcgcataaatactcatgttatattatggttatagagttcacccacaaacgcacggatataccattgtaccatttcacccgagagtattctaagagtatcatatttattttatcccgtgggaagatcatgtagaaagaaattgactaataatttatatattacttgtgataatcatatcctaagcaggagttaagataatccaagggtagagtgacacacaagctgtagctactcattctcatactaaattatataagctaagtggaaagaaaagagaaagataatctactcctatacttctagtatacatagtatacatacattctagttttctgatatactagctaataccctctatccaatgccctcctggtacttcgaaaagccacccctgactgctgagtttcttatgacagcccgtcatgaccatacaaccggggctaaatacgtaggagtaccctccccagggaattaacgtagtattatatacacgcgcggaggaatacccgtactgagctgtcaccatcagcggcccacatctcatccgcagcatataaccccaaataatgatatcccgtaatctagacaccacgtctaaactaccggatactactctaatatcatcgtcacgacatagagtaattgcatatgcaaacattatacccgcaccaaagcatgtcctagataagctagcagtatattcagtataacacgaacataatgtaaagttgtcattaatatactcggaaagtatttcaataccataaatgtataaagaagagtattctaaataaagtacaaggcttacaaaagaggaaaggaaagctactagagccatacccgaactcttcagaagacttccaaactccttatttctactctattcctattccactagtttaagaacactaaactaacttgagagaatataagagagctcttgcttgaagtgtgtgagtgaagtaagaagaggagctccttttatagctgaactatgacggttgtgatggttacaatggtcggtaataccctccaactgtcattggggcttcatctcaaccgtccagtcaaaacctgcatccaacggtggcatggtgggttcggccgaaccagggaccggcccaatccagcccaatttcggctggcggcctccttcgttgttctcctttgcagacttatgaattttggcccaatccagaatgtcaactttgaattcttggcccattcatgcataagtttgattctcgacatcgtccgattgatttatcgtttgagttgatgccgattctcctttacttaatgtttattctctgtaaaaggttagtaaacctaatactagtggaatattattattctaacatatttatgcattgcaagcatcactagttcttctctatttaggtaatattgatagtcgaaactgattgataacgactgtcaatagtgccttgtccataagaacatgggtacgcgtgtcctacgtggacacaattaggcgctcagaatattaggaggtgttgtgcttctaataatatctctaataaattcatgctatctctaaaaattgtgaaataaatcttgttaaactctaagggaacatactctatactgcagtgaccttgttaaactctaagggaatacactctatactgcagtgacccgaaacttaaaaaaacttgattctaaactgcataaaaa

SEQ ID NO: 35840 - DNA, 3873 bp, Oryza sativa
cggagaaggaaaggaacggccgaatttggaaaggaacggcggtggcggcgtgctagggtttcggcccgaggaagacgacgggcctgacaggtggaccccacctgtcagcggcagcgagggcgcgcgcgcgggcggctgcgaactgggccggctgggccgaggagagagagaaagcggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacccctttaaaggctccccggtgtctcctctacccgccgccaccctcgccttctcctctcgtcgtcggaaacgccctagcgccgtgtgccctagcgtcgccgtcgccgccgtcgctcccgccgtgcgccgccgtcgttctcgtcgtcgccgtcgctcgggaagaccgccgttgtggtcgccaagtcatcgccgtcctcgtccgccccttcgccgtcgttgtagaccgccggagcaccgtcgccgtcgtcaagctgaagagctccgccgtttcaacctcatcgccgtcgccgtccgttggtcttccgccgctcctttggtcatcggtgagttcgccgcgtcgcgctctacccgttggtgtcctccgttcgtgccgaagcgccgccgttcgccggtgagcttgcgccgtccgagctgtcgagccgccgccgccggtggtgatgtcatcaccgacgtcatcgtcgccctctcccgtgagccggtcgtagaccgatcgatctcggccgtctgttttggatggatcgatctcggccgtccgttcgcgtgaactgccgccgtgcgcccggtccaccgaaaccctagcctgctgacgcaataaatccctttttccttttcaaaaataattcattattgcgtcataattcaattaaaatcaatataagtgttttaatctgattaaatcttcaaaaattcataactaattcatcttagctccgatttagttggttcaagtctctaaatttttctaaaattgagatctacatattaaaaatatccacatgtactgttcatgcttatttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttcttttcaactattgcatttattttcgaatgtcattgggtggatttaacctattgtttgatatagccctttttgttattggttcctttattccttgataccttgggttattataatttgactagttgaactttatatatattggttcaactagatattagatataatagcttagccctacttagaaacattagttcactattgggataacttatgactcactattatttaatgatggcttaatgatagttcacgatggacaatcgtgattggttaattaattaatatgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataaggtggtgattatgatccacgaaaggtgcgctgcggtggaattgtgttatgcaaggggtattgtcacagctcctttccgaggtaccgtggtggtattgaggcacatggtgacatgatgtggggctgtgtcttgtgggtacagtagtacacctctaatcagagtaaaactattcgaatagccgtgcccgcggttatggacgggtctaacaatgtctttcgtgattagtctcacacctctcacaataatttgatgctataattggtaataatttgattagctcctggtttggaatggtacattcctggtttggagatagaactgtgcagccgggatggttgttcagaatggatgggcctatacaacagggtatgttgtatagcgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctccctgtggagtggagccgtctgcgccgtttatcttttttttccgctgcttagatctttattgtttgagaggaactatctacctctgtaatgacattttcttcgcttattaattagagtaataattgtatcctattatcaatttgttattgtgtgcctcggctgattcctggacgagggttcacacatatgtaagcgtttggaattttggatagaaattccgggcgtgacaccttacattggcagtacccgctccatgaacttacatcctcatgcactctaagcgtcataagtttctagcacagagaggagttctggcactcccgagggggaaactcacgcaagcctaacattgcatcctgtagttgaacccaatccatgctgtcctcttttgggtatctccttgtagtcttgtaatcttgacaagtcagtctctggccatccatatcaggtatccgccatttggccatccgtatcgggtatcagccagcaaactgcttgttcgtccacacacctaagtgaaaccactatgtagggatactgcctccgctcgcctatctactccgctaggtctatacccattcgagaagtacggttgtactggggtcgtttcatgcttaacttcatggctcgatccttaactgatcagggacggcactagcctttactggacaccacccaagccctccagccgccctagtcgaaaacatttgttcagtttaattttctttcacatatcatctcatcattatcatggcaatgtggcgctcatgtctccacatgctgtatgtcaattaccttccctaagataattgcccaagcataaagcattttgacaaatatgaatatgcatggatcaaaattagcatgggctaagcatttgtcaaatattgactaaagacacacgatatcatggattacaaagattatatggataatcaatatcaaaggtatggcatataacaaggtaggacattcacatataaatagcatgcaaactttatttaaatcaaaataagttcgcaataagtccaacatgctcaaagattagtgatgacttgccttgctcgcagatttgctgacccggatcttcgattaactcagcaactccttcggaatctaaatttacgtgcgaaagatttgatttgaattcaattagaattcaaataaaatcaccaaaaattcaaaaattacaaattaaatcgagaaagtggtaccaacagttagatcttgattttagataaatttaggttcaagtttcattcgaatccgagttaaaatgagtgagttatgcaag

SEQ ID NO: 35841 - DNA, 4462 bp, Oryza sativa
ggcgaattcgagctcggtacccagtttaattctctttcacatatcatctcatcattatcatggcaatgtggcgctcatgtctccacatgctgtatgtcaattaccttccctaagataattgcccaagcataaagcattttgacaaatatgaatatgcatggatcaaaattagcatgggctaagcatttgtcaaatattgactaaagacacacgatatcatggattacaaagactatatggatcatcaatatcaaaggtatggcatataacaaggtaggacattcacatataaatagcatgcaaactttatttaaatcaaaataagttcgcaataagtccaacatgctcaaagattagtgatgacttgccttgctcgcagatttgctgacccggatcttcgattaactcagcaactccttcggaatctaaatttacgtgcgaaagatttgatttgaattcaattagaattcaaataaaatcaccaaaaattcaaaaattacaaattaaatcgagaaagtggtaccaacagttagatcttgattttagataaatttaggttcaagtttcattcgaatccgagttaaaatgagtgagttatgcaagtttaaagattcaaatttgaattaattccaataattgtgaaatgttactattcataattgatttatttttattccagcattaaccgtatgtggtagtgactgacaggtgggtccattcttatttccttttctttatcttattctttcaaaggaaatgagatgtgctattgacaggtgggtccggcccctttttgactgtggttaagccggccatataatctccggtgggtcccgcctgtcattgtaacaaaatctataattaagtttacttagattttaataatagggaccccacatgtcattgagtgggttaatcaccattaggtggaggattactgtgcgcaaactagatgtgggccccacacggtttctctctctcgtccctttctttttcccgtcgtcttctacctctcgccaggcagaggcagccgcgccatgcgcctagcgcgcatgccgggacggtgcgaggccggcacagcagcagccggggaggatgaggcgaatctccagcgacctcccgccggcaacaacggtgcagtacggcgcgggggcgagcggcgcggcatggccgccatggccgagctccggggtgcaaggggacagggcggtagggctaggttccacccaaatagatgggtgcgcaagcttctacagtgtatggtggttccgtttttctaacaagatggaaggggaagcctccgggatagcatgtccacggggacatcgccggcggcggaacagcagccgggccggcacggccatgggtgctaatattagggtagaggacgctaaggtgggatggcgagtcggcgaaacgcggcgtcgcggtggggaggcggtaaggaagcagaggatgccgacggcggcgagcgcacaggcgttcgacagcaggtcctcgggctccagcggcacccggcgttgatcgaaggcatcagcagcaacagaggcggcccgagccacggttcccgcggtcagctacgccggcttcggctacgcatgcacctaaggtgttcgatgaaatgtatttgaggaagaaggtagagagggatgggtttttttttatgggggtttggcttggggataagccataatggcatggaggataaggtcgacgacaggcgcgctcgatggctgtctacggcctaggtttagggaggttgacgcggctaagctttcctccacctatgattcgggttcaatgcatcgatcgggcatgattgcctatgcgatagccgatagggtttcagaagagggagtactagctggggaagaaacatcgcattatccaacggtctcagctaggggcgacgagatggcaatgcgatggcgacatgattagcggcgacgggcagtggtaacgaccgccgatacagaggtgcaggctattttctagggtgacgcggaacaacgtggcggccgttatccctcagctcgttggcgactcgcgatgagacgggacgacgcaggcgcttgtggtgacgcggcctttgtgcgggatttcggcggctcggtcggtcggcggtcccacgcgggcgtggcacggcacacggcgcggcgcacggtgcaaggtgaccaggagggcgcaccggtcgtgcgcgacacgttcgcggctcggaggtgtggcgttgtgtgtgcggcttgggctagggctctggtcgagcacctggcggcctaggaacagtggcggctgggaaaaagagagaaaaggaagaaaagggaataggaaaagatggaggggccaaactgcacaatgtcttggattggaattctgaattgagatgtaacctatacattttgggtttaagaattcaaatatttgatttgaatatttatttatttattcattcatcatttcccaaaatgaaattggctttactttatatcatcctaaattcatcctatataactcgaaggctttgatatttctaaagttaattaaaatattctaatgtgacctttaataatacattagcacatcggtcgagtttatttgtatggcaatgtattgcattttgatatgtttaatctattcaattcctattccatgaaggcactgtgagacttggtgcaatatcagtctaaatattgaatcgagtactcatataagcctttttatatatagaactcaatttatttacatactaattattttatgtgagtgaaatttattccatgagagcctcaaggcaagttatacatatcaacttaattattagggtcgttgtagtggtgactatttcatatgtacttagatgtcacagacacttatcacatggctccaatatttaatatttaacctataaattaaattagtaattaacattctctttgtattgctttgttgtgttgtgtgtaaatatttgtagggttcacaataaataccataattttataactattacttagttgtatagctttagcttaattttcatttgtgacaatttatagtttggcaagcaataacaaccataacatccatcatgatgcacaacaaaagaaccaataacattggcaatgcaatttatttaaaagtttttgaaagtactcaacttcgggtttcattttattggtcgaattttcagggtgttacaatgagcaaccgctggacccactattggtggggagggaggaggagagaagtgcggcaaaggaggagcgggtggtggtggatcttttttttttttgaaactgagaccattagcccggctttttatagaaagccaaacacggcatcgttatggggatacccattttacatcacgcacagaaaaggtccagaattaacaccattagggggggataaaaactgaacagcattaacaggaaccaaaacaactctaagacggtcttaacatcaaaactctcaagctaagtaaacgactaagaactaaaaacttcagacgatcagccaactccagatcttggttgtctcagagttgaagtagcatccatgagcttccgagtaatcttgtcaaaattctcagcgtccttgctgctaaggattctcccgagctgcaaaaatgaattgatttggaacattaatgataggggtgagtagactaatttttctctaaaaatcatgttgttcctagtggaccacagcacccagcaaactgcagcaagtagggacaaaagaactctcagatcatccccacccaaagagccattgatcaggtagaaatcctcaaaagacctaggtataatactcgagtcaaaagcatctctgcatatgcaccaaactaaagaggccattgggcattggaaaagaatgtgatcagtggtttcaagcatcccacaaagaacacaaaactcagaacccttccacccatttttcttcagctgttcagtagattgaatcctgtttttcaaagcaagcgacagaaagtgtttaattttttcaaggcagggacatttccacacaccctgcattctagtgttagtcactcctctaaagagaattgctcgatacatggatttagaggtgtaagttttattcttattaagcccccaaagaaacacatctgggccatcagacaactcaatagagttaatgatatccacaatagctagccattcctcagattctctctccccaaaagaccttctaaaagtgagagcattagcatttgcagtgacctcagcaactaagatgttttgttgattgcaaatctcaaaaattcttgcgaagcaaattttcatggggcatgtgccatgccacacatcatgccagaaccagatatggtcacccttccccaaagcccattctgaaccaagtttcaaccatttcctaatgttcataatccccttccagaactgggagccagaatctgaacattggaaaactctagaattcctcaaat

SEQ ID NO: 35842 - DNA, 579 bp, Oryza sativa
cgacgatttttcttttgcatgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccgtatgtcctcgatggcaccgtaatacgtggcagttgttccatcgtgtcccatggcatcgacacaaacagcgctgttttggttcgtgctcttcatgtcttgggctctcgtgtagaatgtgtacccattgatctcatatccctggaatgtcgcgatcgaccaagacggtcccctcgccaggaaggcaagttgttggttgatcgactcgttacccatgagatgttgtcgtagccacgcggggaaagtatcaatgtgatgccgtgtaatccatgcatcggacttaccgatgttcttggcgcgaactagagccaagtgct

SEQ ID NO: 35843 - DNA, 606 bp, Oryza sativa
  unsure (1)..(606): unsure at all n locations
ctgcagggacccgcatctctatggtgggaccatttccaggctacgcagccagaggggcaacctattacttgggctcgcttcaccgccgctttccgaaggacccatgtgcccgctggagtcgtggcacttaagaaaagagaattccgagagttgaagcaaggcaaccgctccgtgatggagtatttgcacgagttcaacaacttggcccgttacgccccagaggatgtgcgggaagatgaggagaagcaagagaagttcttggcaggaatggaccctgagctgtccgtccgtctagtctctggggattatccggattttcaacgactggtggacaagagcatccgcttggaagccaagcacaaggaactggagtcgcacaagcgccgcttggcaaatttccgcaatcagcagggtgctaaccaaagggtccgctacaccaatccctatccagggggatcctcctcgcgcagcagcaacaacagcagcagcaacctcgctccgcgcctcgacctcaattcgtggtgcgcgtcccacagccgcagcagcagcagaatcagcaagnnnnnnnnnnnnnnnnnnnnnnnnnnnnnnnnnnnnnnnnnnnnn

SEQ ID NO: 35844 - DNA, 349 bp, Oryza sativa
cgaaagaagagaagattgatttgctaacatgtttgagtggtataaaggttccatctggttactcatcaagaatcagtaggctcgtttcactaaagatcttaagttggtaggaatgaagtcgcatgattgccacgttcttatcacacagctgttgcccgttgcaataaggaatattttgcctcctaaggtgcgacacacgatccagcggttgtgttccttcttcgatgcaatcggccagaagatcattgatcccgagggactagatgaactaaaggcagaacttgtgagaaccatatgtcatcttgagatgtactttcctccaactttctttgacataatggaacatctt

SEQ ID NO: 35845 - DNA, 4111 bp, Oryza sativa
tccccgacctcccaagacgacgccggtatccacgacgccggcaactgcaccgccgaccaggtacgacgcccccctcatcctgaacatgatatgatgaatggatgaattgcagtttggttggatgacttgcttgaattgaatggatgaattgcatgattgatgaaatatatgaggtgatgaatttgcactgtttgtggatgaaatatatgcactgtttttagtctttttgtattagatgattttaggattaattttggccttggtatatggaatatatagccagggttaattttggccttgattaattttggccctggtgattaattttgtggatgaaatatatgctactgctgttatatggccctgctactgctctgctgtttatgtttctgttgtttctgtttatgtttctgttgttgtttatggccctgctactgctgttatatggccctgctactgctctgatgtttaattttggccctggtgattaattttgtggatgaaatatatgctactgctgttatatggccctgctacagtgctactgctctgctgtttattaattttgtggattaaaaataatgactctgctgttatatggccctgctactgctcttattgtgcctacttgttctttttttttatctacaattgtttatatacatgatttatataccactgctgttgttgcccctgtacttcttattaaatggccaatgatgaattgctcaataaaattctatctatacctgttcttttctttatggataagaacagactatctacacttgttgatttatatacccttgctgtcaaggatgaatttccctctgctgttgctgtttatgtgaatttccccctgttgttgctgtttacgtgaatttccccctactgttgctacccctgtggcatatatacccctactgctgttatatggccatgctactactcttattgtgcctacttgttcatttttttatctacaataatatatgcatgatttatataccactgctgttgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctactattatatggccatgctgttgctactgctctaatttcctgcacttgctcttttctttatggataagaacagatgaactacacttgttctattttatggataagaacagatgaactacacttgttctattttctttgggttgctttttcctcctagtagctgatttcctctttttatcccttcatgcaaatgattataattgatgcatatttctgagcaaaactgaggccatatctttcatagtataccccgtattacattggatctaatgctatttagtataatggtaggaaatttataagctttttcgcgaaaattagaccatgtcaacgcccggcgcaaacccgctctccccaatacctgcgaggatccaggaagaagcaaacccagccacggagacagttgccgaaggtcatcccgcgacaacggcggtccaacaacccaaaattcatggtaatttataggataaattttcaccacatgaccacataaattttagctagcaccccttagcaaatattgccttctgtttgtgctgcagaattgccacaggaacaacatacatcgatgtcgggcgggacaagtgcaagtaggtctagtagaaatccctagtcacaaaatatatggccgaccatagtgcaagttataagagaggttgacgctagtggtaggcccaccgcgcccatgactgtcattggaagatggtctaactgctgcgggctagaggcacgtaagaacttccggatcctccataaaaatatcgggaagggcacagaagccgagaaagagcgagcttggacgggaatggagaaatggttcacatttccggctgaagcaaaggataggctcaagcggaaggcattccaaaagatggcaaaagcttggaagaattggaagtcgaagctcttcaccgagtttgtcaacctgcccgacaatcatacgccgttcgatgaataccctcaaataaccgaagcggtgtgggaggaattctgctctctcaagacctcccaagagtttagggaatcaagcgaggcacatcgcctactacaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggtgcgggcaaggggtaaggtcaacccggacggctctgtcacatttgagaacaaaagtgatgccgtcgtctatcaggaactggtgagttcactacttaacctaactaatttccgctcgtataaagtacaagttcgtataaacgactattttcttttctagttgggcttggttgctgaacaagcttcacaaagcgaggttgagtccgcgccgaagaggcgcgaagatgacatcctcacaaaggcacttggaaccaaagaacatcctggccgaactcggggaattggtagcgatgtgccctggaagcatggactctctcagtacagctcccaatacaggaaatgaaaagtctccaaggaagagagggatgctcgtttgaaggccgaacataaggttgaggtcattcaagaactagaagctagcatgaatgcaagggtggaagaaagggttaacaaggtcctcgccgacatgaatataccccgtcacaacacctgctgtgcaaccaactcctcgtgcacaacacgacgcgagtccgtcacagcataggagtagttgtgcatccacagaggtgccggcccctggtcttccgatcgcaccactagctgcagtggaccacatcgaggtaattgttgttatccgatccatatctaataaaagacatttacacgttccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctactagctgggtatgccaaggtgtccatcgatatagtaaaggacacctggtcaggctatccgctgcccgtgcccccaaatgatgaaatcatgactttaggcgatgcgcgcaagacgttcatacaatggcccaaagaagacatagttgtgaagatgactcctcgtccaagtcgaccgacggagtttacacctcccaagtttaagctatcaattgaggctccccgtggaccggcattgtcagtacctcattctcctggtggagctgatatggacttggcagatatagctcaaagcttggctccaataaagaccacaagaaaggccgatagctccccaccacttgtcaagggccagaagcgtgaacacggcaaggggaaggtcggggagttggcgccggagccaaaaagagacaaggctgcgacgtcgatgccaaaaaggggcaaggctgcgccagctcaatttgagctaggcatgccattggtggaggacaatgtgttagccgtgatgggtattgcttgccgagagctacataaacaatacatggagctaagcaatgccaagcggaaaatgagggagtcatccatagttagacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgattggactatatctcctaattaaattagttctaatacgtaaatgttttaaggttgtgttggatcgagagtcg

SEQ ID NO: 35846 - DNA, 1115 bp, Oryza sativa
  unsure (1)..(1115): unsure at all n locations
tttttgaagttaaggtttttagtactaacactacataaccactgcgcaggcgacatggattctcctagtcatcgtacctaagtggagtagggttacctaccttaactccaataagtccaaagattatgatttcagtgaaatcaccaaggccttaaatatggcttggggcccatatgtggaaaagggtggtaggcacaagaagggcaaggacgaactttatcatgacaccaagtttgcatgcgcacaacagatcggagaccaatgtggtttccacgtgtgccacaacatgttaacacttctaagagaggtgaaagatttcgacccttaggttgttgctaatggcgaataagctcatttcaatacctacattgctattgaaaacgtgctaattaacctcttatttattaaacagaaaggtagagctggcttcaagatctcacccatcaaccctcccgctatcagaggcgaagtgtgcgccttcattcttgcagaaataatgaacaagaaaggacgttttcatgtcaaatagactcatgaacttggctagataatttattgtgatgtaaaaagatgtttttataatttcttgcgatgtaaaaaattatgtttttatggagtgcaatgtaatttactttcatatgtgcaatatttatggtagtttactaaattgtcatcacatttgatcaactacgatttacgttgtactattcatctgttttctccttttttttcccttattgataggttgtggaggtcgagtacattatggctttaatccatttggtaagtatatatgcggttctatgagcaacgaccgaaattgtggctttcaaggggtgtgaatttgctgtgcaaatttgtggcatttgaactgcatatatgtgttgttggggatctgtgatgtttgagatggatctgtgatgttatattgggggggtgatgtatctgtgactagaatatatctgtaatgtatctgtgtttcagagggcatggctagcaaatcctaagactagccaatatttagcatttatttatttcttctgaaattaactcannnnnnnnnnnnnnnnnnnnnnnnnnnnnnnnnnnnnnnnnnnnnnnnnnnnnnnnnnnnn

SEQ ID NO: 35847 - DNA, 7037 bp, Oryza sativa
ccaagataccacattatcattcactaattaacaagatgctacatcatcatccattaacaatcatcacatttaaacatcatgcaaacatgctatatctttatagtttttataatttaacagcttttcaactacaaacatgttaaattatcatccaacatcattcacataatgtttcaatgtatatctttttatgttttatgatatcctatatacttatatagttcatcctcacttagtgattaaatgattaatctatggtccaaattatctttttccttttttcctctaattaagtcatatcacatcaattgtttttagcctttagatgattatacggtccaaattatctccctacttttcttcttccataaagtcataccaacttactttttacgtttgaatcaccaatctatatactaattaaatttaaattatcataaaccacattaatttacttaatctgatgttatctatctatctacatgttatttttttaaagttatcataccgaattcccgcagcaaatgcgcgaggttttatctagttaatatagcacctagccaccaagtgtccatagcctcgctacaacaaaacaacccaacggagacattttatttgtaggatagagacgtgacgttttatttcgtctcccacagataactgaggcgcttttataaagcatagtaggaatgtcaatgtttgcaccgtctcaaaattatggagacgctttttaaagcgtacctacattatataagacgttgctagagacgtgtaaattgcatatctataaaatatagaaacgcttttatacaagcattaatataggcacatacgtcttaatatatttgatattgaatatttaacgctttcatccgggctcgcacacagcacctacgggttgcaaagttcaggcactaaccaagtcattgacgtgaacaatcttgaaggtaaatacacttttttttttatattgcaactcttcaaacatgcgtcctgtagcagatactcttctttttaatctgagactggatattaaatattcaagtttttttgtccaaataaatataatattattataatggtatttgatgatgacgattaggatcagtgtgtttgttttcgtctttctctatataaataattatatattggctaataacgatgacacgcatataataaaaacgtctcaaaactcatctgtacagatgagacgttccaaaacgtctcaatattcatctctaaacgatttaattttgtgctaacctgtaaagcgtcttaaactatgtcctcaacaaataaagcgtctcaaacatcgtccctatttcaacattaaacaatggttctgttgtagtatatcctctccttgcgtatgtacactacatggttacattatggtgcccttctttatttaaaggattgtcgggttatatagtccaaatctaactccactccctgcgacatattccaactccaagtccaactcctagtagaactagtatcttcgacaaatattctaacaaagtccagcttcgaatatatgatacctagaagcagtagaattaccataccgatccatcggtcctccaaacttgaattgtcttcatttgaatcttcactgtaagccacccgatgagcctacaccaaactcaccgtcattaagagactccaccttaactcaaccttctctcgactccacctttccaccttctttcctatcattaaagtcgtattgcaaagcgaaaatggactactccttagctgaacaccctagactcctcgaagactgtcagggttatggataaggtataccctctacccttggatgtacgctatacggcaatacggtatatcggcgcgtgtacggacgttctctgaatacgttaaggaaattcatttcgaagtccaccaatggaaaggttcctacccatataggactgggtcgcactatatcgtgtagggtccgatgtctccgagtcctacttggagacctcctgacctgcgatataaaagggaccctccgggaagacctagggcatcgaatctcatagccaacatgtcacaccctaaaaattcaaattatataaattgttgtttaaatggaatttctagaaaataattttaaaagtcttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttggctttgggccgaaagtcggcccaaaaccgctttctctctctcctcggcccagccggcccagttcgcagccgcccgcgcgcgcgccctcgctgccgctgacaggtggggtccacctgtcaggcccgtcgtcttcctcgggccgaaaccctagcacgccgccaccgccgttcctttccaaattcggccgttcctttccttctccggccgagtcaatagaggggaaatgatcctcgggatctcctctaccttttctcctttggaatcatcggctaaatcggtttggaaatcgagggattcgagttcgaatcggatcgggctctctctctccaagccgagctttccttcgccgttgccgtcgccgtgggccttcgccgccgcctccgagtccctttaaaaggctccccgtggtctcctctacccgtcgccaccctcgccttcgcctctcgtcgccggaagagctctagcgccgtgtgccctagcgccgccgtcgtcgccgccgctccagccgtgctccgccgccgttccagacgtcgccgtcgctcgggaaggacgtcatcgtggtcgccgttgcgtcgccgtcctcgtccgccccttcgccgccgccgaagatcgccggagcatcatcgccgtcgtcgacccgaagagcttcgccgcttcctcctcgtcgccgtcgccgtccgttgaccttccgccgccgttgtggtcaccggtgagttcgccgcgtcgtcctctacgtgctggtgccttccgtttgcgtcctcgcgccgtcgttcgccagcgagcgtttgcgtcctcgcgccgtctgctccgccgagccgccgccgccgtcggtgacgtcattgccgacgtcatcgaggtcgtccgctgtgagccgccgtggacccgatcgatctcggccgtccatcttagatcggttcgatctcggccgtccgttcgcgtgaaccgccgccgtgcgcccggtccaccgcaaaccctagcccgctgacgcaataaaccttcttttccttttcaaaaataattcattattgcgtcataattcaattttaaccgatataagtgttttaatccgatttaatctttaaaaattcataactaattcatcttagctccgatttagttggttcaagtctctaattttttctaaaattgagatctacatgttaaaaatatccacatgtactgttcatgcttgtttatgtgctgttttggtgattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgggctttatttattggttcaactagatattagatataattgctcagccctgcttagaaacattagcacactattgggataacttatgactcactttatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcaatggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataatagaagatgctataactggtaaaatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaaagctgcttttgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacacaacacaacgaccacagcctacgaagccggagcctacaggagccaagtcgccgggtgatctagtcgaatcaactcgactacgatctcgctggtatcatccagttctattattccctttgtaatttgtggtcatctccatataatcctatatcaactggattagggctattacctatttaggggcctgaaccagtataatctttgtctcttgtttccttcatgtcgtactacgttgatcatcgtaccagtgtaccccaataccctctatatccggtctatgggtacccatcgtcgacagtggcgcgccacgtagggagctttggtgctcaaggttctactactatgacatcaagcttcgtcgacaacggcgtcagcaccggccccattcatggagtccctacttgaacaatgctggtgtggactcaagttggcgaaatcatcttcccggtttacaccacggtgccaatctcggctggtccatcaattatcggaaacgagaacgccgtggctataaccccggacgatcccgcgtctaaggatcctcccgccgtagcagagaatggaacatcgacgtcatacgagcccgagaaggttcctagtgtggccgaaccttgtccttccgacaagaactccgagccgacaaggacaacttctgaggtaaaaaagtcctggtatcctatccacaagtccaggaagcacaacttgcaagcttgctgggtttttctcaacgtacaagctaaaattcgtgcttgcaaagagcgtggaatccagcgtacttctccaactcatgatgtctattgtcctattcacaagacgaagaatcacgacttctcaagctacaaggtctttctccacgccatgaaaacgacgcttcctaaggtccagcaggtaggaacctctcgtaagggcacaaacaaggaacaaggagcgacgttgacctcggatcgatttgttggagtaatcgacattgatccccacgagccatcagtcctacacttgctcgaagactatggctcatcatcttccagtacaccacgcgacatgtttgccatcggtgggactagcacgtctgcacacgctaacgcaggggcggagaaccagacggtcacgccggcccaacatctcggcaccatcaatgcagtactgagagaagctccctatgaccccgttcttaacgatgatctcgcacgatggatagaacgactatgggaatcggtagccaatctcagtaacgcgttcgaggaagccgctaccagagcacaacaagagcgactgatagctggcgctgccaacggcgaaccaccggagcagcggacgtcacctagatgagctacccatccacctcgcagcaccggcgatctccgcgaccatctgaatggccgccgagaagcacgacgcacgcgagacaatgagaatcattcccgacatcgtgtttcttcacaacgtcgcgagaacgaagagcgagtgtcacacccagaaattctcgaaccagaatttgtaagctgaatgtgcattaaatccctgtccaggaccagccagggtacacaaacgacatttgttgacatacagacccacgtcttacaaaaatataaaagattacaaatgcagcgagaaagataaaagcgagctaaaccgggaagcttgacttcagcagcgggcgactccactccacaagcaaaccttgacggcagcgacgaaaccaacctctctgagacggctccatctgagaagaacttcaactctggtgtgggggaaaagagagcaagactgagtactacccactgtactcagcaagtcataccggaaaaggaggtatgatgcaggatataaccaaaggaagctaggggttcttttgcataaagcaggcatttcaaagcagtagttgaaagcagtaaaatagctgtagtaattaatcaatattaaccaattactgtccaacgctacaccacgttgcaacaggcccaaccaaccacctgaactacaccagctcatt

SEQ ID NO: 35848 - DNA, 3644 bp, Oryza sativa
actctattatcaatttgttattgtgtgcctcggctgattcctggacgagggtttacacacatgtaagcgtttggaattttggatagaaattccgggcgtgacaagttggtatcagagctcccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttccagcaaaaattttacaatgttgtttcatttaatcttgctgcaataaaataaatttaacaagttgattttataactttcttttatttcttttggaacctgttattcaaaagtataaaacttgtaacctggtttccaactgtttcaacttatcttgcaaacttggtttactttgtttacttaccttttactttgaatttctaaaactttattcaaattaatccaaaaacttgtgatattaattggatagatgtcttaactccctcctttcacttgtgtttagatgccgcgctacaagcctgagtacttgtttggtgttgagggttttgtccaggagttgcgtacaatgtcctttgtcattggatttgggactgcccctttttatgctcagattcctcatgatcgtcatgaagagaggtgccgagtcaaagtcaccttgaacagtaatagtgaagacattctatcagtgatgttcgaagctggaggaagaaactacatccatgcatgtcaggaagtggcaaggatcgccataggagagctccgcgatcgctacagtgatcaattggccgacactgagtatcgttaccatcctcgtcaaccacagggaagtgaccgtggcagttaccttgagactgaaggaattgagaatgatgctaccacaagacatttggttgagatgctatgggctatggatgaaagtcatgcagagactgtgttagcagcccaagatcgtgaagattggaatcgtggtaagatttgcaagctagaagacaaggtggatcgtttggagaaggaactagctgcgttgaagggagaagcaccgccgcagaaggccaggattcgtcttaccgcaaggaagagagctctatttgtccctcgttatcaattggcgccaaaggtccgtgtggtggagaaagaagttgccccagcagatcctccggtcgtcaacgtaagtgatgatgaagaagaagaatccaagcgcaaccattccaagattgagtgggtagcaactcaagatgatgaagacgagccgaacgagccttcaatcgacctccgatgctcggaagaactagagtgacttgttaagtcgttgtcttagatcgttgtgttagtttgcttgttttaagtttgcttgtgtgtgggtcttgcatgtgatttacatcagtggtaggatgtaagtgcatgcgtttgtttgttttttttgagtgttaggaagttggtgagtttagtggtgtgagagtcttcagtttgtaataatgaaactcagttaagatcaataaaagttaaagtaattctctgtcctaagtagttttccccggtttctcttcttgtgccctgtccatgccagatggtgaacactcgcagcaacgggaatggtcccaacctcaacaaccccaacaacaacaataacaatgaggggaacccaacccttgctcaagttcttgctcaacagactcagctaatgcacatgatgatgcaacaacttcagaatcagcagaaccaaggaaataaccatgcacctcctcagaataagttagcagaatttcttcgtgtgaggccgcctattttctctagtaccactaaccctgttgaagctggtgattggctgcatgccatagagaagaagttggatttgcttcagtgcactgatcaggagaaggtctcatttgcatcacaccagttgcatggccctgcctctgaatggtgggatcacttccgtctgaataggactactgctgaacctatcacttggcttgaattgaccgctgcttttcggaagacgcatataccatcgggagtggtgtctctcaagaagaaggagttcaggtcgcttacccagggatctcgcactgttacggagtatctacacgagttcaatcgtctagcccgttatgctccggaaaatgtacgcaatgatgaagagcgtcaggagaagttcttggaaggacttaatgatgagctttcttacccactcatgactggagattattctgatttccagaaattagtggataaggctattcgtcaggaggacaagtataatcgcatggagcagaagaaacgccagattgctcaattcaagacgcaacaggggaataatcagaggccgcgtcttactttaggaccccagtctatgccacatggaggttcttcgtctgtcgttcgtccgcagcgtcagttcttcaacaacaatgttggcaacaacatccgcaatcaagttccacgtcttattgcagctccaacacaacaacagcctgccaagagggagcaaggtagcaagcccgtggtgtgtttcaactgtggagacccgggacattatgctgacaagtgtccgaagccccgacgcgtgaaggttgtccctgtccagagcaactctaccgcaccagcatcaaaggcccgtgtcaatcatgttgcagctgcagaagctcaagatgctccagatgtgattttgggtacgttccttgttaactcagttcctgcaacagtgcttttcgattctggtgctacacattcatttctatctatgagttttgcgggaaatcatgggatggaagtagaagatcttagacgtcctttgatggttagtaccccaagtaatcaagcactctctttgcaacgtagcccctctgtcagaatagaaattaagggagtaccatttctggccaatcttatcttgttagaatccaaagaccttgatgtcatcctagggatggactggttaaccagacataaaggtgttatagactgtgctaacagaaaagtaactctcaccagtagtgatggtcgagttgtaactgttcatgcattatcttctgagtctttaaggtcaagactgactcagataactttggaagagattcctatagtccgggagtatcccgatgtgttcccagatgatttacctggtatgccgcccaaaagggatatagagttcagaatagatttggtacctggaacaactccgattcataagaggccttatagaatggcagccaatgagttggcagaagtcaagaggcaagtggatgatttgcttcagaagggatacatcagaccgagttcatctccatggggagctccggttatttttgtggaaaagaaagatcatacccagaggatgtgtgtggactatcgtgcattaaatgatgtgactatcaagaataagtatccactacccagaattgatgatttgtttgatcagcttaaaggtgccactgttttctctaagatcgatcttcgatcagggtatcaccagttgagaatcaaagaggaagatatacctaagacagcttttaccactaggtatggattgttcgaatg

SEQ ID NO: 35849 - DNA, 1650 bp, Oryza sativa
  unsure (1)..(1650): unsure at all n locations
nnnnnnnnnnnnnnnnnnnnnnnnnnnnnnnnnnnnnnatgtcatcctagggatggactggttagccagacataaaggtgtgatagactgtgctaacagaaaagtaactctcaccagtaatgatggtcgagttgtaactgttcatgcattgtcttctgagtctttaaggtcaagactgaaccaagtaactttggaagagattcctatagttcgggagtatcctgatgtgttcccagacgatttacctggtatgccgcctaaaagggatatagagttcagaatagatttggtacctggaacaactccgatccataagagaccttatagaatggcagccaatgagttggcagaagttaagaggcaagtagatgatttgcttcagaaaggatacatcagaccgagttcatctccatggggagctccggttatttttgtggaaaagaaagatcatacccagaggatgtgtgtggactatcgtgcactaaatgatgtgactatcaagaataagtatccactacccagaattgatgatttgtttgatcagcttaaaggtgccactgttttctccaagatagatcttcgatcagggtatcaccagttgagaatcaaagaggaagatatacctaagacagcttttaccactaggtatggattgttcgaatgtactgttatgtcttttggacttaccaatgcccctgctttcttcatgaacttgatgaataaggtgtttatggaatacctagataagtttgtggtggtctttattgatgacattcttatctactctcgaaccaaagaagagcatgaagaacatcttcgccttgcattagagaagctacgagaacatcaactgtatgctaagtttagcaagtgtgaattttggttgtctgaagtgaagttccttggtcacgtcatctcagcaggaggagttgccgttgatcccagtaatgtggaatccgtaaccaactggaaacaactaaagacagtttcagagattcgcagtttcttaggcctcgcaggatattaccggaggtttatagagaatttttccaagattactaagcccatgacacgactgctacagaaagatgtgaagtataagtggtcagaagaatgtgagcagagttttcaagagttgaagaatcgcttaatatcagctcctattttgattttacctgatccaaaaaagggtttccaggtgtattgtgatgcatccaaacttgggttaggttgtgttctgatgcaagatgggaaggtggttgcctatgcatctcgtcagttacgcttgcatgagaagaactaccctactcatgatcttgaattagctgcagtagttcatgcgttgaagatttggcatcattatcttttcggtactcgtacagaggtatacactgatcacaagagtttaaagtatatctttactcagccggatctgaacatgagacaacggagatggttggaattaattaaggattttgacatgggaattcattatcacccgggaaaggctaatgttgtagcagatgctcttagcaggaaaagctattgcaatgctacggaaggacgacagttgccattggaattatgcaaggaatttgaaagattaaatttgggaattgtccgtaagaggtttcgttgcagccttagaag

SEQ ID NO: 35850 - DNA, 1168 bp, Oryza sativa
agtacaagtggtcggaagaatgtgagcagagttttcaagagttgaagaatcgcttgatatcagctcctattttgattttgcctgatccaaagaagggtttccaagtgtattgtgatgcatccaaacttgggttaggttgtgttctgatgcaagatgggaaggtggttacctatgcatctcgtcagttacgtctgcatgagaagaactatcctactcatgatcttgagttagctgcagtagttcatgcgttgaagatttggcgtcattatcttttcggtactcgtccagaggtatataccgatcacaagagtttaaagtatatctttactcagccggatctgaacatgagacaaaggagatggttggaattaattaaggattatgacatgggaattcattatcacccgggaaaggctaatgttgtagcagatgctcttagcaggaaaggctattgcaatgctacagaaggacgatagttgccattggaattatgcaaggaatttgaaagattaaatttgggaattgtcagtagaggtttcgttgcagccttagaagcgaagcccactctaattgattgtcacgcccggaatttctatccaaaattccaaacgcttacatgtgtgttaaaccctcgtccaggaatcaaccgaggcacacaatgacaatattgataatagagtacaaataattaactattgaatactcgcaaattaaaattattacagaggtagatagttcctctcaaagaaaataacatactacgcagcggaaaacaaaactataacaaactacggaacagctaaggcgactccactccacaggcaacttaaccagaataagcctattcctccagatcatcaccttcactgagatactcctcttctgatgaatgaatattgcaagaatgagcatataacatactcaacaagccacacagcaaatatgcaagtgcacaggataacaaaggatggcataacatagctcatttgcagaaacaacatttaataaatatttaagagaatagtaaaacagttgtataattaatcaatattaaataaacaccatacaacacacccgtgttgcacaggcccaaccacatttgaacaaccaaccccagttgaacaaattaaacctccaaaccaggaattaaccattccaacattaatac

SEQ ID NO: 35851 - DNA, 741 bp, Oryza sativa
actctagaggatccccggattaccacgatctcatcacgaagggaggcttgatggtgttggtactgttggaagaaagactattaggttggatcggaaggtgtacgataaagctcatttcacggtactacaacatatgactgaggtggtgccgtacgttgacgaacaccttgagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcttgaatggagtgccaccacctggcaaggatatgacataaatggatacacctttcacacggtaaagcaagacagcaaatgcacagtgcagaacagtggttacgcatcgaggctgctagtgacggtggtcgtcgtgatcaatactatagattacttgaagttcaaagtcccgttgtttccgttgtcgatgggtcgatcttcgcaatgtaaaagttgacaatgaaggtttcaccactgtcaacttggctaacgacgcgtacaagcatgaaccgttcgttctcgccaaacaaggttgttcaagtgttctacatagtcgacccgtgtaacaagaaactacatgttgtttgtgaagggaaaagtagaattgttggattggtcaatcttgcacccgaggatgattgcaaccagcacgtccacggcataggtcaag

SEQ ID NO: 35852 - DNA, 228 bp, Oryza sativa
gtcaagaaatacctctagaagaggaggaagaagaagatgaagttcaatatgcacgtgtcgaccatgaggaaggattatttttgtaatttatgtacgtagtttatgtctacatgtctgttatctatgtgactctaatatgttcgcaatgatcaatagtatattgcatatgaaatagtcaaataaaatagagataatccattatatgccactgactttgtcgcacgtcta

SEQ ID NO: 35853 - DNA, 1155 bp, Oryza sativa
gcaggtcgactctagaggatccccagatgcattgatcttttttccttagaaaataggcatgagagacgttgggagttcttttaattttttcattgctgcagtttctgtcctggctggctgttactactatggtgaattgaggcatagagcgacactgcagacctaaccactatggtgaattgaggcatagagcgacactgctgacctaaccaaattttgctacttactctaacttttaaaatctatctttctaaagatggtcgtctcgagccatcccattaggccacatggcagtgttaaactttgagataaatctaaaaaaactatacataaaaaagtagcaaaaaataaaagacacaacctagagacttcccaattatctatcctttttagataaatatagaatatttataaaaaaatttatctatcctctttgagataaatctagaatactcatacaagaagaaataccgagaagcaaacaaaatatctttcccctttgcatctatctatctcctgttgattggtttcatgccagctgattgacttgagcgacacgtggcgagatacaagcggcggaaagatcgtcgggtaagaaaccatctataaaacagacaatcttaggatggtgaagaagagccgctccatgtgcatctcgcaagttaggatggtgaattgaaaagaaaaaaacaagaagaagagcggaaagatcgtcgggtaagaaaccatctataaaacagacaatgttaggatggtgaagaagagccgctccatgtgcatctcgcaagttaggatggtgaattgaaaagaaaaaaataagaagaagagcctctccatgtagttgggccacatggcaccacaacccaacagtgtgtgatcggaccagtgcaaacatgtaaaagagggaaaaaagaaaaataaagagacaaaaaattactttttaaaattcttcacaaattatccagggcaagtattgtgaccacatatcttatgtttcgagaaactaaaaataatagatagaaaactaaatgacagaaatatctgctccttctttctaatattgaatcaaactctataatcctaataactattttttaaatattgtttttttttgcttacattataaaataaataatatctagatctttcaaattt

SEQ ID NO: 35854 - DNA, 295 bp, Oryza sativa
aattaaattagtataaaaatgaagtgcaattactactgttagtgaaataaaataattaagtataacaaaaatatgcagtgtatgtggaaatatgttaaggaaaataaaagaactaagtgaaataaaataaaataaaattgctgtaggcaaactcacctgtgacgggctctatctgtggggccatcacaggtgacctcacctgtgatggcccagagtgttgggcccgtcacaggtgggctcacctgtgacgggtcaacatttggggcccgtcacaggtgaggtcacctgtgatggc

SEQ ID NO: 35855 - DNA, 11044 bp, Oryza sativa
  unsure (1)..(11044): unsure at all n locations
gcggaagaggaacggacagcactggcgacgaggttgaagcggcggcggtcttcgggtcgacggtgacggcgatgctccggcggtcaacagcgacggcggaggggtggacaaggacggcgacgacttggcgatcccaacggtggccttcccgagcgatgacgacgaccggaacggcggcggcgcacggctggagcgacggcggcgactgcggctcgaggtctcacggcgctagggcgcttccgacgacgagaggcgaaggcgagggtggcgacgggtagaggagagctcggggatccttttaaaggggttcaagggcgacggcgaaggcccacggcgaccagcgacgacgaaggaaacttcgggaaaaacgaatccgaagcaaactcgaatccatcgatttccaaaccgatttagccgatgtttccaaaggggaaaaggtagaggagatctcgaagatcatttcccctctattgatttcaccggaaaaggaaaggagcggccggatttggaaggaaacggcggcggcgcggcgctagggtttcgggcagcggccgacgcgaggaagacgacgacctgacaggcggaccccacctgacagcgagcgagggcgcgcgcgcgcggctgcggactgggccgacttgggccgaggagagagagaagggttttgggccgactttcggcccaaagccaaaagagactttttaaaacctttttcaatttaaattattccttaaatgcaattgcatttattaaaaatacttacttagctcaaataaatcccagaaaaatctaggaattataaaattaagcaaagtatttaatgaaattttatctggccccattttatattggaatttattaattaaaattagatcttctcttcaaggcttttaaaatcatttctaaaaattccaattaaacaacaatttatagattttgaatttttagggtgtgacaatatacacctcgaccagacgattgccaagaatgctaagaatgcatcccacaaagagagtagtggcttcctcgaattgcttctgctgatcagcaataagaattccttcaggtttgccagtactcacccagaagcatttcatagtcgtcagccacagagtgaccctgatttgctgtcacgactggaaataacccaacgggcattccttacgtgcgtgcattaatccttgtcccaggaggcaaggtacaccaaaagttgatacaaatcagactctaagaatcccaagcgtaaatagttaacttattacatgggcagcgaaggcccagcacacacaaagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccataaatgcagaataaatgcaagggagtacaagggaattataatataaaggggatagggttgcagtaaacagcatttaaagacatttagttgctcaaagccaatttgtaaacccgatcctagaactatacaatattattaatcaaggccgtgaacccacacgaacctgccttaacccaaggcctatgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccatggtatacagacggaagacgtgacatagtttccaacccatcctagccatagacaagagtaccgacccaatcctgcctgcggccggaacccccgggacaggcaggcaagactgagcccctagcagcagggcaccaaccctgtgccaatgacatctcgactaccgggccgcagctcgtgtaaccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttaggggattttgaatagagggggcggtgtgaagccaattccacaatgatccaacaattccagtgtgtccaggtgatgagaatatcccaaagtctagagttgtaaaaccacctaatgttacctaattaaattgcgaagcatctacctaaaattaaactagtggtgccatgagtagagtgtccactagttgaggttttgtttgatctagggtgaacaaggtaataatattaacaataacaataataatatggtcataacaaaggtaaataggcatggctaaataaaacagtggtaacgcgggaatttaaataaagcgataatgcaataatttaaatcaacataattttataaactgggattcaatatgctcaaagatgatgtgacttgccttgctcgcttttccaaccgacggcttcgactttcacgaagagcggatcttccgaagctgcagcgtctacacaaccaacggaaaagaaaaaggcttttactctaataaacttcacataacagcagaaacaaagcacaaaaatgggttcttgacttcttaaggaaaaattagagacttgaacggtccaatttcgagttcaattggccaagatatggccatttgaagtttatatgctcttaaatggatatttacgaatttcttcatttaaatttaattaaaaaccgggtttattgcgtcagccgagggagagggcgcgcggaccgagtccaccggagtggggcccacgcgtcagcctctcggtccacggtggaccgggcgcacgcggccgacgggagggggacgcgcccggccccgatggtcaccgccggcgaccaccggcgcggcggagcggcacccgagagagaggagggaagggggaagcgaatggagcggtctttcgcttaccccggtcgacggagactacgggaacggcggccgaagcggaggaaggcggcggtgcggttcgggacgacaaggacgacggcgctccgacggtcggcgagcgaaacggaggagcggactgtgtcgacgactactcggcgaaacccaaggaggcgaccccgagaggggaggaagtnctgagcgaccgcggncggcgacccggaactcgtctgcgactgctgatagagagaanagctgtgcgagcgctatttccaccgtgagggcgagcggcgaacggcggaaacggaggagagaggcacggggaacaattaaatagcgtctggtgagagggaaagcggcctgaggagggggaaaccggcgcggagatctcggccgccattgattgcgccggcgaactttgcgggcacaaaatcggacgaatcctagggagagagagaggggaaagtgggggaatcgggagagggaatcgcggggagtaattccccccactttaatgcgcgcggggacggcgggatgcggcggattcggcggcggcggcggcgctagggcacgggcgggcggcgggcccggcgcgaggaagccaatgacaggtgggccccacccgtcagcgagggtggcgggcgggcccgcctgtcagcggcgcgcgcgcgggggaggagccgatgggccggaggagaggagagagagggagggaagagaagtgggccgagccggccccagaaaggaagggggggaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctcggcacaatttcgaggatgtattttagagtcgatttgggacgcgacatttgccatctcttaaaatgcacacctgtgaatttatccggtcttctacctcctgaagttggtggtctgttgagctttacatttccccttgctcttgttctgggccttgtgcacaacattggcactggactgcccagtatcgtccttagacgcggcatctttttcccgagctttctcctcaacatcaagagacgctatcaacccctcaacggagtattcctgtctcttgtgtttgagtgcaataccgaaacttctccatgatggaggtagtttcgcaataatgcacccggccacaaatttgtcgggtaagacacacttaaggagttcgagttccttagccatggtttgtatctcatgagcctgttcgactacaaaacggttgtcagccatcttgtagtcatgaaactgctccatgatatacagatcattgctagcatcagtagcaccgaatttagtattcagtgcatcctacaactccttagcgtcggtcatatgcatatacacctcgaccagacgatcgccaagaacgctaagaatgcatcccacaaagagagtagtggcttcctcgaattgcttctgctgatcagcagtaagaattccttcaggtttgccagtactcacccaaaagcatttcatagccgtcagccacatagtgaccctgatctgccatctcttagagtgcacacctgtgaatttatccggcctcattgcatcggcaaaaccaatcatagtaaaatcacagagcctataataaggtttttggattgttataattataagcacataatgatttaatttattccataaataaaccatgacattgcagatgtaaactagattgaacacatcattagatctacacatgtaaactaagcagtaaaacatgaacagatcaaatatgcgcaacatatcgaacacgtaccgaggtggcggaaagaccggttgctcggcaggaactactggcggttgcgagcgtcgacgaagtcgcgaagcacgcgagcggagaggaaggcgagccgtcgcagacgaacagggagcagtcgcgcgaagcgcttcccaaaaaccttattgccaccttctcccgatgcaggacgtcaaaggcagaggttccggagacctgctctcccgatcgccagtgcacgccggcgagcgggatggagtagtctacgagtgacgacgcagtacagagtagaaggcaaaccctagattgatttcgcgtgtgttgcgtgaaggcggcggcttggtttatatagagatagatcgcctgatcagggtgcccgcgtaaaccgaaccggataagtcgcgcgtaacctatccggactccatgccgttttcacacaccggatttttcggaatgtttccaaaacaaaacaaatccgaatcccgcagcaaaacaaaactgcaaaaggaggctgcatctgcgcaagggtgaggagccaattttgccgagcattcgacacgtacgtcgtgcgcgcgccgccggcccggccaggcgagcgagcgcgcgcgtgtgtttccccctcttctctccaccacacatgcttcaagtgactaggagggcatcctcccttttaaggaggtccccctcttctagaataagcaaggtggtactaaactccacatgcatgccatcccatgaggtgggtttttgcgattttccaaagaattaatcttcgaatgggccttagcccatctattaattccaacatggatctcacgacttgtgtatacaaggttcctctggtctcaacgaaggatgccctacttggtgccaaaaatctattcaccataaaggtgcagtttagtgccaagaaatgtccaactacatgatgtaccagctatttgtgaatcctgggatgctattggcgggcagcaggcgaaacttgttcactgatgcctacaaacaattgaagggtatcgtcaaggagaagaacctgtcactgaatgaaagagaacttgcccagagaattatcgtcaaggttcagcagccacacgaggagaatgaaggagagctcatcgatgatgcttggtccattgcagaagagctcctgaatttagaagatgaggagaagatgtggagggtgattgaaggagtgtgggtagagatgctctgcttctctgcagccagatgcaggggctacctgcacgctaagagtctcggcacaggcggggagttcctaagctatgtctggctccttctgcattacatgggaatggagaccttggcagagaagctggcgagagcagagctcccaaacggagcacgctcaggtaattcatccactaaacatgctggagactcctatggcaaagagcaagctcctggtgcatcgacttctcatgctagaggagcctatggtgatgaagatggcgctggtccatcctcctatcatgaaatcgaagttatggggcatgaaaacgtgtgacatgatgcatacaagatgtccttttttctctttaggcgagatgcatacgtgatgtcagtcccagtttgacgcttttatttgtgcgttctgcttaaatggttcaaattcttctctcaatgtaatgtcttgtgtgagtcatgtatcctagcaacttaataaaccatggaactaataaccatgaactggatccagactcggattgaagaaaaaaaatagaagttcacataatgtggttctaatgtatagtactccctcctgttttttttatatgacactggttagtttaaattttaactagccagcgtcatgcaaacaaaaatggaggtagtaatatggaagaaaaaattttaaaacacgtttatgttcagaggtcctcgcatgatgccccattatcggctagcttcctgacagctagcgggacgagattgaggcgtcagcagcagcccaagtggtggtgcactagaagtctagcacagtgtagcgaggagcagcagcagctgctgctcttgcgaggatggcaaagtcgtcgttcaacgtgtgggccacagtgctgtggactccgcttgcttgatggcatcatcctagtcgcgttgttgcctaagagcaagtatattaggagaatgtaagtcggctaaatgctgagatggaggatagaagagaggagggagaggagaagcgagctgtaaacttacagctggcttggacgcaagaaccaagaaactctgtgagaaagacaagtgtgctctgtattaattgtaaatagctaactattatatgtgtgggctaagagaaggttgtaaaaaacattataaccaacaagtcggctgtattattagccttactctaagcaaggcgctcgacgtgggagcaagggaaagtggatccctcggagctcttacctcgaggggacagtgacactgtaaaatcaaagtgtttgattattattttgtgatggacaattggtatttcagattatttgttttgatatttggagataattagtgaaatggttttgaagatgattggattttcaggttatggacaggattgagttgtctaatgattgcagtcaaaccggctgggttaggccagtcagaccgaggctatgcgagcagtcagaccagttagcatgcggtctgatcggccgacgttgtgtcaatttcagtttagggttgattatttggatatccgtgaaaaattcatgtttatggcttagtcaacccaccgtgacacgggaccactcaaacggtcaaccgaaccggcagtttagaacgactctattagtaaataacgacttgggatgaccgaatgaacgaggctttggactatacttcgtgcgaacgaacgattagcggctagcgaatggctccggcacaacccagtacacttaactcagtttgcggaaatggcccggtacgacaacgataggctagtagtgattcgagcttacggctgcggctaggcaactcggctaccaagcgacaagcagcggctaagcagcgacgtcggcgcgaaatggtagacttaactcgtttgcggcaacggcccgatacggcaacgttaggctggtagcgactcgagcttacgactgcggctaggcaactctgctaccgagcgacaagcagtggctaggcagcgacggcggcgctcggctgcagcggcggcgcatggcacacagcggcaggagcagcggtagcggcggctggcggctagggcacagggtgacgcggcagcggcgcggcagggcgatgcggagcggcacgacggcgcggtaggacgacgcagcggcggcagcaacagcgacagcggcgcggcactcggtggtggcggtagcggcggctagggtttaccggcatcttcaacttgatttttttatcatacttgcagcatgtggttcatgagtcgattatatctcttgactgcactacaactatatgttagtagtactacttaatttagtactacctccatcccaaaatggtagtcgctttgactttgctttaactttttcttgtaatgtttaaccatttgtcttatttaacagattagtgcaaatataaaaacagaaaagtcatatttaaagcacttttgataataaagcaaatcataaacaaaagaaatgataattccataattttttgaataagacgaaagatcaaaagttacaaacaaaaactcaaagcgacaactatactgggacggaggtagtatacagttttcgaccccaagtaggttttaaagtgtttttttcacatacagttcagttttacgcctaataaacagaaaagatgtgaattgcagtcaaattttgcttgattctgaatctgaatgcaaccatggttgctaattccatttcatggtgttgggtttagtcccggaacgatttccatgggtcacatggtggggaggccaggtaacaagtcttcggggtcacatgggttgatgtgacaggggagattgttagacccgaggctcaggtaacaagtcttcggggtcacattggttgatgtgacgggggagattgttgtgtttaatcccacatcggtaattgatgatgagggagcacgacttaaaaggtggggcggtcctcatccattagactagtctttttggttgtgtaggctcaggacctaaagttgtagctccggttgggcctgtggtggagcaggctcaatataacctggggtggcccatagttggtgggctgggctgcgcactctaacacatggcattcaaaaaacaggttcaatatttacagagttgtaggacattaggcatccaaaaaataggttcaatatttacagagttgcaggacattagagaggatacatgactcactgaatcacacaaaacatagcattgaaagaagaattgaaacatgatgtgcaataaaagtgacaaaatgggactcactgctctcataaccaccatatgtgatacatcacacatgttcttccccaatgacgcttatctctccgatggcagatggatccgctactctttcatcacaatgagatctgctatcatgagaagtcaatggaccagcaactcgctcaattatgccggagggctcaccaacatgggtagtggatgaattagctaagaattctctgttttggaggtctgctcttgacagcttctctgccaaggtttccatccccatataatgcaggagcaaccagatatagctcaggaactccctcccgtgccgaggctcttagcatgcaggtaccctctacatctggcagctgaaaagcagagcatctccacccacacgccttcaatcaccctccacattttctcctcgtcatctaacttcaggagctcttcagcaatggaccaagcgtcatcgatgagccctgttccatcggatggtggtgtgtcttcattggttatctcctcgaggggctgctgccgcgaggcgattattctctgaataaatgcctccagtttgttgtagacaattctaacaaaatttggcgtagttcgtgccacaagtgccttctcaatcaaggcggttattcgatgcctaagtgcccttagtggctcatgcaccaaagtgtttcttatcttcctatgtaccaaccgttcctgctgcatccaagtgattattctctgcatacatgcctttaactggttgtaggcaattgtgaagaagtttcgcctagcgtctgctgactctactgggttctgcacgaaatcaaatattctcaagacaagttctttttcattcaatcaaggattctcatccttgatgatgtcctttagttggttgtaggcatttgtgaataagtttcgcctggtgcctggcatcagcatctcaggattcacaaacagcaggtacatcatgtagttggatagttctcggcactgaacagcactcttgtggtgaatcgatctttcacggccatatgatccactagtgtaatagcagaaatcagtggcaagatgccagagaaggacactctcatcaaatgccccctctaagctccatcctagttcctgaaagtacccctcggagcgaagagtccatttccccttgttatcattgaacaacctgtaaatgtgaaagtgttctcacctcccggaggaggccgcgtaattatatttatactgtcaagaacagcccttgacgtggcacttacaaaggatatgatcaagttgttacaacggatgttatccatctcaactaccctattatctagccagcaactcaactaactagaagataagatgtacactgttttacactccccctcaatcataacttggacaagttaagattatacatgaaatgtcttaaactctgtatagacagagcctttgtaaatccatcggctatttgatcttttgatccaataaacctaatatcaaacatcttatttgctactctttctcttacaaaatgataatcaatctcaatgtgctttgttcgtgcatgaaagaccggatt

SEQ ID NO: 35856 - DNA, 2081 bp, Oryza sativa
gccatctgacattgaagtttgattggtctcggattcagtgctgctgccatcaatctcgctgccggttgatatgatttcatgtgagctttgcatcagatcttcaccgttttgcctcagatttccaccattttgcaccaaattttcgccagcgatctgtactgctcctgtgcttgatcatcacaggcagggttagtagaacatgttagcatatgatcattagtaatttctcccccttgatcggtgatggacagcaaatgagaaggcaagagagagatctctcgctggagacgggcgccggcattgggatgcagggaggcgaacggaaagactgtctcatcgaagacaacatcacgcgagatatagacacggccagtggatatctcaaggcacttgtatcctttgtggagaggactatagccaaggaaagcacaccggattgatctaaaagaaagcttgcgatgattatatggtcgtaggtttggccagcaggcacacccgaacacgcgcaagtggctgaactcaggagttgcagagaaaagttgttcaaacggcgttttgaatgagatagcagaactaggcaacctgttaatgagatatgtggcggtaagaaaggcttcatcccagaattttaaaggaaccgaggcttgggatagaagagcaaggcctttctcaactatgtcacgatgcttacgttctgctgagccgttttgctgatgcgcgtgagggcaagaaacatggtgagttatgcctatcttctggaaaagggagtttaatttctcgtactcaccaccccaatcggtctgcatggtgagtattttggttttaaactgtcgttcgacatactgttgaaagtttaggaaggcttgaaagacatcggatttctttttaagaagatagatccatgtgtatttgctaaaatcatcgatgaaactaacataataatcatgtcgcccaacagaagtgggcgccggtccccaaacatcagagaatacaagagcaaacggaacattagatgaactcagagatttagggtacggcaattgatggctcttggcccgttgacatgaatcacaaatgtgttctacattattggactcgctagaacaaggaagctgaaaacttttaatgactcgactaacaatcggaaaagctggatgacctaaacgataatgccacctagtcgaagatggcttgacaatgctcaaggcatgtttattgagacttgaatcaccgggtgctggagccaaaggataaagccgtcccttacttctgccgtgaagaagcagcttcctcgttgcctgatccttgatgttaaagaatttggggtaaatttcaacgaatgcattgttatcaaaggctaagcgatttgccgagacaagattcttatttgcagatggaacataaagtatatttttcagatgtaaatctttgtttggggttgaaattactgaatgaccaatatgactaatgttcatacctgtgccgttggctgcatggacttgctcctgtccattatacttctcacgaacagagagcttgtcaagctccccagtgatgtggtcgttggcaccgcagtcgacataccagttggtatctatgccgtaggcggagttcgtcgctgctgctgcaaccttctcttcgggctgataggtttgatcaaacctataccagcacttgagcaccgtatggccagttttgccacacagttgacagaccggacgtggtccttgtggacctccaccgcgtccgccattgccacgaccacggcctccattgccgccgccaccacgaccgcggaagttgttgccgttgccgttgccacgtccgcgtgaagcggcgttagcagaagattggatttgtccgcctacttggagatgatccatctggttgtcgtagctaaccatctgagaatacaaatcactcaaggagattggatcagatcgacctaccacggtggaaaccagcggattgtagtcgatgtcgaggcccgcgaggatgtacgacaccagttcttcgtcatccaggggcttgctagccgacgcaagatcgtcagccagccccttcatcttggagaagtagac

SEQ ID NO: 35857 - DNA, 2046 bp, Oryza sativa
acgcaagatcgtcagccagccccttcatcttggagaagtagactgcagtggtcatggatcccttcctggtgttggcaaggctgatcctgaggttggcgatgcgtgcgcgagattgagatgcatacatgttggtgagggcattccaaacttgcgccgaggtgttgagagtcgccacttgttgcagaacgtccttggacagggaattcagcagataggcaagaacctgctggtcctgagccatccactttgcgtagtccgggttcttggtgacgatctccttgtcgttcttgtcgacggtggtcctcgtcttggccggctccacagccgtgccgtcgaggtagtcggtgagcagcgctccgcgaagcgcagggagaacttgtgcacgccagagaacgtagttgtccctggtgagcttctctgtcaccggtggaccaagtgcagccggcgcagatgtggaagaggaactcgccatgacgagaaaaggatctagggtttgtgttgggtagaagagagaggctctgataccatgtaaatgtggaagcgttctcacctcccggaggaggccgcgtaattatatttatactgttaagaacagcccttgacgtggcacttacaaacatcaaggcaccaataagtagaagcatcagttttgttcgcccaccaacgcttcacgtgctgaagtactaagcttgtaatgcagcgtgatgaggagctggacttcatttgccacctctgatcaaggtagtccttgcacccaaaactgtcgcaaagctcctaatgtaatgcctttggttacagatgaagcatccaatgaggttgtgttggtaaagcatggcatccatatgctgggaaacattgccatccataccagttttgcttctccctatggatgaactcgacttcctttcagcagtgttaacaatatccagagcaagttggccaaaaaaattcaagtgctgcagtacaacaaagcaaggcatatgtaaccttcacatccctatcattgtaagcttgtctgtgactgtggtgaaataggcctatggctccaaattgcaggtataaagctatcatacgtagcagtgaaccaacaattgattttctaaataaccccttcaaccaatctcgtttgacattttgcatcatttgttgaacacgaccttcaggaggaaggtacatctttcgtttcgtgtagagaagatcgaaggtgtgagataaccctttctgcagccaaccatttgttttgtctgcgtcaagtgctgagaaccactttagtttcttaagccgataatcaaaagaaggagatgaaaggtctacaaatatttcacttgggtcaaagttcaccgttgttcctggtgttccattaacatcagaataatagcccctcaccatcgtcacgaaatcatcaattgaatcaatcttgccatttctgcctgttgtcctccgaacattttgcggagagttcactaggctattaatgctagcactatggagggcccaaggtttctccaagcatttcagaaccccagggatgaaaagaaacaccgctgttagcagcaataatgtgtcaccacctgaccatgatttatagaacacatagatggctatggtgatctgagacaacgacgtgagggcgtgccgcgtccacagctcgttatcttcaacattgtagcggtaatgctgtcctgtccaccaaggtgtatgaggaggataggtgcccaaaccacctataggatgctcctgttctgtgtgtatagccatcgtctttctttctatggcgattgaagagtgttgcaagtgcatatatcgctagggcatcgctgctgaggtatgcaagccagataaagtatctcaggtagaatttcataggaatcttacgccgaggagacatgatgaggaggatgtactgaacaacgaggctgctgagggcgagtatgcgcagctgccactcctcccaccgttgcagagcacttgagatacccatcctcttcttctcctcctcctagtctctttgtctatgtgtctgtcttgtatactcggtggaggttc

SEQ ID NO: 35858 - DNA, 5395 bp, Oryza sativa
aggtgcccaaaccacctttaggatgctcctgttctgtgtgtatagccatcgtctttctttctatggcgattgaagagtgttgcaagtgcatatatcgctagggcatcgctgctgaggtatgcaagccagataaagtatctcaggtagaatttcataggaatcttacgccgaggagacatgatgaggaggatgtactgaacaacgaggctgctgagggcgagtatgcgcagctgccactcctcccaccgttgcagagcacttgagatacccatcctcttcttctcctcctcctagtctctttgtctatgtgtctgtcttgtatactcggtggaggttccattcaggagtaataacaactagtgcatcaataaaaatgcaagatgcacaatcgttgtgtggcgcccctaatattccaacgatccggcttttagatagattaatatgtacgggaatatcactgagtagtggcatgaaaagcacacagacactttctgtcaatcgtatatgtgtagatagttatatacttatatattactcccccggtttacaatttgttgtcacttttgatcgcattatttgcacacaaatacttgccgagtcatgcttcctgatacatgttttcctattttcccatattaataacccttattactattttctccaccactggctattttgtggtctagaattatacgtttaaatttttttgaagggtaatatatattatattttcacatgaaaacaaatgtacgtagatatacatgctatggttaaaagtgacaagatataacgaagtagcctgatgaatcctgtttttcttgacttgaccaaatgttttgagcactcctctttaaaagttcttcctttatataattatatgtgatttccacctagtggccagcagcagcgaaaatgctccaatgtgggcgcccgatctgaccccaaaaatcggacccttgcacccgcacgagccaattgtttttttttttttttttttttttttgagaaagaggaggcagagccctctcccattttcattaaagaaaacgattacaaggtccataaaatctgttaactttgatcatcttataaacaaacacaaaacacctacaagaatccttagttcttcaaaaaaagctagtaaaactttctcacatctatttatctattatattaataagacagctcaaaaaaagacaccacgtttatcgtggaggctagaaattctcacgttaatcgaaaaaaatataaattatttacaccgttggattgtaagaggcatagatttcaatgtgtgagatttaacacaaacttgacatgttaactgcattagaatcaatctctaaccaggacctttacatgcaaacggactcaaaatagttttgtccaatttcctaaacttaagttaggttctagattagttaggctataatgtatagtagcaacggaaatctacagcagcgggtcgagccccgcggctgcacgatgagcaggaattggacgatgcacgttaacaaacagaaggaacgatggcatgtgcacagcagctagccaggtgcgcaccttaagcgatacaattaaaaataaaatttagaataaaaatgtaataccagtaataaatatgtaaatattctttgccaaatatgtatatttatctatatatattattaagaaacatagaaatctttattattaagacaactcgaaaagaatgtgccatatttattctaaaggatataaattatcacgttaatcgaacaataaattccaagccgttagactgtggtggaaccaaattagaatggtgaagattgataacagaaatatatgtaatataagtgtatctttagaactaaacaatggtatatagaggagtaagtgacagcatttgatgaaacttctaaatattataaaaatgaaacgaaacaagataataaactctaaaaagtataaggtccaatttttaaaggtttgggactttagaaagtaaaaaaaacaatgataataaagttccaatttaaatcacaatgataataaagagaggagggagcatgcgagccatagaatagtacaatggcaaagccgataatggtttggtgggacttatagaaagtaaaaaaatgaactcaaacaataattatgtttgatttttagaatcctaatgacaataaagagaggaggtagcagatgggccgtagaagagttcagtggtagcgtttgatgagactttaaaaatataaaaatgaactcaacgagaaaataaactctgaaaacaaccaggtcctatttttaaagattcggaacttctaagaagtaaaaaaaaccaatgataataatgttcgattttaaaatctcaacgacaataaagaggggggcagcgggtgggccgtagaagagtacagtggcaaagccgctaacggtttggcgggacttctagaaagtaaaaaatgaacccaaacaataattatgttcgattttaaaaatcccaataacaataaagaaaggaggcaacggatggacattagaggagtcgagtggcagtgtttgatgggatttctaaaaattataaaaacgaaacccactaagccaataaactctaaaaattataacatcaaaattttaaagtttccaaggagaatgaataggaaaagtgatagatcgagcaagcaaataaagaatagggtaacttttaaagactataatattaaacacgaggatgatatggtttgatttttaaaagttttaaaataatgagataactattcaataaaatttaagtaaaatcatattaaaaatagataatttcatatggatgctagccgcgcaattgcgcgggccacccagctagttaaaactaaaaacatctcgaaacaaagaccacagcttctcccctgcatcccaaactgtgtttttctccataggtacaagaccctttcaagatttcgtgccgcaagcgccgtgtcgtccatcccatgccgcaagcgcaggcctccacggcgtagcggccaacgcaccggctctatccccggtctctcctgatctcctcgcctttcctcgtcccacttggagaagctcacgtcagccgtcctcaccgcacagggagccaccgcagagcaacagcactcggacccagccgcccggtcaattggtacaccaccatccatccccgtgagcgagcccatcccatcatcccacctcgccaaggcgccacgtgtgtttccatttccatattttttgccatttctatttttgtttcggtcgattaccaatttcacatggctcggccggtagaaagtcgaaaacaaacaccggtcggctcacccctgactaggcttccttatttctcgatcctatcttatctctttcccatgtatttctatattattcaacatcatatcagagcggatcatctagtcaactctctcacgcttccgccgccattgtccccgagtgggttctaatctcctggggacagccatccccactcgtttttttcttcatcgatgtcgttctcgtcctagagagatcaatctcctggtgctgtgcgtcgtcgtcttcgtgtcgttgaatcagcagcaacagcaccagcgacctccacacgtgcccggccagtcccttcatagacactgttccgttatcaaggacatgtcgacgctggtgccgagtcgctgctgccctggaacccctcgaccccgacctcatgccgtcacgggcggatcttgtcagccctcgccaaccatcgatcccgccgcccgatctggaggacgagcgcgccacctccggctcgtgcagcccaggttgtcgccaacacgctgccatcgactcctctgcagtcatcaccgccactcttaattaccaccactagccctcacctggattccaccggtcgagcacgcctgccgggccgcctcctttatcgacttcagccgtgatctgctctgcttggcgccctccaccagcccccacaactctgggatcctctactccatggccactgacttctcgctcgcaactatcaaacctagcaaacttatatcaaggtgggctatatatggctttcattttggcataaaagcaagttttagttcacaatcttttgcaaagggattttataaagcaattcaaaccatgaatatgaatatatcacaatatttataattgtaataacataacacttgttgtcctccatggcaacaagtctcatgatcatcgtcatagtcaccaaaactcaacacaaatcatcattccaatgccccattttcataaacacatttataaatcaagtactcatgacactccaccaagtcgctcatgactctgcctatttggtacaactttaccaacatgatgtgtatcactctagtctgtccggtacctgttggtaccaccgcacaatacacgttgaatgtggtctagaggtcacaacacaacctttatattatctaatgcctagccttgcaccagcacgatgcatgttactccacattacacctagaatgtagtgtcgctaggtggtgggtccatgccttgaacctaacaacgtaggcacaaccaacgtggtcccctacgaagcacaacaccattgtattcgataaacttagacgcccatgccgtgaggcggaatagttagtcgtcccctcccccgaacacacacacgaatgaatcatccgcacatcaaacacacatacacacatggatagctcctctagacaggtcattaaataacttaattggctaaggccaccccataaatagaacttgtggatgcacgatatactttaattggtgacacgaagtttagtccttaacagaggaacttgccttattctttggataaatcggacaactcctaaatctctccttcaccactaacgcaattaatctatacaaaatgacatgatatgcaaataccgagagatgcaaaaaaaatccaaaatgctctaaaatgcatgatttgtgcgcagtgggttggtactgacctatgatgaatttaagtgagagaatttctattttatcacttttcttttgggagttatgaattttataattatgctctattaaattttttatgcagtttagaatcaagtttttttaagtttcgggtcactgcagtatagagtgtattcccttagagtttaacaaggtcactgcagtatagagtatgttcccttagagtttaacaagatttatttcacaatttttagagatagcatgaatttattagagatattattagaagcacaacacctcctaatattctgagcgcctaattgtgtccacgtaggacacgcgtacccatgttcttatggacaaggcactattgacagtcgttatcaatcagtttcgactatcaatattacctaaatagagaagaactagtgatgcttgcaatgca

SEQ ID NO: 35859 - DNA, 466 bp, Oryza sativa
catgtgccatgccacacatcatgccagaaccagatatggtcacccttccccaagcccattctgaaccaagtttcaaccatttcctaatgttcataatccccttccagaactgggagccagaatctgaacattggaaaactctagaattcctcaaatatttttttcttaaaagctcaacacacaaactcttatcatgagactctactttaaccacccatttagtaagcaaagcaatgtttaaagctcttgtttcagtgagatctaaaccaccaaaatccttaggaaaagctaaatcagtccacttaatcatatgatatttcctttcatgtttgtcaccagcccacacaacactggccaaggtcacctgtgacgggcccaaaccctcatctttgacggcttcgcgcatggtcagtgatcagtggtcactggtgagtccagtcacctttgacgggtggccagccgtcac

SEQ ID NO: 35860 - DNA, 8586 bp, Oryza sativa
  unsure (1)..(8586): unsure at all n locations
nnnnnnnnnnnnnnnnnnnnnnnnnnnnnnnnnnnncggccgaattgatagaggggaaacactctccgggatctcctctaccttttctcctttggaatcatcggctaaatcggtttggaaatcgagggattcgagttcgtctcggattcgtttttcccgaaccttccttcctcatcgccggccgcagtggcccttcgccttcgcctccgagcccctttaaaagtttccccgagctcttctctacccaccgccaccctcgccttcgcctctcgtcgtcggaatcgcgctagcgccgtgagccctagcttcgccgccgccgccgccgctccagccgtgcgccgccgtcgttccagccgtcgccgtcgctcgggaaggccgccgtcgtgttcgccgtcgcgtcgccgtcctcgttcgccccttcgccgccgccgaagaccgccggagcgtcatcgccgtcgtcgacccgaagagcttcgccgcttcttcctcgtcgccgtcgccgtccgttgatcttccgccgtcgttttggtcgccggtgagttcgccgtgccgcccgcttcgtcctggtgctttccgttttcgtcctcgcgccgccgttcgccggcgagcgtgcgccgcccgagccgtccgctccgccgagccgccgccgccgtcggtgacatcattgctgacgtcatcaaggccgtccgccgtgaaccgccgtggacccgatcgatctcggccgtccgtttggattggatcgaatctcggccgtccgttcgcgtgaaccgccgcccgtgcgcccggtccaccgaaaccctagcccgctgacgcaataaaccttcttttccttttcaaaaataattcaatattgcgtcataattcaatttaaaccgatttaagtgttttaatccgatttaatctttaaaaattcataactaattcatcttagctccgatttagttggttcaagtctctaattgtttctaaaattgagatctacatgttaaaaatatccacatgtactgttcatgcttgtttatgtgctgttttggtgattttgttcttttctgcttagattccgtcgtttccggagagtccgttttcgccggagaagagtttgaagagttccaaggccagcaaggcaagtcacacagatcccaaacaaccctttgagcatgttgatcatatttaaagctattgtttctattcaaatattgcatttattttcgaatgtcattgggtggaattaacctattgtttgttatagcccttttgttcttgattactttattccttgataccttgggttattataacttgactagttgggctttatttattggttcaactagatattagatataattgctcagccctgcttagaaacattagcacactattgggataacttatgactcactgttatttaatgatggcttaatgatagttcacgatggtcaatcgtgattggttaattaattaacgtgccaactaaaacctgataatggtgggttgtgagcacatggtttttgatggttgcgctcatgacaattaacgaccggtttgcgagctactgttgtgaaacatttaccgtaccaaccacaagccagcgtgggcaacggctttatcttttgtatagcatgaacattatagtgtgccagactgtgaagaggcgagaagtccatgggggtcgctggggagtccatgcctctggttgtagagggggtgattatgatccacgaatggtgcactgtggtgagttgtgttatgtagggggtaatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatttgtacagccgggtacggttgttcaggatggttgggcctgtgcagcatgggtgtgctgttcagtgttgattaaaatttctgattaattactctactgttttacttctcttaaatgttttgctaaatgctgcttttgcaaatgagcctatattttgccatccattggaatccttgtgcacttgcatatttgctgtgtggcttgttgagtatgtcatatgctcattcttgcaataataaatcaacctcagttgaagaaaaaggatccagaaggagaagacgtttggcttataccccagttgagctgcctgtgggagtggagccggagcttcgctagattttattttttccgctgcagttttcttcttggtgaggactaagtgcctcataataagtatttatcgttttagtttattatgatggatttgtatattaaattgtcagtttgtgtacctcggctgattcctggacgaggattttatgcacaaataagttcggaaattattagtgaatttccgggcgtgacaatggagtacgggtgaagtgtacatccactgcagtgtgagtaaaccgaatatattcgaatagccgtgctcacggttattgagcaccgggacatgtattacacttggctagactctgaactcttaaaatgatgggtgggatatgcataatgattttttgactagtggatcaacttctcgagaggcgagaaggggtagaccccagaaaaccatgacgaccagtggcgagaagctatccttgggagcacaatggatggtggacagaaccatcgctgtttaatgaactatggagataaaatttgatcagttatgctaggtcttaagcttgtgaaaagaattgcaaaattgactttatgcaaataaaccattagcctttcattgaatatcctctatcatatgcatcgttgttgtgggggcttgctgagtacggttggtactcactcttgctatttacaaatttcatcagaagccggtgatgaagtctcggatgacccacatgcttactaccaggagggtgaagaagatggcggcgcttaataggtcttagttatggtcgttgcctgtggcaatggcgtcgccgctgccttgattccgatgcttatctatttctgcttttggtatgtattccggaccgtttggtcctatgttctaagactccctgcgggtctatgatgtaataaatcgcgctagacaatctatgtatgcgcaattgatattccagcaatgtaatcgtgaataccagactacttgatccagggaaatggtactattaacacgagagattcctgttataaaaacaggggtctacactcgtgcaagcgggggcagctccggtggcggctagcgcaggtgatggctcagcgacggaggagggggatcatgaaggtggtggcaactacccgggaaggcgacgacaaggagaacagcttcaccgccgggccactgggggcacggatcggccaccaccgggctcctcctcccttgtcccaggtctagtaagcagtggtgttaacaataaaatttggtaagccccgaagagaattctcacatcgccaatagtcgaattcatgctatattcggttaaggaaattaatctattaaaggaatcttatccagaagtgattgacttcaaggaggatgtggtatgcaagttatctattaattaggaatagtttgttagtttccttttatctttagggaagtgcgtttagtgtcctataaggactttatgttttccttttatttttaggaaagtttctttcttgtcttacaaggactagtatctccccatgggtataaatatgtacactcggggtcatcgtaaactatctctcgatcaataatactctcggcgcatcgccaccctctttaccgaggttttccttatcattcggcggaacttggcacctgatgtggggttgcataagctttcgatctccggcgaaggggtaagtcctacgttccaccggccctggcaactatattggcttcatcggcgtcgttcaaggctgcctcagtacgttcgatctcttggattgctctggttcggtcgatatatttacctacttatttatcatatgtctctattaatctagtcttagcatatcaatttagctctatcggccgcttctcgctttagggtttccgctggtatcggctaaatcgtgttgctagattagattagcttagacatccaccaccctgaaaatcagttaacggcttgattgtctagatattatgtttatttttatacttagtgctgcatcagttaagtttgatctactaagtcgtgtttagaaccataatctctagcctgtttcttgactgccaataacggtttcatcgggattttagccgatgaggtatctagacgttgcatcggcctacaaggattgcatataagttggatttagccgatgacatccaaggtttttactgtttatctaatcttgtggattttatgacatcggacttccagccaatgtatgctttaaccttcagatcattgcttagtctatcatatcattattagccgattgtttctactggatattattattgttatattatatcactatcagccgatcatctttatttatatcaagtgtcatattctatatcaaacatatagccgattgttcaaaaccctattgctatcgactggtatcagtatcggctggaatcactccatcggcttgtcagccgatcggttatttgatctgctatttgtatatcttgtcagttgcaggattaaactggctggcacgtcagcatctcatcaacctttggatctgcactggagctaagcatatctcccaggcaagtgtgtgtttttcacgtcaacaggtgggtcggggcgtggaattatgcgggcagcaatgtctgcagcgaacacagcgggcgtcacacatcttctggctggcagtgcagatgcatagatttgctttgtgacttgttcttggatttgctttgcaattgtgctcattgatgtgtggatttgcattgtgacttgttcttggatttgcttaatgcaaggctgctgcatctgggcattttcaaattttgtttgaacatctttgctggcggtcagagcaaatgcgtgtgctttgttttcaactttttctaaaccaaaattgaactttgcaggcggccgtcgtaagacagatgtcactggaaacggattattgtcggcggcctgcggaacacaccgctaacaaaaactgattttcacttgcagcccacgtaacacagccgccagcgaaaacctattgtcgctggcggttcaaatcccatcaatgatgaactttgattttctctggcctttggtcgcaggcggctagcctaaccgccagcaaacgctgattttagccgccaggaaaaaaatgtgtttgtagtgaatgggaatttagcaaagactcctaataatcccttctttctatataaagctatgtgcactaaacacctaaagctcagcatgcaaacaatgtatttattagcactcctaaaacccagatgcaagcataccacatcaacccattaagcacacaaagctcaacgtgcaagcatatagtaattatatctacaatttatttcatttaaaactaaacatacacatgctaaaccatcattctcaaatcattttcataatatttgaatccaaataattttatcatttctccattagctaacatatatcctgcagcaaagcgcggggcatcatctagttatagtatggagtagtatatatagtacgtatagtatccaaacataaacgtaacataacaaagttatttgttaatgaaggtgggatgtaaaaaaactccatcactactacaacatctattttcgcaagatgacccccttactgtacatatggttctctgcagcctactgcgccttttcgccaaacctggtggttttcaccacttctaacaatcttcgcccgacgaaacaatatccatctccagtccaagggttcgatgacctttcctccaacggctagcatattttctttgctttgggtatgcctagtgaaacactgccatcaaataattattaccttttgcaactgtcaatgaaccaggtgtgtccctagttgtttgcagattgtcacagtgatcggatggcagcactttatgctgagattgctgctgaaccttagtctttggttgtataatccacgtttgctgatcggccgataaccgcgcatcctcccgccatgcggcacagccacgtggtgcgcggagagggggatggcgggagggcgcgggagagggggcacgtagcggttttttctattttttcagtattttttgttttatatatacatatatatatatatatgtatacaaactttgtatacgtgtatatatttttttatacgtcaaaactatatactgttggcaactttttatgacaagtcgacaagcacgatcgcaacacctaaacgccttgtggtgatatagagtcgccaaccacctcgatctagccaaagggccaaatcaagatgggattcgtagaaaaacagctaaccgggctagcgaagccgatttaaagatcaaaatcagcctctaggccgatttagatcgatatgaggataactacccgtctcgttgggcaaaacggaaggttttcaggacaaacctacaaagaggtgtcgcactctcgcagcggcggcggacggtttacggcgcaaactgacaaagatggactaaactagggtaaaatagaaaacatagtaaaagaacgattcaagtagattgtattcggggattttacaatgaaccggccttgtcccttaaataggggttggtcttgccctctacatgctcttctccacatccaactcgggatagaaaccaaagaaaacacgaaacctgccttcccgagtaaggaaacccgtcactttccaaactttggcaattttcccctatttcgtccataggtgccatatttgggtgtaaacacatgccccctgcctttttggtgaacagacgtgaacctaaaagcatagaacatgttatctccgggcgataatccaattaccggccataggacttcctaagcatcttgccaaatgctcgggaagtatttctttaagtatttcccattaattgatctctgaaaacaccgtcttgaagtgtcttcatctccctcaaagtcttcaaacgctcgtcgatgacatcttcaaaaattacttcccatcaaggtcttgtaatcttcaaccgacaagtcgccttgcttgaaataccgaagagagccaagatttacctcaactggcaaaacggcaatttcaacaatgttttgttactcgactcggcttatccattagcccgagcgtagtaaagagaagaactcaccaacttaatatcataagattcggcaaaacttctcacttccttggacataaaagaagctcctttaatgttttaggaataccgaatctatgaacgatatgcttcaaaataaagtcaattacttccgcataagtaatattctcgagcggcacaacctcggcccacttagtgaagtaatccattgcaactagcacgaaccaatgccattttgatggcgaaggataaatttgaccaatgaaaaccaaagcccaacctcggaacggccatagtttaatgataggattcaatacagcggtaggcgttaattgaacattgccgatccgttaacaagcttcactctctctatagtatttgaaacaatcatcaattattgtcggccattcacccccccactctcttaagcaaccaatttatcttacgggccgattgatgaattccacaaatcccttcatgaacttctctcccagcaactttagattgatcattatctaagcatttcaacaatactccatctatttttcggcgatataatatttgaacatttgccgccgaatcttccgatcaatcttaagtgtaggatctttcaaatatctaatcaaaggaattcgccaagctatttctatctcatgggcacaaatgtccgaattcacaattaattcggccttttaatcaattgtaacgtgccccccagcctcctgtctgggttcggtcagaccggccacgcaatgccggtcagaccaccctgtctgcccggtcagaccggccatgcagagccgatcagaccgcgggtaccactggtcagaccggccgtgcaatgccagtcagaccacccctagtctatgactttgccaatttcgtccaaacttttgaaatcaagcatcggcctttagtatataattttttttttcacataatagctagatgcttggtatatcaaattattggaccaaaattccttctctatagacatatgaaaaattataacattcaactaatatgtctagatgaatactaattcaattggcttttgaaacaataatcatcatgacatcaaaacacttagccaattgaagcataatcaataatgaatcaccaaagtcatatgtgtcacatgcatatattccaataaactaaaaatgtaagtaatcggcttgagcatgtatgcaaaatattaacaatgccaatgttcctaaagaaaaccactctaga

SEQ ID NO: 35861 - DNA, 10840 bp, Oryza sativa
  unsure (1)..(10840): unsure at all n locations
aannnnnnnnnnnnnnnnnnnnnnnnnnnnnnnnnnnnnnnnnntttttaacatctataaaccttttaatataatcagcaacagattcattgtatttatgcctaactgatgttaaatcagacaacttaaacttagtttcattagcataaaaataatcatgaaattgttcttctaattgagcccaagtatgaatagaatttaaaagtatcactattagcctcaccacattgcgccagaaattgacctaaatgctcccatgtggtcttaccatcctcaccactaaacttggcaaattcgggaactctataatttcgaggaaacggcacattatcataataatcaggatatggctttttataagctctagcacgattcctagtttcaatcctgaatctattcctcataatatcactaatcatatcctccatgctattaggcccttgtggatttggtggtgggtttggtggcctaataggttgcgtttgcggcgcaatatgattatattggccttgcctagtatcgggaggatatcccctagaaacatcattataagcattaggaatatgtgggggaacttgaggattacttgtagcagtagatacaggaggatcaaatgttctaaagtggtacaaataactagcattagtcattggatctataccctgtattgggacaattgcgccggtctgaccggccgagggcccggtctgaccggtgtcattatgcgcggtcggaccggcctgagggccggtctgacctctggggtaatacccggtctgaccggccgtttggttggtcggaccgacggctatattgcggtctgaccggccgtcaggcccggtcggaccgaccgtgaacgccgtcccgtcggttttactacccattggatctataggagattgatcaacagtggtataggctttatcctttaatgtgtaatcatccataaaagaatctagcctactccttaaaaatccatcaatcttatccttaaacattacatctaatctatctttaaaattagccatagatgaatctattgtagatgcaatttgttgttggatagattgtgatacctcgtcattgcttaccacgtcgggagctagcttgggacgcggcccgggcttgatgatcacgccttgacgagtcctagtagtggctctcatcaacgcctcccgtgtgagctcgttgatgtactcctccatagctttacgatcttctccttcgaagtcatccaatgtgactggcatcacattagatggctccacctccgttttggatgatggcttcgtcatggcgaagtcgaagttgagttgacgatgaacggatctcttccccagcggagtcgccaaaaatcgtgttggcaactttttcgactagtcgacaagcacgatcgcaacacctaaacgctttgcggtgatatgtagtcgccatccacctcgatctagccaaagggccaaatcaacatgggttttgcaaaaagaaaagctaaatcggctagcggagccgatttagagatcaaaatcagcctctaggccgatttagatcgatatgaggataactacctgtctcgtaggcaaaacggaaggttttcaggacaaacctacaaagaggtgtcgcactctcgcagcggcggcggacggtttacggcgcaaaccgacaaagatggactaaaactagggtaaaatagaaaacatggtaaaagaacgattcaagtagattgtattcgggggttttacaatgaaccggccttgtcccttaaatagtggttggtcttgccctctacaggcccttctccacatccaactcgggatagaaaccaaaggaaacacgaaacctgtcttcccgagtaaggaaacccgagacccgacgaaaacagactcggacttggaccctgacggtctgaccgcccacatacctgcggtcagaccggccctactagccggtcagaccgcccacatacctgtggtctgaccggccctatgaaggaaacccgtcactttccaaactttgacgattttcccctatttcgtccatagatgccatatttgggtgtaaacatatacgtaaaaaaattgtttatagtatatacgtatgtatatttctacgtacgtataagtgtatgcaaagctcatacatagtatatatatacacgtatatacgtatagagaggagagcagaaagagaggggggggggggggactcatcgcgcaggcgcacgaccgcccgcgagcatgtgccacccgctgcataatcgacagtcaaataatggttgccattactattaatacaaacaggagaggctttgcctctctttctaaaaaaaaaaaagaaaagaaaataaaaaacaaacaaacaaaaaagaaaccggacatcgcagccagctaacagtacaaggaggaccattagttagctgcactactgcaagctttggtttgagtccaccacaagcaagagtgcagatgtcaaccaccaaatgctgagcagctatgagttaagctgtgacaccaggtgcaccttttcatcctgcagcaaattagttcatggtcacactgtagttgtatccaacttgcaatgctaatctgttcctggaggcagctaatcgttcagcagttgcaattaacaagattgccagtgtcgcccaagcctacaatttgccggtctttctagtttcttgcaactattggccaagccaaatgctgctgttgatatgtagaaagtcatctgctctatatgagttcgatatatcttcacacatattggtctaatatatagctgataagaacaatggtgcttgatcaaccacccttcatttagtgccctatagcttccatgggattcgattttattcattacaatgtcaaagggaacttgcttttatcgaacaagttgtttagtacgctgtgacatttcaaattatacgagagtactacttgaattggtagtgtagataaatatagtccttggattaaaaaaaaaaagaagatgaatgacttgatttaattctgctgctagtagaaatcactctaaaatttgtccacaaattaacactaaaaaggcatagtacaagtgccaaaacgttcctaagcagggctgctggtagaattaatcttttgaaagatttctgtgtagtaattaaacactacacgtctgcatacatgtcatcaacccatgtgtcgtccatgtgccctattttattgttctattaatgaactatcaaaatataggtatatataccaaaaaaattctatctttcttgacttacgtaaataacaatatagcaaatcgacttatgatgggcaacaaatcatctgctctattccattacaaattaaaactcgtgagagcttcagaaactacgtactgattgtccaaaaattctcagagattctatgcatgctccttctgcagtacaagtagaggataggcattagaggcatagggacattgattttgttacaaagcaaacagattgctctgctaagcctatctcatggtcaatagtgacacagaatggtatcaagcagatgccttcccatttctgaggcaaactcacctgcattacatgcaggcttcaactgaccgttatcagatggatgatcgtctagcttgatccaatgcgctcaactcagcaccaaattaatcaaaagcaacccgttcattcacacgaacaaagtctcctggaaactcgagctgatgatctgaaaaatagtacgcattatgcgattcaatcctaaacttgaacttgtaacctgtgcatgtgcttcacttttacatgtagcaggatgtacaaacttttaaacagcatgataaaagtataagtttgaatatcgcgtctcaaatcgcaggggatgcaatgtaccatcatggagagatctgaagttcaaaatctattttagcacaactatcactagaggtttcaagaaggggatacagcgagtagtatcctgatctgccttttgtaccaaggattgacaaaaatacaaaattcaactagtgctgtctggttttgaaattttaccaaaatatgcaaaactttgctatagtgtctatgttgtatactcgctccagcctcaaaaacatattgttctggaattttcagagtcaattttcaatatacaactttgactacctagttctttaccataaactagtaggaagcagacatccagtacgtagccagcaagggagaaaagctacgtggagtggagaccaggtgaatggacacggagaaaagctaccgtgaagtgaagaccaggcgaatggacactagcaaacaagctgcttccgacaatcacaaatatgcatggtaggatgtttctactcggtggggtgcctatgttgtatgtgccatacatacttaggaacgtatatatcacatcttatactatgattattgtcaattaatatattaaagctgcaaacttgtaagcaattattacttaggtcataaacatacaaatatatggttttcttttttggaaaaagtacaccaaaggtcccacaacgtgtcatcgagttacaaaatcgtcctccaaaaccagatatccagcgtcccttaactaaccaaaaccggtcctaataggtacttcggtggtttttaccccggttttatcatatgtggcggctgaatcagcgtgggacccacgtgtcaggctgccacgtcacatctctcttccttcagtgtactttttccttcacgggaaggaggagtcaaaagggtgggtcccacttcctttttctttcctttctagttttattttcttgtttttctctgtttcttctcttcgccgttttctctctctgccctttttttcctcctcacgcgcgagtagcagagggagggcgccggcaacgcaggtgatggccagcggcggtggggaagacggcaacatggaagggggagagcatggcagcgcggtcgcgcgtagggggagagaggctgcacggcgcggcagctcggcagcgttgcctggagcggtgtagagaggaggaatcggagcggcgccgagcagaggtggtagggaagggagtggcgccaggaggaggaggtccgggcgccaattggagggggcggccaacagtggcgtcggtgtcgcttgggcgatggccgggcacatcagtgcggcgcgatagtcggcgcccgaggggaaagggtggctaaacgacagcacccatctaggcgtgacgacggtttgggggtggatgaagacgacgacgatggcggctttagtggcggaggaggaggtggttgtggaggcggcgcttgtgtggctcggtcgcgctcgggggctgcactcggcaccctggcatgcggcccgtgcttagcacatcatcctcctcgtcgccattctctgtgctcatccaagcatcggcctcgcgtgtgcaatgccgaggactacggccgccgccgcgcccgggctacttcgtcacaggcgaggacgccgcctccttctcctgcctcccgggcctctctgaccctgagctcccttccttctcccccgtggtctccaccgctgccaccgttgtcgccggcgtggcgccgccctcctcctctcctaccttgccccagcgacctcctctccgcccaccagcgaggagaaaagagagagaaaggggagagatgacatggcaacctgacatgtggggtccacgtgggtctcacgctgactcagccgccacgtaggacaaaaccagggttgaaaccactgaaggacctattgtgaccagatatccggttttgcggttgggggacgatttcgtaactcgatgacaagttgagggcttctactcccttagtcccaaaatattagggattataatgaatctggacactagtaacgccaatgattattaatacaatgctattatgtctatcgtgattattttgggcattatatgcttgctgtttgacccaagatactatgacattttcattgatgtttttgttcttttaataattagtagaaaatgaacacaaatgttggtgcgtcacactggtggagaaaccctttgaagtcccggttcgtaacccccttttagtcccggtttccaaaccgggagtaccaatccgggactaaagatcgctatctttagtcccgggtgaaataaccgggactaaagatcgatctttagtcccggttggtaacaccaaccgggactaaagatggctcagccacgtggccggctgagctgacctttttttttttgcatggccctgttgctgcatggtttatatatatatatatatatatatatatatatatatatatatatataaaccatgcatatatatgtttcaatacatatatatgcatacatatatatatgtatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgctgcgataaattctttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatatagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctttgtttcttgtggatattggtcgagcattgcgacgtttactttccgagggtcgatgaatccagtatcgaaaaccctccgccgtcgggccctttgaatctccattccacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtctgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctacaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccctgggtccttgttcttggcggcgtcaactttcgccttcttcgttgcccttgtgtgggcaggcgatggagctggggggggcccttgactttgaaggtgccggaagaggagcttgcggaggagtaggtgtaggagcccgaggaggagtcggtgcaggatcctgaggaggagtcggtgctggcggagcatgaggaggagacggtgcaggatcttgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaagtcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcatcctggatgctctggagtctgcagggcgagtgtcagctcgtccctatctctgtcgggtcagaacgtgccctgagaggaggcttccactgcatctgttagtcgtcgcgcagcctctcgtatctgaacgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcatgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacagg

SEQ ID NO: 35862 - DNA, 1968 bp, Oryza sativa
cctagaaaattagggtttagcttgtaggcttttaaaataatttctaagaaatgatttaaaatatgcatttttaatttagtcgatttttagggcgtgacaaacctaccccccttaaacggaatctcgtcctcgagattcagaagaactggcgaacagatgaggatgagctgacttcaattcatcttctcgttcccaagtggcttcttcttctgaatgattactccactgaaccttgcagaaccgtataacgcgattccgagtattcctctcgcttacttccaatattctgactggcttctcaacataagttaaatcttcctgaagctctatacgatcaggatctgcttcctccgtaggtacacgtaaacatttattcaactgagacacgtggaacacgtcgtgtattcccgccattgacgaaggcaactctaactgataagctacctctcctcttcgactcacaatcttaaaaggtcccacaaaacgcggtgccaatttccctttggtttggaaacgatgaacacctcgtaacggcgtaacccgaagatatacataatctccttcttcaaaagccaaatctctgcgacgattgtcaacatagctcttctgacgtgactaagcaacgcgcaacctttcttggataatcttcactttttcttccgcctctcgcaatatgtctgtcccaaaaacttgacgttcaccggtttgatcccaaagaagcggcgtacggcactttcgaccatataatgcttcatacggagccatttgcaaactagcttgataactgttgttatatgagaattccgcgtacggcaaattcttatcccaacttccaccaaaatctagaacacaagctctcaacatatcttctaaaatttggtttactctttccgtctgaccatttgtttgagggtgataagcagtactgaaattcaaacgggtacccatctctacttgtaatttctgccaaaacttcgaagtaaactggctacctctatctgacactatcttcttaggaacaccatgcaaacataccactctggccatatataactctgcaagcttatgccctgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgcttcaagtcttggtacatcttagtgcttccagggtgaatggaatacaaagtttcatgagcttctttcatgatagtatccttcaactccttattatctgggacgcaaattctttctcctaaccacacagttccttgctcatcttctacaaaaccgatggctttacctctcctcatgttctttttaatttcttgtatgtcaggatcattcacttgagcttctctaatgtcacaccctgattttcgtcttaggatttataaattatttaataaattattaatagaatttatattaaatgttcattaatttacaagtgaagttaaatgtgggaaataaaatttcctaaatataaagcatggatggatttaatttttattaaattctccgtggttaattatactctctggaattttctcggatttttcggagctcaattcctaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattgaaagatcatttaagtgattattttaattggaaaaagtttt

SEQ ID NO: 35863 - DNA, 956 bp, Oryza sativa
atcgattcctctcgtttggagttcgatctcttcaatccaatgctataaatagcatcccctagtcgtcctcttgcgtttgccccaagtcccgagctccctggtcgctcgtagcgctgccgcgccgttgccctagccgctagccgtcgccggcgatctccagttgcgccgcgccgtcgcctccgccgtcgccgccgtttgccgtcgccgccgttaggtgcgccgtggtgagaggaatctcggccgcccgttccccttcgccgccgaccaccggagctccgccgtcgccgtcaagccgagccgccgctgccgttctcttcgtcgccggttgtcgtcgtgcgtcgtttgacgttgtggtgagtaccgttgggttcgcctcgtcgtcctctacacgtaggtgtcttccaaatccccggccaaggcccctatctccggcgagcttgctaaccctaatcggccggccgtgggtgacgtcatgctgacgtcatcatcctttctttttccctttttcttttaatagattagatcttctaaaaatcatatctaaataaccgtagatccgtttcaggtggttcaagttgctaaatttttctaaaataaagatctacatattaaaattgtccataaattgaattaaatttatttaattctttttaaatgggctttaattagatttgatcttgtaaaattcataattaattcatatgaagtcagaatgaggccgttcaagtcttataattcatctaaaattatgatctacatgtttgtttactttttatgtactgtttattttgtttttattagtctttttcttcgttttgcgtgttagcttgtcgtttccgtcgttgcgaaggttcgtgagtgcgtcgggggatcaagaagattaattgaagaccgattattgcaaggcaagtcacacagatcgtaaacacaatcctttgagcatgttgatcctatat

SEQ ID NO: 35864 - DNA, 705 bp, Oryza sativa
ccttcattgttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgctaagggttatggaacagaggaggtcatcgaattttgcgtagaatttatcgaagaccttcgcccaatcggggtacctgaatcacgccatgaagggagactacggggaaagggaactctcagaaggaaagcaattatgacggtagacaacaatttattccgtaaagcccatttcactgttctgcaacactcttcattggtactccttacatcgaggagcacttggctctagttcgcgccaggaacatcggtaagtccgatgcatggattacacggcatcacattgatactttccccgcgtggctacgacaacatctcatgggtaacgagtcgatcaaccaacaactgccttcctggcgaggggaccgtcttggtcgatcgcgacattccagggatatgagatcaatgggtacacattctacacgagagcccaagacatgaagagcacgaaccaaaacagcgctgtttgtgtcgatgccatgggacacgatggaacaactgccacgtattacggtgccatcgaggacatacgggaacttgactatgg

SEQ ID NO: 35865 - DNA, 12747 bp, Oryza sativa
  unsure (1)..(12747): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactattttggcttgttacggaagctgaaaaaaaggtactccctccgtcccaaaatataacaacttttagcacttaggatttgttacaaaatatagcaacttcttcaccaacattccattcccaaccaatcacaaccctccaccattcacttttcccacctacctccacttttcaaccaattacaacctcttcctatttaattctacacactttcttaataaccgtgtctaactctaaaactacttatattctgggatggagggagtaacaaaaagaataaatattacgcagcagcattaaaactggctataattatgttctggttatgttgttattcctggagttgtttatcttggtctccaaatataatctagagaaagtttatatgtatgttaccttgacagcctttgggaagataaggattcccttcatatccttcagagcatttgcacaggtacccttggctattacttgcttgcacacacttgctgtttgaactgacacaggcatagtctttgggcaccttcttcccctctgggcaggagccattcctgatggcccagtcatggatgacaggaacacctctgttggccctcccattgacaaacctgaggtgcccaacgaggtcttgctgcctgaagctgtaccatccggcctccacaagcatggcgtagaagcatgggttgaattcccacaccgcgctctggttcatcaccaagatcgctgcgaagtccttcaggtctgggatgatggtggtctcgcagcagcccatcccagtgcagggagcaccgttggatgtgctgttgatgctctggcagtaggagtagcagccagccacatatagattagagttgctgtgcatgtagccaccaatgatgccgagggtatggcatccgatggccatgaagcggttgcgggtggtggaagggacgaacggcgtaccctccagggtgaaccctgtggtatggttctctggtatggtggtgtttgatgagaaacagatgtaactgactggaccgtaaacgcgcacctcgccacgctccagggagatgtcgatgacctctgtttctgataggaggtctctaaccataggccgtggtggctggaaggtgtcgttgcaggtgatggtgaagtagctgctcaggctggtcgcagaacaaccagcgccgatgccaaatgggtaagggatggatacatttccgcacttgccagggcagcctggcaatgaaattgcaggttcagaggtggtggttgatatcgccattgcatggaagacgatgagcatgaggagaacggatgcttcttgcatggttgcggagttggaggtatggtgatcacttgctagttgctgtggcactatttttgaacctacttgttcgtacttctgcatcttccatgtctctttattatgtgattatatactagagtactagactgggacaggtgatactagctcatgctactgcaacttccatgtatctctattatgtgattaactatactagacttggacatgtaataacgttcatgcttatgcaacttccacgttgctttattatgtgattatctatactagattgagacaggtaatagggttttaaagaagtaaggtcaactcctttattccattgcagatgttgtgtttctaatgctgatcaaatggatattgttacatatgagttgatttcaacgattgttacttaactagctttggtgagatcagcatttgacaggaaactttaccttgcattctgttttgctttaattaagaagtgcattctgcaactgaaaatacttcccgtacgttttcggattaaaaaagctatgcaggcaacaattaccccgtacatttcccttaatgtgaaaaatttattcattcacctggattgaaaagctcagctggtgcggttggtaagtactactacatcattttgtgtttaaaagcttagtaaatcagacattttggttccttagccggcaagaaagttgatgtttatttgagtgatttcaaaggtgatgttaaggttttcttttcttgtatgtagttgaagtcaactcttgactaaatttgatatccttgacctgaatttgctagactttagactacgtgtgtggcactgtggtgtggtgactaatcaatcagttctcttccttccgctatgttgtgtgttgtgtcaagagttattctatgaacttatctgatgattctttgcattagctgtagcacaatcttacattcttatcatggctgaatgaattgtgaattctcttttacttttgcatgatctttttagtacttataatttcactttgatatataggttcttcccagctccctacacatgaagttgtcttggaagttggaaccactgatgctctatgtaaggctgacttagttaaggggaaaacgatgaaagcttcagctaattaatcagctcctaaattctgagcacatataaagccaacccacactatggttaccgaagtttcgaaattttaaggttccgttgtttttccaatgtataccacattatttgtattggatcagaaagaaaatttcatttccacaaatagtcattgtccgactccaattaacaccgatgcctgaatatcccagacaattagtgtatgaactctgaaattgggtatgagttctgaggtgtatatcttcctctgaattttttcctccacttgtaatttatagattatacttctaacagtgatcaggagcactgtaaatttcttactttggattactagccatggatttgaatttgatgctcgtactatatgcggcacaacaagtagtcactaattaataatagaaatcaacctgtaccaggtacctgatctgactatctggagtgcagcacactaaaaatgaggcttctgaagtctgaactacggatagatgaaattaaatcacactagaacgtttggaaatatataacaagtgcatgactcgatctctgtggtttaaacatgcatatgggctgacatggaagaaatcaagctgcacaacgttgatgaccttactgaaactttaatatttagatagatacatatgcagcctgttcgacctaggcatataaatggcatggtactatagtacatggaagcaaataaatatacgttaagtttttcgagggattggagaaaaccaaatgtaacattattatttttctaactgtttttctactcaattctagtgtaacttggtgtgggctagtgtggcttcaaattctctcttgtctaatccaaaaaagtcgaatcagaagcaataaaaccagtttattttctgtttttgaactgatctatttcttgccatgcatagtaagagttattatgttaggttggcataataaaaacagttattatgttagggttgtgttctagttttttaaaatttgtttacactagttaagaagagaataagagtataacaaacatattagcgggattatggcaatatacatatgagacataaggcaactatacttgctttccctcatattcaaatatttttcccttttacactagttaagaagagaataagagtataacaaacatattagcaggattatgccaatatacatctgagacataaggcaactatacttgctttccctcatattcaaatatttttcccttttgaatttagaatgagaacaaaacaatggtggttcttttctttgatttacatctctcttttctacccgtgcacgatgctgcaatgtgcaaaaatataacctgcaacctaaacattcatatatggcgcaaattctaagatatatatccacttctgataatttctttttctgtctccatatgcatattatacttctggtagtgatcaagagcttgatgtgaatttcttagtttgaattacgagccatggattcgaatttggtcctcttacttccgtaagttactcactgctcattaatcaacctggtaccaactacctggagtagagcacactaaaacaaacgagtcttctgatgaagaaacgaatgaaattagatcacggtgcgagatctataaataaataacaagcacatcacaacatatacatgaacaatctcttatgttcttgcctcctgtcccctctctctctctctcccctaaacagagagcggcctacgaaatggattgacatggaagaaacaaagctgcacaaattcgatgagctcttggtgaaactaaattgtagttttgtttctttccctattgcagcttgcatatgagactcatccaaatagggatgaaaaggatcagaaatggttagaaacgatttttttttttgcaaaatttaccacaaaacacccaaaatttgttaaagtggcagcgttattactgatgaacaccacaaaatcatataatttgttataggacatcaaggcaatattttatcatttctgggtaaaaaagagaagaaagaaatttaaaaaagacaaaatcgccctaaaccctatctaatccccacaggtgacaggtgacttcatcctcggtgacatcacctgctttacagtgccgctcgctaaccgccatagaagccgccgccgcagggctcacctgccgttgtcaaagccgctgccagccacagtcgaagccgccgccaccgggcttgccagctgtcgttgaagccgttgtgggcttaccagtcaccgtcgaagccaccgacactgggtttgccagccatcgccgccaggtttgctagtcaccgtcaaagctgtcgtcgtggagcttgccaattgccgttgaagctgtcgcagggcttatcgtcgccgtcaaagctgttgccactgccgaacttgctgaccaccatcgcaaacgccaccaggctagctagctgccgtccaagccaccgccgctaccgccaccattcgtgccaatgggggttagatagggctggacaattgtgttttttgaattttatctctcctatttttgcctggaaatgataaaatattgtctcgagtgtcctataacaaatcatacgaattttgtggtgtccatcagcagcgacacgattttacgatgtctcctagccaattacacaaattttgttgttctgggataaattttgccatatattttttttattttttctgaaatggtacgtaaatttctatatttatgaagttgaatttgtttatccattaatttgttttttttttcgttgcaagatgtagaagttgaatttaaacttgcatgtttgtggagtgatatatcacatgttaatacatcttcttaaattttttcataacaatttgagtgacatgcaaacaacgaggggatatcccatcgagggatcaaaatccactccgcatatatgtgtaaagttttagtacctaactttgacatgtattgtactagttgattaaacactgaaataaaaagtcgacgcgggaaactactcctctatgattaatgcagtctaattttcaatatgagaaggtggatttgtaagttagaatcaggtgctgcaagcctgctaatccatgctgccaggagatcgtaaggttcagtaaaacacttataacatgacaggaatcatctcaacagcttagtgctaagtattgcgaaaaagtgaaggacacagtagcattttttgtttggaaaaaccgttgcccatcatatatgcatgaccaagaatataatcatttctagtcgtgtccatctctctactctttctgaaaggtcatctcggccacttacatgcaatcgggatgatatggaagaacaaaatctggatgacctctcgctgaaactatattgcagcgtttaatttctgttcagcctatgcttatatataaatagtaaatcgaagtaaataagtaaacataaaggatcaatcaactaatgagatcaataattatttagttgtttttcagacaatgtaaatagttatttagttgtttggagacattggagaaatgcaaagtagcaccatgtttcaattgggaggacattatcactctaatcagacttactctaattctgaaggggtggaagttgttcctttatcccgttaaggaggagtggaagtggaagtggaagttgttagatctagatggtcatattaatacctgaatcagacgtactctaattctgaaggggtggaagttgttcctttatcccgttaaggagatctagatgttcatattaatacctgaattttaggaggagtggaagttatcatatcatattaatacctgaattttgagttaagttattaaaaatgtatgtttaatatatttttacttctcaatttttttcttagtatttatacataaatttagatttcattttgtgtaacggcgagaatacaagcttacaatatgtggagtattagtgcaacctttctattagaatcacgttgagaatcgatgtggttttcaatgtgaacttaatcagaaactctcataaccaaccgcgttaaacatgtctcactcagatgggagatgtgtgaagtgccatctcaaatacatagttctagcacagtttgaagaagttaattaggaagaaaaccataaaaattctagaaatttaaacggaccaaaaagtaacttatcctgggagaggacaggtgatgcctttctagaacatttagcatagtcgcaactaatcaagcagtagcagtagtctacgtgctctctaatcacatattttaggtaggaggtgtgaattgttaaataggaatcagctacagcaagcataatctgactgataatttgggtgaattgttgcaaccaccactggtaagttctgagagaggcatttgcatcagctgcagcaaattggaagtgggaactcaaagctatttgcagcaagttaaaatgttttactgaatcaaaaattactcaatggggtttgttaaactgatccgatttgaagttgcttttcaggatggaacggatgaggctcttggactccagtactccacattgacattgtcctaccgtggagtttagaagtcttgataacttcaggagccccatcggttgtactaaggtcccgttcttttctctaacaagggctggatgaatattaagattttcgtggcacactttttaaactgctaaacggttcgttttgtgcgaaaattttctatatgaaagttgctctaaaatattatattaatctatttttcaagtttgtaataattaaaacttaatcaatcatacgtttataccacctcgttttgcataaaaaacttcatcttcaagaaaaaagaacaacacctaaaaagaattaagacaaattatgccgtaatttatattttaaaattcaatttagaagatgattttaaaatattttaacatagttttttattgactttaattcgctaagaatacatgtatataaaaattttcgtataaattatttttatcgctaataaataaaccgttagtaaccgatgaggccccaaattgcccatggctcgtcattgaggcccattttcgttgggcctgttgaaagcgtcaaattagattacgttttgaaaactagaatacgcccaggctattctcgtaatccgctcgggtgacggaatggagtctctcgcccacatcgccggccacacaccgcggcggcgtggagaggcggagtcgccgccggcggaaagcggccccccggtccggcccttccaagacgaagccacggacatgggtccggtggcgtgcctcaagtggcggcggcggagatcgccggaggactagcatttcttggcagtcgggattggtggcggcggtcgcagtttgaatcggcggcgggaggaagagacgccgccgcgtcatggggtgggagaggacacggggcgctccagctccaaagcattgcgacctcaggcgaggttatcaggtaactctactctagttctgaatcaaatcggactgcacaactgaatatttttatttatttattcgttctattcagaatggcatcaattcatgatccccaagattagttattcgtcttcattatcttacaagatcaaagcatcgtggctgcaggctaaggggagcaaatcgaagcattttatttttcaggtaactttgcttctgaaatctgatcaacttggctgtatacaattgaatatttattcagaatagaagagatcattattgccacaaacaaggaacaaattgcttaaacaataattacagcagttggctaaaccaagtagtatttactatggcattcgccaacacaagaattaacgtgctggtacaagcttcttcatcatctcacaagatcatcaaccaatctggacgtttcaatgctctcgtatatggtctcattcaagtgaacaaccattgatggcgatccttcatagttgtgatgtgcatagctgtctcctttgtgatcactagcgccgtgcattgggtgtctccttatcatctgtaggcactctaaaacttccttcattgttggccggtcatctcctcttggtcgcaggcagttggcggcaagaatggaaagtttctcgagcacaaccatggtttctttatccataatttctctgtccagcatattccggtgaatgttctgatcaaacatcaggagaaaagaataggacaatgattccttttcattgatgctattggcatagattgccctctttcttgtcatcagctccagcagaaccaccccaaaactgtagacgtcgcttttgtcagttagacggtggctaatgaagctctccgggtcaaggtaacccaaagttccttggacaaacatgatgaactcactttcgttcatggacttcagtgctgatgccccaaaatctgcaacctttgcattgtgctgatcgtccaaaagaatattggccgatttgaaatctccatgaaggatcgcgcgagacgttgatgaatgcaggtatgctagagcttctgctgattgtgtggctattttcaggcgaatgtccaaggggattgatgatctacgatcagtgccatggaggaactcagacaaggtcccattggatacaaactcatagaccaacatggggacatgtacatccaggcaacatcctatcaacctcacaatgtttctgtggttgatctgtgacaagattattatctcattgacaaattcttccctccattcgtcgttaattactttggacttctttatggctacctctttgttgtcatccaaaattcctctgtagaccattccgtgacctccaattccaagaactcgatcttcactgtagttgtcagtggccttttttatatctttttcagtgagtatgcggattgtgtctaccttccttgatctcatctcatcatatagctttagacctccattttgcttgaagtactcatctttgtccttcttatgccttttcctttgtacttgcatggccaacacgcatgccaaagacattagcgcaatggccgaaacactggtgcctttaaaattatctctgtcagaatattgatactaataattttctgctactaacttcttaaatttattttttattgacaattctaggtagtgttcaaaattagtattcttcttgccatagtattagtgttactttgagtagaagaacatcctaatgtaggtgaaacagaagtaaaatctgcagatgtgaccttaccaataaccactttctcggctgtagtgcgcagaggccggcatccataatttgtaccatcagatcttttccctaacttgcatttgcataagtatcctcctggtgtgttgtggcagattccttttctgcatggatacatatcctcatacttgggatcttgcttacgcaatgcgcactcatccacgtctgaagatagcaacaaaaacatccattcataaaattcagaccaaatttgtatgaactatataatctatattaatttcgttatcataggtaagctaaagtcaaccagccaatttacttaagaatgctataactcccctttcaatacttgttccaaaatgaccttttcactttgtaattaaaaatctaccccacaaatgaagctgactgtttctttttccagtcccatgctgaattatggtggaaaccatgtagaattgctgtctattgatgaatgttcatatgattttgtagaagtatagcttacaaactctacctgaattaacactgtgcatggtatagaattctaccagtttaagtatgaacctaaccttggcagccgttcagaagataagggttgccctcataccctttggagcactggcataagtaccctggaccattgttcgcgtccatgcagtagctgtttgcgctgatgcacgcataatcaccaggtatgcctttcccctcttccgggcatgagccattcctaatggcccaatcagccacaacaggtgctcccctctgagctctgtcatctatgaacccaaggtggccaacaaggtccttctgctggaagctgtaccacccaacctcactgaccatggcatagaaacacgggttgaagctccataccttgctctggttcatctcaaacatcgccccccaggcggtgaggtcagtcggtatggcggcctcgcagcagcccatccctgcacatggcgccccatcagatgtgctgttgatgctctcacaataggagtagcaaccagtcacatagtggctcacggttcccttgtagccaccgatgagccccagggtgttgcaaccgatgactgtgaagcggttgcgcgacggggaggggaggaagggtgtgtgcttcagctcatacccttcggtgaacttggtgaacgtggtatttgccgtgaagcagatgtagtagacagggctgagcacccgcatctcgccgtgctccagtgagatgtcagtgacctcgacgagtgcttcagagtccccaaccataggccgtggtgggttgaaggtgttgctgcaggtgagattgaagtagctgctgatgctggttgcagcacagctggggccgacgccaaaagggtaggggatggaaacatttccgcacttatcagggcatcctggcaacgacagactgtacccagaagaagctgcatcctgcactgccactgcgaggaagatgatgcttggtatgaccttcattgcaaggactaatgcttcttgcatggctgggtgctttgtggtcactggctttgccatttactcagtgtactggtatgaaaactgcatatttatacctattttttagggaatattaaaattgcatatatacctcacaggctcagtcttaaatcaacaggataatactggtttatcttggtcatttcttgccacccaagtcaatgcaaatttggagtataatactagttggatttagttatatgtagagatgtttccaagcatgttcatatatatgggatcagcgtaagcaaacatgtacagtgactttcatgcaattttgttttggtttaactatctgaaactgagggattcgtctctcttcttccaagaaaacaaaaacgcgctttcgacaaataagaatctgacttttaaatgcagttttgtcaagaattaaatcatgcaacaagcaacccttggtttggtcaatggtcttcttattctttatcatatattgcaaatcagcagtttattttgtaaagatttccatcgtttttgtttcgttgcaggaactaaatattttttcagtgacatgtaggagaagaaattcaattcaaacctgcgctacggatccatggtcaatgttgctatctttgaatgtgatagtgtgagaattgttaatttggatcagctgtggcaagcacaactgctacagaatgtgttgggtgttctgaaagaggcattgcatcagctgcagcaaactgaaagtgtcaagttacttgcagcaagttgatatgttttaaggtaaaacctccactgtggattcaaacagaacttgatgggggtgctaactgtttaagcttttcatattaacaatgttatgatgaagccttaatctttgtaacatgatctgatccttgtatgatcaatttgttcgatctgaagcaccatagattcataatgcataaatatgttatcgtttgaataagtgatagttttattgatactatgtatatcgtttcttgatagttttctaatacaatcatttattatatgaaaaatcatgagaaaacaagttgatccaagcaaacaaacaaacatatggaagaataaaaattttgtcaggaatgaattgatctcgaaaagtaaaaaagaaaaagaagagagaagttatccatctagctatttgaagctgtatgaaattcttatactttgcattgtgctactgtcctagtacattagtctgaactctgaagttgggcatgacttctgtgatgaatatcttcctttgattttttttcccttcacttgtatacttctaacaaagatcagaagcaaatatatattcacttctcactactcactattcactactcacttctattccgtacatattttttttttggcaaaattggtt

SEQ ID NO: 35866 - DNA, 2868 bp, Oryza sativa
  unsure (1)..(2868): unsure at all n locations
gctatataaccaattttgcctttttttttcttttaacttgatgcaaatatatattttccctttctgaatttagaccaactcacatatttatccagaacatccgaacagaaacaatgtggttgtttggttgttttctttgatttaattgcatctccctatcgatctttaaaaaattgtgcacactgcaatgtgcaaaatatataacccttaatctaaacacactgatatggggcacgcgagttcgtgtatccgcctctgattttatgaagaaaacaaatcttctcaatcaatcactgcaacaatatatgtacttacttccaaagaattttggttttactaaattatataagaccaactcatatatgtttaatcaactacttgtatatatttggccgtctataatcggcacgttcatgacgatatgtaccgtccggagaagatacgaaaaattccttggaaagaaaatgatacagaattctggaaattatttaatatgttataccacaccatttcagagacagcaaagaagtttccgttggaaagaaagacaaaaaaaaagaggaaattccagaacctcagtgccggcgcagagccggacgatacccatcgccacctatttcttctcttcttccgctttttttttaaaaaaaaagactaaattttacttgtcaactnatcattttaactaatatttnntcactttttnntataaatggaatattnnttcaactttggatnncngaagtatttttttttagggcaattgtccaataaagttnttagctatggcaatgtgggtataccnaaccttgttgggccgaannnccgnngtcngttgctttctttgtttcattcataatcccacaaccagtacccaatatttggggatgagccttatcttaacttgttgtcganncatggcgnngtcttgaagggtcttgactcggtagtcgacaacaagggatagcctttcctccctcgaatccggccatccggcgagatcaagagacagagcgcctagcggctatatctctcctgacggtatccgtaggcaccataggggactggctagtctatctctgaagtcgatatccggcgtcttgtcttggcgtatgttggcttgtatgttgatcttgtgtcttgatctattgttccgtgtcccctctcctcctatggagtcttgtatttatacccatatgtccttttgtccaagtagaactagagaaactaatatggatacaatccgagtagtccttgtggtttccatgtagaaccctattcatccttccttatgcggaactcctcctatatccgaaggttgtattcgtataagacatggtatgtagtgggtcctgccgagatttagtcgactactattatgtatatggtatctataaccctgacagcatgtttgtagaatgatttacgataactcaatgtgtgatgtgttgatctttctacaattcttcgtatatttccattaggtttaccatgcaaagaacatgatctatgctcaaattgttactttctgtgtagcaaaatctgggcaatatgaatcgtgaaatatttatttaattacaaataaaataacagctaaaattgtatgtaatggttgactaatttttgaatgtggcttgcacggatgctcctttttaattattggtgcaaagcgcagcggccacgaagtggagcagcggcttaatcacaccgatatagtttgtcaggctcacatagtggaatccaacttaatcgatgaaccactctaaatagttgtctataacctctgggagaaaataagaaatggttgagattaagcactttttttgtttggaaataaacaaagctcatcatatatgcatgaccaatctccaaccatctatatgtgtgacaggaaggaaaagaagttacccaattttgatgaccttttattgagaagtaaaattcagataatttattcctgtttcagccttcatctatatatcggtcattgagcatatataggtgtgattacctatatcgttgagtacataaatgcaattatacatgtctcaagagagccaatagccaaagattagaatagtgatgaatatgggcttaagatgcacttgtgccgggccttacatgggccgtcataaataggcccgaatggtgctgtactacagtgaactggaatagaggtcacaattgcacatatgtcttcctcccagtcccaagtcccctcatctagaccatactaagcgatcatttgcaagcaagaaagaaaaaatacttataaataatatgttacacacttcatatttctacatggtttcaatgtttaggagtcttgactttgagcatttggatggaaacaaaacaaaggaaatttggtggaattaattttgtggaagagagatactagagaaaggggagagtgcatgggacttcttaaaggaaataaaaacatatagctgttcatgtttgttttctcttggaaggggtacagaaagcaaatctgtagaacttttctcaatcatattcccttcatcccttgttacagtggagttaataggtcgcaaaggctccttcggattgaaggatttttagaggaaaatggagtatttaaattactatagaaattgaaactattcgctcatcggaatgaaggattagcatacaggaaaagtgggaaaaaattccttatttacaggtttcacaataaaaacacgggaatttaaagatcaacaggaacttatttttcattcttttgctaagtacaagtcaaatcaatactcaaaactttaagtggctatatttgaaaagcacatatatacgcaagtttgtttaatttaatgtgattgcttagaaagattattactcattccatcc

SEQ ID NO: 35867 - DNA, 3635 bp, Oryza sativa
aaatctactccctccgtttcaaaatgtttgacaccattgactttttagcatatgtttgaccgctcgtcttattcagaaaaatttgtgaaatatgtaaaaccatatgtgtacatgaaagttatacttaacaatgaatccaatgataggaaaagaataaataattacttaaactttttgaataagacgaacggtcaaacacgtacttaaaaagtcaacggtcaacggtgtcaaccattttaaaacgaagggagtattatattatgtgacggagggagtagctttctcgtttctcgtttcgcctatgttaaaatattccgaaatcccttgggtacaaaagtaaccgatcttggcatatgggatgcattgggattggcatatttggcacgaagaagttgtgccgggttcatggcttgtgtcatcgattcatcgcataaacaccacactacgcctacggagttcttctacttgaggacttatgcgtagccctgcatccaccataaatgtgtgcgagcagctttctgtggcggacggcgacgatcgacgtgatggcgacgattaggaggagcaacacgacgatcacaacatgctactacgtccgtcccaaagtatgacaatcttttactggatggaatatatcctagtataacgaatctgtacatagatgtgtcctatcctgtaaagtgtggctatagcacagtatagtgatctgatccatcgatcagagagaagcagctgatctctccaataggccgaaccatctgacaccacgaccttgattactgtaaattttcctccatttctctgcttcgctagctggagtagtagctcactgcatgcggccatggctactggctgtactcgctgtagctgatcatccgcaggatgctggtctttgcactgcatggtgctggtaacaatagtagtagccctggcttcctcgatgcatgcaggcacgcggccatggccatgacatcaccatctactcctccagctacggatcagtagtaggagtagcttctgcttcttgcttctcgcagacgcgtgcagtgatgggggagaagagagagaggttggcctctataggctgtgtttattttagcgtaaagtttagattttaattaaaattaaagatgatgtggttaaaaagttatgtgtgtatgacagattgatgtgatgaaaagactgaagtttagatccaaaattcatctgtaactgcaagaagtgaaaagccgtctgaggagtagtgcggccaattaaatttttcttcagattcccctgcactgtaggagcagtagactgtagtgcccgtgcaggcaggctcaacttactgtaggaaacagtgcaagattcggctggagagggttaaaatcatcgtcagtaggacaaatcgcagatccacagacaccaacggctcaatgaaatgactctaatcattccatggtagtagtcgtacagcagtaaccagctgctcaaatgaaatgacacgatcattaggtgtctttacgaattagtacgatcgtcagagttccctattagtgtacgagttgattagggcatgaacaacgagggaacgtacttgtcgccacgtttcgttccaagtcggaccgtggctgccagctcatctttgccactggcttcacatggctccctttgccttctgcaaggcacgcctacctcacttctaacatgtactccctccgtctcaaaaaaagacaaaccctgtttttcgtatccaacgtttgaccatctgtcttatttgaaaaaattataaaaaaaattaaaaatacaagtcacgcataaaatattaatcatgttttatcatctaacaacaatgaaaatatgaattataaaaaaatttcatataaaacggaccgtcaaagttgaacacaaaaacctagggtttgtcttttttttaggacggagggagtaaaacttactgtattgtgtaacgccccgtcgcaccatatatatgtctaatagatctacgataggccggtgcaaaccagattaattgtcagaataagtggattatcaggacagagacgaggaacggaggagtataaggttgtcgccatcccgccaagctcctcgccccctgctatgtcggtcatcagttgttgtccgatctgaaccagtattcctcgtccctgctatcatcaaacactcgatctgccactggatccaacaagctcgatggcgtagcaatagcgaacttgaggcgacataataagcatgacaacgagtccgagcaaaactgatcgccgtcggcaagctcgtgggcgtccctgtttagttcccgaaatgaatttttttaggtgtcacatcggacgtttgaccggatgtcggaagggtttttcggacactaataaaaaaactaattttatgactcgtctggaaaccacgagacgaatcttttgagcctaattaatccgtcattatgacatgttggttactgtagcacttatggctaatcatggactaattagactcaaaagattcgtctcgcaatttcccccctaactatgcgattagtttttgtttttatctatatttaatactccatgcatgtgtccaaagattcaatgtgatgtttttggaaactaaacaagccctaagagaagaaaaggcggcgatgctcgatgatgtggtggtctctgacaacaaggaggatgagacggccacaacgataaaggctgtgtttagttcagcgcaaagtttggattttggttgaaattagagatgatgtgattgaaaagttgtgtgtgtatgacaggttgatgtgatggaaaaggactgaagtttggatccaaactatggatctaaacacagccaaagagtaggggacgtcggtggtgctatcgaggagaagtaggggaggtcagctagtggcgtggtgcatagtgcatgaaaacaaagtcatagattgaggggggttgggagaaaaaaatgagaggtggagtggatcacaggagtaaaatttatgttaagggtgcgtttgaaggtttaggttgggacttggaagcatatttcctccacacattaaaaaaagtactctttttttaaataccttattagcgtatgattaattaagtaggcaattatgtattagtttaaagttacttaaaagatagtataataatatgatttttttaaagtaatttttctatattttatctagggtgtgtttagggtgtgtttagttggggaaaaggaaatttttgggtgtcacatcgaacgtttgaccggatgtcggaaggagtttttggacacgaatgaaaaaactaatttcagaactcgcctggaaaccgcgagacgaatcttttaagattaattaagccgtcattagcacatgtgcccggatgtcggaaggagtttttggacacgaatgaaaaaactaatttcagaactcgcctggaaaccgcgagacgaatcttttaagattaattaagccgtcattagcacatgtgctgtactgtagcacttatggctaatcacggactaattaggcttaaaagattcgtctcgcgatttcccccataactgtgcaattagtttttctttttatctatatttaatgcttcatgcatgtgtctaaagattcaatgtgatgtttttggaaaatattttggggaact

SEQ ID NO: 35868 - DNA, 23164 bp, Oryza sativa
  unsure (1)..(23164): unsure at all n locations
ttgtcttttttctaataagccaaaacggtttattagagaataaaaataaatttataggtaaaacttttatatatatattcttggtgatttaaaagccaatgctgaaaaagaaactacattgaaaatatctcaaaattaatatcaaaattaaatttaaaaatttaaattttaattatttttttctgaataggccatccgatgagagccttaattggaaagatactgatggtgagttgaggtgatcgaatgcacgcagagatgcagtttccattgggaaatttgggttccagtgcaaacgccggccggcgagtgtcagctttgagggattgagacagacgctgacttgccgtgtatgcctacccctgcctgcccgacggtcagatcaacgtcaacccttttcacctcgatctccacgtaccgcgcctgtgatgacgccattgctgactgcaggcccgttggatccagaatcgacggtgccgatccacagaggtcccaccgtaaaaaaacaaaccctgatttccgtgtccaatgtttagctgtgtgtcttatatgaaatttttttataattagtatttttattattgttagatgataaaacatgattaatactttatgcatgacttgtctttttatttttttttataattttttaaataagacggacggtcaaacgttagacacggaaacccaggatttgtcttttttcccggagggagtacgagtaaactgttgtctctacttgcagcctgcagggcctgggtactgtataccatatgtgcctttgggtgtgtttggttcgcgaaaaaaaaattgtgttatacatcggatatttgaccggatatcgaaaggggttttcggacacgaatgaaaaaactaatttcataactaatctagaaactgcgagacgaatcttttaagcctaattaagccgtcattagcacatgtgggttactgcagcacttatagctaatcatggactaattaggctcaaaggattcgtctcgtgatttccatacaaactgtgcaattagtttttgtttttatttatatttaatgctctatgcatgtgttaaagattcgatgtgatttttttgagaaaacgaaataaaaaaaattatatatagctaaaatggtaactgttggaaaacgttaccctttatacgaaaatgatactcactcgatccggaattttcgtgaccattttcacacctagcagcatgccaggttatagctgccaccataatttactgccacccaaataattaaatttatagcatggttattaagttatcgattttggctatacataaattccatttattctaatttctttctacgtcgtattaatatcaacactgaatagtttaaatgataaatatggccaatgatcaatgactgatcgagtgttattttcaaagagatgcaaccgattccaaccgttttcaccccctgcatgcatattactcctagctatatcattatatccgtgtttgaaagaaattaatatcacactatgttaatttcatagtactagttgttgatatcatgttataaacaaaattagtagtctaaatataatatgtggtactccttccatattaaaactagaaaaataccccgcgcgttgcagcgggaacttatgaaaatgtaagatggcttattaactaaattacagaagaaaaatactaatgtgctaaaaataactatatatgtttttaaatatatgacacatttgactttttatatgcgtttcactactcattttattcaatttgtttgtgcaaacatattaaaatataagtcatgcttacaaaacatttaatgataaatcaagccataaaaaataaatgataactacgtaattttttaataaaacaaataaccaaacatatttaaaaagtcaacagcgtcgtatattaaaaaaaaaagtacggtctggcaattgctctttgacgtagatgctagtttgttgtgaatgtgctgcatgaatatccaaatagttgatgctctcatgctctgttctaaacattaaacatatattgactcaagattaaatatggtgcttgtatctctcagttcgatgatttgcctatagcattatctaaaaatattagacaaagcctaacacatattcatccgaagagaatgtgttatatagcaaaagcacgcaaaataacggtcactttgtactatcatttgcatcgaagtgtcagtgttaacagaatctatggaatcagacgatacatttaagaaataatatagcaacacgtggcacatatatgaatgtaatttaatactaatggcctgatttacatgttgatgcgtagacgtaattatcccaaagtgagattctagggaaagcagaaatttcatgaagccaggcaaggagttacctttagtagtcttttttccttgagaaaatcccttgtatacccatgaaaactcatccaatcccttccatgccctcgaattttactcaatctcctctgtacccctcaaatttcgctttcatcccttccatgcccctcctgttaggtttccgttagaaatggtaatcaaaccgtgtgtagtattgtcagtatttttaaaaaatgccaaaatgcccctccaaccctaagtcttatcccctttttggtcaacctacctcttatccactcgactcgagcggcctcccgcgccggcggcttgcagtagctagcgctgctgttccgtaccccttcggccggacacgccaccctcccgcctaacgcgtggtcgtccagccgtcttcttcctgccacgcgggcgtcgccctcccgccgcgcgcgtcgtcgtccagctgtcccgccgccctcccgctacgcgcgtagtcgtccagccgtcttcttcctgccgcgcgggcgtcgccctcccaccgcgcgcgccgccctccccgccgcgcacgtcgtcgtccagctgtcttcttcccgccacacgggccgccggccaccgccctccctggagcaggaggagaaaccccaaaggaagttggggatcttatcagttggggatcatctagccggtaagttaatcatcttcttttcctgttggtttgttgcacttcttattgggggtggatctaccatacctaatcgacgcgtgagtatcccaatgatctgcctctcctggagcttccttgcaagcgcttggagaccaacaacactgcctaggcctagggcactttattactaggagttcagcgacattgtccaacctctatttggaatttcccatgcattccccgcgctgtttgttgcaagcttgtgctgtttctagcatcgacaaattttggtcactcgcattgccttggcaagagcagcgctacagccagtagctgaagctaacaacagccgagacgacaagagcagcgttttttcccctaatgtgttaaactatcgaatgatttagtgctttagcgagcccttttttttaattatcatggctgctccaatagttacaccaataatggcatactctcctaggttaggcaaatttctttatttcattctacatggatttagatcagttaggtatataacaatttattttccacagtcaaaactttcatttcactgaggacaatagtacatggaacaatagctcatgttcaagtatatcaattaggtaagtaattagatcaagagacatagatcaattatgtcaatttgctggcattatgttgttctatacaatttattctcaactctcttttctagatcaagatcacttactggctctaatcaacctgagccatctaacatgttgtagccttgccatgtattggagataaaacacctaccgttgcaccaaaaaaggcgaagagcaaaacaaagggaaagccatcacgttctggtactcctgatagcccagctatgtgcacaaggagcaaaaataagagtcctgcaatgggcactaggagcaaaagaaagcttatggactaaatcatatatatggcttactgattaggttttattttggtactgccatttctcttgtggaggctgctgggttttgttgttgtgatgccctgcaaagtgctctagtcatagttgatatctcatttcgctattgtaaggattgctttctcataaaatgtccctgttatggacatactattatggaccttatgccattgtgctcctgatgtatggaatgaaaagttggtttggttcctgcactactgggtatggaaatggaattgtgtgtgcatgatatgaactgttatgtatggaaaggattttttgtatgtttctatagttatgtatgaagctattgatgctcttattgtattagaatcattttcttgtacagaggatccaatttcttctatagaggaaactcatgcatgttgcttttcctcatcctattatttttcctaaacaaaaagatatattacatttttcagtaccacaataaatttgttatacactcatttagcctcaaaatacacattgttcagtcaccatttgttttatttttttcaatctagctgtcgctcatacggaagatacacattgctcaccctattgcagaagggtattttggacatttggaaccacacttaactgccaaatgaaggaaacctaacgggaggggcatggaagggatcaaagcgaaatttgaggggtacagaggagatcgagtaaaattcgagggcatctaagggattggatgagttttcatgggcacacaagggattttctcttttcggtttgtttgaagagctcttctaaaacaggtaagatgataaagtatgtctattttatcaaataggacttgaagaaaatgagaacatggatagacctatattacgcttaccatgtctaaaacaatgcaaaattaataaacaaagagattagtagaactatcctttatgggcttttttctcatgctcgagagttcaccattcaatcttgaatcgagaagatttctgcattcatctgaagagtgttagcgaggggaaacatatcccgaaggaaaccaagattaggagtagaaaggagaacgatcggaagaggcaaaggaaaagcaagaaaagaggaaacaaatgctaccagttgattctgtgaacacatcagacattaagaagtaatcatagtgggtaataaaattggcagtttcgaaagataaagcgcttgggagacgtggaggtactcaagtagagctagatgtttttgctgcagatcctaatcagtgaaaatctaagacatccattgcaaatctaatggtcagactaatttagagtgacgtggcaagctgtgagatgagagaattagagttagcggggatgaattgtataggtatataggaaaaataaaccaggtttcgtacacacatggtgtacgtattgtagtatatcttctcaaattgcaaagtttaaggtcagcttagtagcggagccaccacccgagctcgacatttatgaattggtgataaaatttctataacaaatactactaattatattgaagtttgttcggcccaaaaaaaattctagctttgtcattgggtcaacagggttcacaatttcgataaaaactggtcgaatttcgtgaaatttcaatgttttgacacggcttgggattaagtttcgattggaatttcgaaggttaaacaatagatttgatcaaaattaagtcaaaatttatcgaaaaccgtgataatgataggactcgaaatttagtggtcaaccggtaatgtaaactctggggtcaactaaacaattaaacttgaaagacactggctggtccaagttaaagctagagtagctggcgatcccgtgagtttgcatgctcctccagccatgatccccgatccatagcaaggctagctaccaatctaatctacgagaaggaaggtgatggagagcaacgacaacgaacgaacaaagaaacagcagcacgcgtgcatggcccaacccatggcagccaccgtctcgatcgatctctgcctgccttgtgggacctcctggtcaaacaccaaagctcgacaccttcatcatcatgatttcgtgtcccagcaatgcaatgccatgcaatgcaaggagatgttttgaatcttaattttgcggttctgcttttaaaagggcataccctacattgaaatgttcgaaattataaaagggcatactctattgagagttcaagcagtacttttatatactgcacgtcttccgtgcatcaagtgtaaacaaatactccctgtcccatggaaaataaatttaaaaccgaatagaatatattctaatactacgaatctggaatctgaacatatgtatatccaaattcatagtagtaagatgtataacatctggtattaggttaattttttatgggacaactacagagagagtaagattgagtttggaaggagggattagcatattcttagttaaatgttagattaaaaaactagaaaaatatattaatataatttataaagcaaactctaaatatttttaaaaatatatataccgtttagtgattcagaaaacgagggtgtatgagttcagaaggaataaagaacacaacataaatgttcgtagcagatatacacgtgtcagatattttccaaatgaaacattatacacatgtgttcagcggttatactacttaacttgctaatggattattacggggtgtgcttcaaaatctcataaacgatgcaggtttgtgtaaagaataacaacgttggagttttttttttcaaagaacttttaaacatttttaatcaatttcccgattgtatcgatccgtttcccccctaaagtagaacaaaatttactagtatatcgtttctgcccttttcgttcctagctgtatataaaattcagtttatcttaatttctgtcatgtcagcgtcgtatcaatgccaccactaaatagttaaattcaaaaattataaaaaaatatcctaccataccaaaaacatttctacatttctgtgataagaaatataaaagaaatactagtaccatacatctcttccgaccgtttttatcctcaccctacgctattgtttgcaaaatgcaatgcatccaaaaataaatattaaaatggacatcaacctggctggaatgtcacctctcttcccagcaaccaaaaccactccactatttggaagaaaagaagacgagaagatgagagcagagcagacaaggagacgagacaggtcaactccgaccattaatgtaatcaccaaccataaccccctaatccatgaaccgcgctaacctgcatcccacccaattccagcatccatgtgatcccctgcttaattaccacccgaccaacattacccacccccataattatttaattacttctatttactcctatgtttgttactcccttcaattaaaaatataaaaaattttagttgaatagaatatataatattataaatttaaataaacatcgtatccagattcgtagtatttaggaccgaagaagtggtagaaaatggatgctcagttgattcagaaacagttgcaatcatcaccagtgatcatatcactcaaagcaagctgattaattaagccactagattatattagtttagtagtactaacagcaaggtgattagcagtgattaactaggagtagtaattaattaacagtgtgtacattcaacgcggtagctaagggtcaacgagaaattaatgtcacggtggccggagcgtgtctcccgccggcgatgtcggcgacgacgcgggtaggtagtagcagacagcaacggtcaatatgctcagaagaggtcgaaccgcgcggtggcgttcgccggcttcgtcgtcgtcggcggcggcggcgttgtcggcgccgccttgcacgactgcgaccggtgtagcggcgcggcgccggcgccggcgccggggacgacgggcgggcgcgacgaacggaggagggcgaggttgagggacttgaagaaggggtgggacttgacgtcggcggcgccgcggcgggagccgaggcgggcggcggggtccttggcgaggaggcgggcgatgaggtcgcgcgcgtcggcgtcggcgggaccgcacgagccggagccggaggggaaggcgagcgggcggcggacgatgttgcggagcgtcgcctcgtttgtagcgccggcgaacggcgtacggccgtagatgagctcgtagaggaacaccccgtacgcccaccagtccacggccgcgccatgcgcgccgccgctcgccacctcgggggccacgtactcgtgcgtccccacgaacgagcacgacctcgcatccaccggctccgccacgaaccgcggacgcggcgccgccacggcgttccgccgccgcttgaaccggaggaggtggtccgggaagcaggacgcgccaccgctggcctcgtcgtcggtgtcggtgtcgccgtcgagagacggcgaggtggtggactgcagcgagaggtcgaagtcggtgagcatgatgtggccgtcggcgcggatgaggacgttctcgggcttgaggtcgcggtagacgatgcccatcatgtggaggtactcgatggcgaggagcacctcggcggcgtagaagcgggcggaggggagcgggaagcggcgggacggcatgcggtggcggagggagtggaggtcgccgccggggcagaactccatgacggcgcaggagaagtgcggcgtggcgtcgaagtcggcgaagagggtggggaggaaggggtggtccagctgccgcaggatccgcttctccgccgccgcgcgccccagcttctgcttcctcgccaccgccctccggtccaccaccttcatccgtacatgcacgggctctccctctccggcgagctccggaggcggcacaggtacaccgtcccgatgtcgccgccgccgatgcgccgcacgagcttgaagtcccgcgggcctagcggcgccgcggaggtcgtcgaagccgcgcggatggccgcccacgcgacgtcgccggacctgtgcggccgcaacagcaccgacgcccgcggcggcgagcacgacgtcgccgccgccgccacggcggccgacggcgagcagtcgaacgacaggcgcgacaggctcgagcaccgcgcgaggctccccgtgctgctcgccgccgagctaaggctcgagttcggcgccgtcgtgtcggcgtcggaggagtacctctccatcgccgccggcgagagctccaccatctccggcttcaccggcgcgcgcaccgccgccaccatgaacgtgagcacgtgacactgtcgtcgccgtcgtcgtctacctctccggcgaaagctctccgcggcgagctcgctgtgcggtggtgaagtggcaggagcggtttcccgggcgatttataccggcggggagaggccacgtcatctgacacgtggcggtgccacgtggcggggatgagtggcagaatcgtaaatagtgtgtgccgggggaagaaggcgtgtgcgggatccgcataggctcgtgagcttgtctcctggttgggtaggggtagatccgtcattctacggcgccgtagacttttttttttactgcaacttttgtactactgctgctgtggctgtgacatcagggtgaaaaaagagaggacagtaacttttgggttttactgctgctcactggaggcaaaagtgccctgttggacgctacggtctcttttctcctctactccaatgttgtctcgtgcttctacccatcaattcccattacttagtttaaatcgatagtataattgaaaattcgataaattcgagctgaatttatgaatttcaatagtttgatggggttcacgttcagatccgttcgaacatatttgcttagtttgatcaaatctgacctatcctttggtctcacctgacatatgcttcgatataagttgagtcacgggctcacggctaacaatctgaagaaaaacatccattgtaacaaaaaaaaaatttattacatcattcgtttttttaaaatttattatcagttttatataatttgtgcttcaaaagtttttaatccattgtcgaagtttacaagcattcaaaagccaaggctagataatagactacgataaaaaaagctcctgaatcaattctacttttcaaaattcaaatcttggttactgttgataagccaccaaaaacacgcgacgagcacgagtgcactgaacaaacttcaacaaatgcttcaaaaagtagtagtaacattgagttaaggaaaaaaatacgaattaccccctcaactatcgtgatcaattaaattaaattactctcctgaatttgaaaaccagacattttatcccctcaactatacaaaccagataaataagaattaatgttgctgtggtgatataaatttatctgacataaatagttcaattcttgtggaatttcttggccttgtcacatgagtactctaccaccagtccaccactactgtgcaagccacactagtgcattttgtttttgtcatggagatgcatcatctacatgagacaatgtcaccatcctagatctgtggattgccgcacaagaccaaagttttctccgaatttcttccaagaaaccttgcatgttcagccatcgtttgcaaagagtgtagtgcgtgtactgttttcatgcagatcggacgcttgttcggtaccacaggcgacaacttgctcaattgtgctgccttcacctgtgacagaatattgcacggcctcggaccccatgtaatgttgtttccttactcatatgtgttttctagagttgttcatggaatattacatgggtgggacacgcgcacataccactacgcacgatgccaactcctttgaaatacaggagttttgttttccacctattcttcttttatgttcataaaagactgattccgaaaagaacttggcttggttttccatagagcaagaaatagtttacaacctctgatgacaaaatggctagataatttgtatgaaaatatgtagttatataatattaatatatgtatacactgtaggatccttctctacagtttttccttgaaaagaacataggagttttgtagagttatctttgaaaatagtcctttttctttcctaaaaaaaatcccatgatgttccttcagttctgaagggtccatacaaaggtccctacacgataaatctaattgtttgagatacagccgataaactatgagaaaatgaacaaagaaataaaataatttatgagtaaaactttatatttttgttattaacagtttaaaagccaatgctggtaagtggattgtgatgaacaaaaaccaaaatcaactaaagttgagttttagaatttcaattcctaccgtggctggtaattaattaagctaacaagtggacgaatggcgaatgtacgtatgtttcaattttagtgccattttcatcaaaccatgctgcatgcgcagtaactgaaactattcagacaagtataagacattgagggcttattcggattagaggaacttcacaggatttttggaggaatactgtgcatagaaaattttccctttcctatcattcgggtcataaaaactggttgtaggaaatctaaaggaaagtttcctttaatgctgttttcacaggaaaagtacaggaaaaatccatccaccttgagctcttttgtttgcttcctgcatgcaaatcataagcaatcaatttcctgtgattcgaatgctctcaacttttgtattcctttgtttttcattcctctctgtttttcatttctctgttttatacttagattccttttacattcctatactttttctatcctacgtttttcctatcctataatccgaacaagccctaaaaactgagtcaagtatgttccccatgtttggcaatgcatatggtagtactatatatacgaaaaagattcaactttcattgccatcttgacgactttcttgcatgcatagatgctcaagaacacagtatgaaccggtgtcaaggttagacgccactaattatgatcagaagttgacgaaggctgcttgatacgtaagcaaagtgattagtttatgcagtgggttggtaaccatgtcgggtagaggcgacaatgtcaacatgaccggctgtaaattaactccaattaccgaaaccacaagttggcaatggcttaattagtcaagccttttgcttatatgcaggcttactcagaggtctatgtgtcaaaaggttaaactctaagcattctcatagtaataatcaagaagaaacggagagtaagattgtgatcacgtgccacatgtgccggaccaaattattgtcggacagacatgaatagtaattaacttggagagtaattaagtaagagtaatagagtgtaattaagtaagagttagtatcttgatgctcggagaagaaaccgggatcaccatgacttttgtgttcttaacttttgggattttctgcagatatatgcaatcttacttgatagatatagtactacatggcacgcatgtatggatggatacttaatgacagagattagagctaatgatttcggtcagaattagcttttgctagcccatgcatgcatgatgtatacaaaggcagataattaatcaaagggctttgctttgctgatgtgtatgattttggtcaggattatttaactaatttgctgatgctcatgatttctccctacccgattagcacaaccccactttaatctctgttcggaaagattaagacagcttaatcagcgccactggtcctaaagctggagcaaattaagcatgcatgggccccttgcatgttctatccacgatctttctacaaataattgtaagtgcagcaactgaagtgtatttcagacaaactatttctcttccatgttgttttctcctctctttttattcaatgtgttttctgcaaattcaggtgatgctatatctgcctaaattagtagtgctacaagaactgaagtgcatttcagagttcagacatactagaactgtagtaccatttgttcttcagtgtaattcttttccttttgcaaagtgttctctgcaaattcaggtgattaactaatctgcagctatcctcttaatagaaatagtactaattttagggccattttttactgctccattttgtcattttgcagcaacaagcggcagtgccaaactgacaaagtaggactacctgcacacttaacttaaaaagatagctgttcttcagtgatcagtgcagagtgtagactagagaggatgattaaactaattaaactaacattagttggaacactcttgctgcaaatttgtctgcccaaatgccaaccaaaagtactcccaagtcgctccaagaactcacctggatttttattttctctccatcttctttaactctggaagattcttgttgtgcaaccaaagatacgacctatgtatctttcacctgattaatctatgctactactgaatatagcttggtacagttagatcatttctttaaacattaaacatatgtttagggctcgtttccttttcttaaacaaagattagagctcttaattttcaattatagtgcacaatcaccatgtggatcaaccgatcgattggctttgtctgttctttcaatttgactgctttattaatttcagggaggagatgaacacattggacaaattctagtgcagcataaaaggtaagggaatgaaaagctgctgaagatgataagaagctgcaagtgaatcagggagtatcagttggtaattattgggacctaatagtaatttaatttgctttctgagcagagcaggccgggcccatgggtcagtaggtcatcaacaagcaaaggacagaattatgcatgctggccctcatgtgtccccttgtgttctagggcttgatgaatgatcattactgttgagcaacaaattgttagtactaataattcaaaacttcatcatatactgtatgtactattactagtagcaggaaagttcagaggatacaatgactcttatgtccaagaactgaagaacctgaatttgaggtaggatgaatggccagtgattattacacttttgattagtgctcatgtggtagaagctaacagtagcatctgtaactgaattactacctctctggtaactgtagccatgattgccaatctcttgagggaggtaatcatgccatcatattcagagcatttgttttgttcacaaaagttcagagcttctttctttcttctcttccggtggcagagttcagtccagtctgttcagagaaaacccaattcagtcagtaaattaatcatcaaaatgaagctgattctacatatactgacccttaatgtagcactagcaaaaacatcgttgaaacttcattaattagcactatagttaaagcatggaccacaatgttcagtttggacaagatacaattatacaagaacatctctgaacctgcagatacaagtttcaacttccaagaactacaagtagcacactagaagtaacaattgttaacttgatttgtgttctagactccagaatctagatacagacagccagtacctgcagatcgatgcatcacatgcactgtcaacttgttctagagagcaagatcaaagcccagcttaattaaactaatcacagtgtgtgtgcatatgcatcgtcactgcatttcttggtttcaaagcccaagaaaccaggaagaatctcaagagaaaactaagctaattaaacaagaagctgattaacttgtcatcagacagacagggcgctgctcgctgaaattaaatcaatagtattaagagggggacagtggcagaggccgtatcacctaagaaccctacagccgctaagcaaagcatcgccattgtctcgagctgaactggaaccctaattaaggaacgaatcttgtgttgctcagcttgagctttctcctcttttgctgtgcttttgtttgattagattaattaattaatctgggtgtttcaggacacattcagagcgagcttgcttgcttgcctggccagctattgacatgctcacatgggtgacactaatattagttagggcaagtactcctatatggattatagtattgtttatttatgtttaatttttcacatgagcctatataacaatgtgctgtttcttttgaaaatataaatgtaaacaatggttgcatgcatggctggaacactagtacactgaaaatatactatagtacaatataaaaaatgtgtatagattactgaatattcttataatattcagagaaggatgatgttgcattagtggccacattatggccgtgattatgttatgttaagagtgatgcagtactagctagagggcattattaatttaatttaattaaagaggtggagtactaagctgagtgtttattaatttgagacaggcacgtagctaggtgtgcactgtcaaaaaattgcagcattcgacggcgaaaaacatggatgcgtggatgcttgctagtacttgatcagtaattagtaaatcaattcaatttccaagagagtcgataaataaaaaaaatcagcttctttggatcctaatcccggtttaaagaaataaaccatgaaattgaattaaaatcctaactctggattgaccaggatttcggccatacaatgattcctgagatggtaaaatttaattatttatcagatactgtactcaaagagatgaacacagtacattggtctaaaagtctccaagggttaaaaactttggacgctgggaacctatgggccttgtagagtaatcctactcgacaagccatggattttcaaggcccaagcatgttcacggcctcttgggcctcatctcttagggcctaatattttggaagcccaaaatcctggagaaggctactttgggtaagtttaatgggtgaatgtccacgtgcatcctgcgtgaacacgtttggtccaccatgagacgatggtctccaaagattatacttctacgtagaaactttatacataaaactttatatataaaaactttatatactttacataagaaaatctgaatctgaattactatcacgtataaactttcagtatgtaaacttaccaagcagtgccaaaaaaaaaaggaaagtgtagggtattcttgcgagttcgccgtgtgcgaacgttcgcgaatcagtccttttgggttagtttgcgcatgctcgcggacgcgcttagtgtcacgattaattatatatatgttcatcactttctatagtaaaacaataaatgggtatttgagttgaaaatttcaaagtttgagtagagttcttaaattttttgttgaaaaaggttgtattacaatgtttcactgaaatttaaaagataatcataaaatgacagcgaaatcataccaaaaaaatttcaaaactatcccaataaactttcaaatataaattttagataacttcaatatattctaaatcacttataatagagaaaaaaaataaagaaacattcgtttcatacatttgtatggcatgtaattaatccccaacagttggcgacgagaacggatgatcgaacgaggggcaacagtgatgatagagctagaggagagagaggtggacggcaatcggcactatgatgagcgaagtttggcgaggaggacaacgacgaccagcggcaatgagaaggacaaaatgcggtgcaatgcgtgaatgaacagtgaagggatgcaccgatttggttagtcaagaaaacatctgcaaatatatactccctccgtcccaaaatatttgacgtcgttgacttttttaaaaatgtttgaccgttcgtcttattaaaaaaatttaggtaattattaattcttttcctatcatttgatttattgttaaatatacttttatgtatgcatatagttttacacatttcataaaaatttttaaataagacgaacggtcgaatatgtttaaaaaagtcaatggcttcaaacatttaggaaaaaagagagtatatataaacaagtgcttaataaaatacagttactactcaacaaatgcccaggatgattggttagtcaagtctagtccagtttctagcctatgctggtcaagaaaaacaaataacctgtactccctgcctgcgtctagatggaataatgtcatcatatgagtcctgtaattagataaaataatgacgagatcagtcaagttaaacaccaaaccccaagaaagttcggtgtatgtacgtgtgtcgtacgttgacttggtctaccccgccccatactgcaagcatgcacaattattgcacacatgcataagaaactttttttttatctctcgaggatgtctcttagatatttacatatcacttaaataattataaaaaattaagaatatatattaacatgcgatatatcactatataaatatacaagttcaaatttaacttctacatctcgtaataaaaaaaaccaaattaaactacaactagttaacgtatatttataattaaatttgttttttcgttgcaagatgtataagttaattaaatttaaatttgtatatttgtggaatgatatatcacataataatatatcttcttaatttttttattactattcaaacgacttgcaaacactactctcgaggatcaaaatccactccccacatgcacctgcatctactgccagagaagagacgacgtcgagccctatatatgcatggtggagtatgggtgtaccgagtcatcttacactcttaagcatcgacgacgacatggccgccggcgacaagggtagcctcctcgccggcttcgccacctttctccagctcatctgtggcggcggcggcggtggcgaggactatcagctgccgatcgatcacaaccatcccgaccacaaagccgacatcctcatgtacggggacatggtggaggccgcctacaaggccttcgccggcgacgacgacgagaaggaggttcactactacggcggcggcggctacttgtacttggccaccaccaacctttacgccaccatcgacgccgtcccggcgccgctcgaggcggcgctccccgtcctccgcggcgtcgacaatccctactggttcggttacgtcgccgccgcgtggcgcggcggctactgggacgtcgtcgtcccgtggcgcggctccgtgaacgtcgccgactggtcgatgaacatccagttccccctcgtgccgttcaagccgtacacgtcgaaggataaggggatcggatgcggcgccgccgccgccgctgccgccggcgaggtggagaagggcttccacaaggtgtacgcgtccaaggacaaggccgggaagggtcagcgcggcgagctcagcgcacaggagcaggtcgtcgaggaggtgaggcgattggtcggccatttccggcgagaagatcccggcgtcggcgtccgcgtgaccatggcggggcacagcctcggcggcgcgctcgccctgatggccgcgcacgacgtcgcggcggcgctggccgacgacgacgtccccgtccgcgccgtgaccttcggcgcgccgcgcgtcggcgacggggcgttccgcgacgccctgatcaagggccgccacgtcgacgtggtgtccctcgtcgtcaagcaggacttggtgccgcggctgccgccgggccaccggtacgtgcaggtcaccgagaaagtcgtcgagctcgtcgtcgacgacgccgccgtcgccatgtcgctgtcggcgtcgcacagcctggaacagtacctgcacctgttcaggcgcctgtgcgacgacgacgggcaagccttcgcggcgccccatgacggcggcgaggtggcgccggagaagaagaacaagtggccggagatggaggaggaggctgacggctacaagcggctgccgctgtccgagctggacaagctcatcaccaaataaaggcttgaagctccaattttcccaggaaattaactgaactatttctacgtaccaggctcacacaagatatgttatcctgcgtgtgctttctccggttaaaatcatatgtgtttaagaaactatatcttgttaacttagtgaaactctgttcatcccttatggagatatcctatgcattgtttttacttacttaaaacatcaccttttattttaaaaaaaatagcaagatagattaatgtcactccacaaatatatatgtttaaatttaacttatacaaataaaaaataagaatatgaatatgaatagaacacgtaatttgcagtcttttttttattgttgttctaattgtataagtcacatttgaacttgtatgtttatagaataatatatcacatattgattgttagaagtataatatgttagttagagataagagtcaaatacaaatatagagataagatatatcttagagatagaatcctagagataagatagagtcctaaagatagaatcctagagataaatctactattacttgtattgtactccaagtctctatccctatatactcctatatataccacatgagagggtcgatgcaatacatggagaaaataccaaaatataacatattagattttccatatggtatcagagccttagagaccaacgtcgttcgatccccgcgtcgccctggggagatgatatcaatcctataatttccctggggcgccgcatcaattagccactacagattatccatagatcgattcttctattagatacaccaaataaacacgacgacgattttgtcgtcgctcaccagcatcatcaagcagaagacgaggccgtcgcgtacggcaccaccgtccaagtccttgtattgaagcccgagcgacggcaacaccaggacgcatctactcaggaaggagcttgcggcctgacagttcccggccgggatgaccagcctcagcacggtgacaaggaggcatacatgcatgcatactgtacacgcgcacatgcacgtacagatcgtttaaaccaatcaaagtgctggccatgcgccatcccgtgccgagtcctccgtgccgatggtcttcaccgagctctcctgctgccgtcagttgactctcctctatttcctcccgcagtcatagcgggagtgtcatggacgatagcgatgacacggacgttttaactggagttgccgtagatgattcttgttatagacgttcgtcgatgtagccgatcatgtagtagccgtagtcgcggtagttgatgtagccgcaaatagccgaaggcgaaaaaaaaatacttacgccatggtgtgaagacgaaactggaattgttagcatcttgcaccttgtagatgttagaggatgccattggagacgtcttgcatatgtcagaggacgtcgttggcaatgaggccaccattttggctggtcctttcgcgccgtgtagcggtcatcacaatagtgacgccgagttgatgcagtcgttatcgtcgtagatgacgtgatcgatgctgccgtcagtgtcgcggtcgttgtcgttgtagaggacgcggtcgatgtcatcgatgaagcatcttgcagattaatccgtcagaggacgcgaggtgtccatctatgtggacgagtcggcggcggcgtgtgtttccatgttgatgaagaccatcggtgatgttgtgtcggagaaaacgaacgtgtgttgatgttgcttacgacagcaggagagctcggtgaagaccatcggcacggaggactcggcacgggatggcgcatggccagcactttgattggtttaaacgatctgtacgtgcatgtgcgcgtgtacagtatgcatgcatgtatgcctccttgtcaccgtgctgaggctggtcatcccggtcgggaaccgtcaggccacaagcttcatctgttgccagcgtccccttctgtgtcgtcccttaactctcctctattttaatctcttaccaaattctttgatgactttttaaacgatatgcacaaaacgaggggacatcttattttgttgccagttgttttataatagttggatgtaatttttttccatgtgtcactttggtaagtggatttgatcttaactcaacagttgttgcattgttagatcttttctggtaaaatcattttgtttttcaaattaatggaactggcaaagttagtgcaaagcaactatataagacatataaatgtatactcttctatattgttagcacatgggaatatcttttgtgggaaaggtgtcgtgcagtttcgaaggttcgtctattcatggacctaatccattcaaaaggcccatgcatgcgtgcatggtccaaccaagagttcaaaaagatgcggagttctatgggccttaatccacaaacctaggccatttttcttcgacctaagtgcctaaccatcctttggacttcatcttttttttaagataatagaatagtaattcatcccggcctttgctcaaacgagttacagccaattattacacgaaatcactcaaaacgagtacaacttaaagagaacttaaaaaaaaactcttccaaacataaagcgaacacaaactcgtaaacgccaacacaagataaagagtgttggcaactttttgtgacaagttgacaagcacgatcgcagcacctaacgctttgcggtaatagtagagtcgtcaaccaccctaatctagtaagcactagatcaagatgggttttgataaactaaaccggctagcggagccgatctagatgaaaccgtagataactacctgtctcgtgggcaaaacggaaggttttcaggacaaacctacaaagaggtgtcgcactctcgcagcggcggcggatgatttacggcgcaaatcgacaaagatggacaaactaaactagaactagaagcaatatgaaaaaagattctattgattgattctgacctactaaagcttttctaaaagaaacnnnnnnnnnnnnnnnnnnnnnnnnnnnngcaattgaagaatttctccttcgaactatagcatataaagacggatacctgtctttactagtatttgacaagccaaaaatcaagggttgtctacagcctacaagtatgagcaaggaaatgaaaattccacttttgcccctcaactatgagttaataaacttcatttgcaccttcaaacacaaaattaggtatggaacttccccaacttataataccaatgcaaatcaagtaccttggcagcattgaggggtattagtttactcagcgtctatgtggcttgttgaccccaatggtgccttaaactagcttgatttgtaccgattttgacaattaagacagttggggccttggggatgcttttgtacctatttttttcggttgagaaatgtgaatgaaactcgatccatatatagtgacataaagtggacttcttattgcaagaaaattagacacttaaacaaggccttatatatacgagtaaactgagtcttgtgacacacacctacttgttgactcaactactttcgccctgccattcggataaaacaattttgaattttaaagttttatatttagaaataattgtaggtagagttttccctcatcttcttagcaatcatgaaaagtgaaccatgcaaaggaagtgactaagaatgtctctaaaattaatcctaattaatatattaaatttttaaaaaatcaaaatcagtttagccaacaggtgcattggttccaaggttgttaggatcgggatactaggtagtatcgttttgctcaaagtagtatcgtatcgtagtatcaggatactatgagattttattttttaagtttaattaatatttatattaattacatatagccagtctatataaaaatgcagtaataatatatgtcatgcaaatagagacatttatcaagagaaaccacgttggtttggatatatttaactgatttttatataaacttaagcatatttatttacattatttttaaaccatcttattttaaataatattttgtagtatcgtatgaatcatagaatcgggatactacctaagatttcgtaggatcatgtagtaattgtagtaatgaatagtaggatcgagatactatgaaaattaggatactagatacgatcggtatcatttcgacttggtaggatcatagtatcgtaagatactaggatacgaatcgggatactgacaaccttgattggttattccagcactcgtttcattaattcgtcaacagtgtcgtcaccatatgatcgttccattctgatatatagtgacgt

SEQ ID NO: 35869 - DNA, 436 bp, Oryza sativa
ggctccggtctccctcccatccgtgcaccacgctctctgggagtgagggctggtcgagggggtgccgagccatctcgtggtgcaccgcgcgcccgccagctcaacttcggcgcggcaggtggccgtgctgaacacggtgaaaatggtgggtcgtcgtcgggcattgtcggcgccggccttgggtgaggtagctcctcatcaggggcaacgggtcgccgtcggcaacgcgccatggcaaccaaccgtggccgcgaccgcgaacgtgggggccgcggttggtgtgcgtcgaggagtgtcggcacccaggaagcacccatcggcgattacgtcgaccttgacgaagaaggtgcatgggacgatgaggtggaggaattaggcagcttcggcggccctccggtgagcacttctgaccgagctaactggactgatagttata

SEQ ID NO: 35870 - DNA, 540 bp, Oryza sativa
tgcacgggctctccctctccggcgagctccggaggcggcacaggtacaccgtcccgatgtcgccgccgccgatgcgccgcacgagcttgaagtcccgcgggcctagcggcgccgcggaggtcgtcgaagccgcgcggatggccgcccacgcgacgtcgccggacctgtgcggccgcaacagcaccgacgcccgcggcggcgagcacgacgtcgccgccgccgccacggcggccgacggcgagcagtcgaacgacaggcgcgacaggctcgagcaccgcgcgaggctccccgtgctgctcgccgccgagctaaggctcgagttcggcgccgtcgtgtcggcgtcggaggagtacctctccatcgccgccggcgagagctccaccatcttcggctttaccggggcgcgcaccgccgcaccatgaacgtgagcacgtgacactgtcgtcggccgtcgtcgtctacctcttcggcgaaagctcttcgcggcgagctcgctgtgccgtggtgaagtggcaggagcggtttcccgggcgatttata

SEQ ID NO: 35871 - DNA, 1274 bp, Oryza sativa
acatccaccacaaggtaaagtaatgcaacttttgtttcaaatctttccatcattttaacttgtacctatatgcctcattgtgtgtttgtatatgcagggaagtactatgtggttgatgcggggtacctaaactgcccgggctacctttcaccgtatagatgcactaggtatcatgtggagcaatggaaaaacggcccccgccacaaggtatgaaagaaacctttaaccatgcacattcccggattaggaatgtcatagagcggtcttttggtgtgttgaagatgaagtggaggatgttgttggacatgccatcgttttcggaaaaaaaacaaactagaataattgttgcttgcatggttcttcacaatttcattcgagagagcaaaattagggatagggaatttgctaggtgtgatgcggatgcagattattttccaatgcctacatcacctcactctgactggtcagaagatgaacctcttgttgaggatagcaacatgaatttcttccgcgatgacttggcaaatgctttgtttaatggattgtaatttttttttacggtttgaggactttaatatttatgtgagataattgttgtatggactttaatatttatgtgagacaattgttgtatggactttaatatttatgtgagacaattgttttatgtaattgtatatttatgtgagacgattgttgtatggaattgtatcttttatgtgacatgattgttttacatacttgcttatatatttgagacaaattatgtgtttgggcttgtaaggaattgtgtatgcttgtatgtgcctgtattggattagccatagaagatccggctgctgtatacttttagtggaggcaaatgattgggatggtacaataatagctaaatagcctttggatccaaacagcaagagggctattttggtagggggctattttggtgggataatctttaacccaaaaaatatccctgggatagttctccaaataggccctatatatacagaacaactacagtagctttactaaacgtttttctccagacatacctaaattttacgctaaattttttttatcttgacatacttagtacctaaagatactaaattttatactagaaaatataatacctcttggtatgataaaattaattatcctattcctatgcatgagcgctcaatatgaaggttaactaaaagtaattaactgaacaatataatgaagattcctttgcacgagctagcgatcgatggtcgatcggaaggcacgtt

SEQ ID NO: 35872 - DNA, 33932 bp, Oryza sativa
  unsure (1)..(33932): unsure at all n locations
aaagtttttatgttttttctacaaatcaaagagacatgcttcttaatttgagtcttttttttggataataataggtgataaaaatagacgcttgtttgagcctatttggctatggcttgtttgagcgttttagttgcagcttaattataagctaaaggattcattacgtaacaaaaattaaaaatgtaacttgtataccacgtattcttagaggttttaaaccaaaagttccatgatgagttaaaaccatgtaaaaaattaatggattaattataattcaaaattattttctactagggcaaaagttatagatccaatccaaagaaggccttaattaatatatacttacttcgatacttgcaacacatgatggaagtcttccattagagccagcgaggagatacctgatcgacctcttaattagcacacacaaaggcgcgcatatatttactacttctctccgtagatatatatcatacgcctattaatataccatgatgactaattaactaataattatataaaattaaggtccttcacctaacactttgtaagagcaccatcaacaggtcactcaaatactaaatcccaaaattccatttaagaatttctaatatgcattttggattttagaaaaaaaactttaatccaatagactgcctagaatattaactctctaagacaaaacaagtgaggttactccgatcatctattagagcaggtacaatagcatgctataaaccaaccataataaacatatttaaaggagataaaagatgtagtcagccataataaacatatttaaatgagataaaagatatagcacggactacaagaaccataataaacatatttaaaggagataaaagatgtagcacatctattagagcaggtacaatagcatgctataaaccaaccataataaacatatttaagggagataaaagatgtagtcagccataataaacatatttaaatgagataaaagatgtagcacggactacaagaaccataataaacatatttaaaggagataaaagatgtagcacggactacaagatgtatgtgttgtatgtgtgctgtaacaggcctctctctagaactatgtagccaaggagataaaagatgtagcactgtaacaggcctctctctagaactatgtagccaaggagataaaagatgtagcacggactacaagatgcatgtgtgatgtaacactctctctagaactatgtagccaaggagtgtagccaaggagataaaagatgtagcactgtaacaggcctctctctagaactatgtagccaaggagataaaagatgtagcacggactacaagatgcatgtgtgatgtaacactctctctagaactatgtagccaaaagatgtagcacggactacaagatgcatgtgtgatgtaacactctctctagaactatgtagccaaggagtgtagccaaggagataaaagatgtagcactggaacaggcctctctctagaactatgtagccaaggagataaaagatgtagcacggactacaagatgcatgtgtgatgtaacactctctctagaactatgtagccaaggagataaaagatgtagcactgtaacaggcctctctctagaactatgtagcaaaggagataaaagatgtagcacagactacaagatgcatgtgtgatgtaacagacctccctccagaactgtgtagccagcccatctaacgggctctgacaggtggacccacttacacacaccaccctgtttacactttcgtcttcgcttcgtgtaaaagagttaacctgtgagtgacatggttggagggatgaggccttataaattggttccacccttactagactagcaaggtggtactaaacatgcgcacacagtttacatgggccacacatgcctcattctaattgggccaggatgtcatatatatgtgtatgagaggtgggagcaggtattgattgtgtactatatgtttataggtaattattgtatgaattggctataaaattgactatagatgatttgaagctggtagttggctatactattaaacttgctcttaggagttgctgcaagctcccgagctgtggggagtatggatatgaaatttataaattttggacaattaattaggaattgttgagatttgtttgaggggacagtgcatcataccacagttgttaggtaggtgtttgtttctctgccacaccttactaacttaggcttaccatactttcttatactttgggctcacaaatcattcactcttttatttttcaaaccacatgccacgtactgcacatttgtggcttactaattcatgactgcacttttatatcatattgtcatgccacactttagctaataaggttagttgtggcaaagttagttactgcaaccaaacagccgctaagtgcttattagctccctatatatatctctattgcggtgtggcatcatatcacacgcaaaactaattaagatcgagattgtccgtcccagcgtacctcgacatggtcggcggtgagcagagccaaatccaaggcaacggcggaaatggctgcagcggtaaggtggtacatcagcggcgcctagtgatcaacctcgaggataagaaccaccgggccgatctcctcaggtacgcggtcatggtggacgccgcctacaagacgttcgatgaggtgaagaagcaccccggcgagtcctacgagaccgtcttgtccagccgcctcgccaccaatgctgggtacgtcgtcaccgcccacctctacgccaccgtcgagccactaccactcccgccatgggttgtcgactcgttgccggccgccatcgccggcctgaacaagccgtactggttcggctacatcgccgtcggcgccggcaagcagcagggcgacgactgctgggacgacatcgtcgtcgtgctgcgcggctcggcgacggtcgccgacttcatgatggacatccatgtcgaacgcgtggcgttccaagggttggacggcgaacccgccggcggtgaggtagccgaggggttccacaaggtgtacaggtccaacgacgcggacaaggagcacggcgagctcagcgtgcagcagcaggtcgtcgaggaggtgaagcggctggcgaggcatctccgccggaagcagcagcagcccggaaaactgatccgcgtcaccatcaccggccacagcctcggcggcgcgctcgccctgatggcggcgcacgacgccgcggtggcgctggcagacgaggaccgccaccgccgcagcagcgagccgttgatcggagtccgagccgtgacgttcggcgcgccgcgcgtcggcgacgacgcgttccacggcgccctcgccgcgcgccgcgtccaagtgtcccgcgtcgtcgtcaaacaggacatagtgcccaagctgccggcgaacaatgtgcttgacggcgactacaacatcgagctcgacgaccatgatgccagcaagtcgccgcgggagctgatcaaggcacacagcctggacatgtacatgcacctcatcctgatgaccttgccgaacaccgactactactccaccatgttcaagatcaacgagaccagtaccgatcaggcgccggaggcggatggcgaggccgacgacaagcccaagtggatcaaaatgcgagaagacaatggtgacggcttcatgcgtctgccagtctcagatctggacgacgctttattatagactgtcggtactggtagcaatttttaaactttggctttttaaaatgggacaccttcttcttttatataaaatatgtcgacaacggcccgacggtttgaaaaaaaaacttttttccaaactttggccatatatatgcttccaccgattcacctgcaaaaagtactgatctatttttcatgctttcatactatttttattacccggcctctcaatcataatggcgcatatcgctatttaaaatgtacttttatatgatttccggtgatgttatcttttttcgagcgaataatttccagtgatgttttctgtaataaagttaaatgtgaccataccatgtcaatgacagtctgacaataaaattgcatgcatttctcagtggctgaagattaaccatttcccttgctaacagacacagaagaatagaagaatatattaatgttctcattacccatttcccctcagagaaatgcatttctagatatatattatccaacactgttaatgccaaccagaatcctgatctcaaagtgtaccacgcctaatcttaaatttcacagttgggagtcatcgacaagtgttcctacaaccatttggccagttaacaaaagaattgcgcaataaatgaagtggtttagttccttttttacgagttacatgttccccatgatcgacgctgcaagaccaacatatatagctgcaggcaagacgcttccgaaacagcttcaactgtcaaggagatgtttttataaaatttagtcatctacgttagttcatgattgtagctacctatcaaggagatgttcttttaccttcaggcgatgtcccctcattcttagttgtcatccgaataattatatttttttaaaagaaaatcacaatatagattaatatgtaatatatcacttcataaaatgtaagtataaattcaattcagctattcagttaattaaaaaaagaaacgaatgtgattataaatagtgcatgtactagttcagcttttttttcaacttatcgtaggacatatttaaacttacatatgatgatatatcaatttttttatctaagttgtcaatttctttcaaaagcttttaatatataacagtttggatttcataccagaaatgagggtgtaaaatcaaagcgttttttattgttattctgtgatgaacaattgacatctgtgtttattggttttgatatttggagattattggcgaagtggttttggagatgactgattttttcaggtgataaacagggttactgtttcttgtcaggtccggtcagaccaggcagtggttgcctgtcagaccggcgctatgcgagcggtcagaccggtttagcccacggtctgaccggccgactctgtgtcggttttagtttcagtttgtttgtttggatatccgtgattgtttcgggtttatgacttctagatggatactatgtgtatgtaatactgttgtttgctactaatgagtcaagttggagatagcttggtctcggaatatggtttctttgtttgattcatgtgtaggtgacttgatgcctcgggagagtattgccggtgatggatcgggagttgacttggggataaggcgacgtccgtgacggtcagatatcatatgggatacttaggctagagttcaatgcacgtggttggtgaagattccatatagcatacgatggaggtattgtgtgccccgagtttgtaaagtttgtttcttgtacggaaaggtttcctaggtggattagaacttctagtatgagtttggttcgtggctttaggctgcctacctcatgtataaatagagagggagcgtgaggtttcccggtatcgcttttgagagcattgagttgtgagtttagttagggtttcgagtttagtcgagattttcgtgaggagtgctgttgttgcactttgtaaacacagagagaagtaaaaaagttgtcatctactttgagagttcttcgatttatgttttctcgagttcggcggtctaaccggcgaaacaccggcgatcagactggcggcattgcggcggtcagaccggcggcagctatacaagcgacatcggttgatctcgcggtttgaccgaaggttcaacctcggtcagacggtggtatccatgcggtcagaccggtgcgactacttcggtcagactacgatccgtcaaatttgagggtaacttttaattccgcaaaaagtttgggtttttgggtataccaaccattcatccctctctaattggcttagttcttgtgtttttatcctacaaagggtacatccccttgatcattcatgattttccactatcatgaatatccgtgtttagttattcttaatctgattcaccgttacttgatcaaccttgatagctcacacgcatgtacattgtgtccatgcatggtgatgacttacaatatttatataaataggcatggtacggtggactgtttggccagacagtttcaactatatataccttagaaaagaagcggaacgggttacaatgctcttacaaaataaattagaaaagtggaattgatttcaggttactttactccatatctaactcttaaattaaatttagaagttaaacccctgccacctggtcttaagatggtcactggataccaaaccaaacccaaccaatatgagtacttaacttagtatgtgagttaaactttggcttggtatgctccttttatgttggacctatgcttaatgggacaattagttcttaccactattttaacttgtaattttaccctcattcttgaactgcaatttgtgtttgcccactcctatttcgatcagacttcacggtgttaaaactcatctatatatgtctttgcagatttaccactacttccctaagaactttgtgactttgcccttgttttgacattaaaaattttgagatgaactttggccctactttaatagcaatattcacttattcaagataaggacaagtataagcttgacatgaactttgcccctgttttaacatgaattttaacaccattaaattcccctaatgcaataagggcaagtacaagcttcgtcaaaatcataaagttggaaaaacatgaggaaaatcataatttgaattcaaaacatgataataacgcaaataccccatgcttaatttgctccgaatttaggcttcgtttagttcagcttatcagttgattagctagtaaatgaatataaggatcaattaaatatataaattataaagttaacaaataggttagaaaaaagttatctgcgcaatgctgatgaatttttttttttgaagaaatcgtaattataaaagcatgacacagataatagatatgcctccattagttaaaaagaaaggttattgtttagttattagttaattcatgatttttcttgaggaaaagttaattgacaattgaattaattaagggaatatcttcaaaaaaaaactgccacaagttttttttagtcaaaaattttcaaatgtaactatagtataattgaaatataattacattataactatattgtaactacacttcctgacccaatatgcatactcacatctctagcaatggtggcaatgtatataagatccccataaaaaatgtggctacatctaatcaatggactagtggtttcaaaacaaccaaattatttcccaaccattaccactagctcggtagttgcattggatcttgccaagaaagcatattttgcaccttggaagattaaataggaagacaggaaaaagtgactacgaattcctctttttgtttgtgaatccctgtttgtatcctttgagcgatattagataagtatagaaaaatcaatttaaaactgcaagtgcatgtgcacctacaccctttatcattattttctttaagatatatgtatgtaagtatagatttcaataaagtttaattatcattatattcctctttttgatatagcatgaatcacaataaagcatccaatgactcggtatgtaatgtaggtgcatatgcattgcgttgtaaaaatcttcttctaataagtagaacataattttatattactacaacaaatgcaaatggcagtgtgagagcatcaactcacgattgccctgtcatcacaaattttcaatatgaagattccttgtgcatgagttcatatatacacatcccgaaatgcttttttatatccaatggatggtttccattttagtaaagtacatgggcatgcataaaaaaataagattaggatgttaataattagggtcgtcaaacatccttagccaatcaacacaacttatagatgagacaacatctaagttggggaacaagacagagtagatcactagggaaataatttcaacaatattcccaacataaacagagagtcataacctctggctgcctccgccaacccagcaagcaccacgccacgcgaaggggagaaaaaattaaaatcacaggagtagaaaaaatagagaagcatgtagaaatgtggacgagaaacaaaagattaaaaaacataaaaaaactgaaaaaaaaacaatcgttcggatagggcataagaaaaactcatgaatcttgattctttattagaaggtataacgtggtagcatatgttatctatttttttgtgcttagagcacctcaagtataatgctaaaaatcgaactatgcgtaagaaaaaccgaactgaccacacagtgagaaagctctaagctagctgcatccgaataatgatgaactaatgcatgcatggttccatatactccctccatcccaaaatgtttgatgccgttgactttttaaaaatgtttgaccgttcgtcttattcaaaaaatttaagtaattattaattctttttctatcatttgatttattgttaaatatatttttatgtacacatatagttttacacatttcacaaaattttttgaataagacgaacggtcaaacatattttaaaaagtcaacagtgtcaaacatttagggaaggagggagtatataattatatattcttctccatcttatccattccaatgacaaattgacaatgaatctcagatccacatgtatatatgcacgaaaaaactatacacacatgtggttgtgtccagtgcggagccagggatgcagccgtccacctaattctgggatgttgatgagtggatcttgccaggagtaagcctgaaattagaacggttagataagaagaaataggtactagtaagtactattacttaatccaacaaatgcatgtgatgacgactgattaatcaattataagtcaatacaatgttacttaaaaaaagaacaacaatcgatttttcactagatacatgcatgtgctaggcagcttaattacacatggaacatgctaacatttttttaggcaaaaatctaaatagtgtgtaggcgatgttttgcttaactattgcacggttttttcagttaatggttttgacaacctatatcaaggtaatatttttatgatccaattatatcactatattcattacaattaaatatttataacatgatctgatctcatatgattatattccgatgaaagaatttctagaaaaaagtataatggtgaaagaatttacttttatcatatatgtaaattagttttggaattgaattaattacttcttagacatttatgaaaataacttcaataaaacttaaaagtaatttatacaattttaaaagtaacttaacaaaaaaaagttataacggcaataaaagtaaatcctttgtgggattaatagtatactcacacggagaacgaagaagtggccgttctgatgctgattaaaatttagcctaaagacttaatgatcactatcatgtactcaacaacaaaagtaggagatgtataccatttttattattaaaaaaaactccattactttatactcgctccatttcatattataagtcgtttgacttttttcttagttataactactttacgtttgatcgagtttgtagaaaataatagactaatattttcaatacaaaacaaacatattatcaaaatatatttaacactaaatttaatgaaactaatttggtgttgtagatgtttctattttttctataaacttgatcaaacctaaagaactttaacttaaaaacaatcaaacaaaacggagggagtactttagcaaggtcggaccggctatatataatgcatgctgcattgcagtgtgtttacacacacactccaagcctttgccttgcgttgccatgggcagcgtcaaccagagcagcctcctccatggcatggcgggaaagctcagggcctctttggttgccgccaaatgcagcaatcgattcgttcgtttgcctgcagcagcagcagcagtcgactctgctcatcacacgagatcaagatttctttcgtcgcaggttgccacgagtaaggtgtacgagcatccatcatcatcatggcgaaagccggccaggacgtcgaggatgatctcctccgccatggccgccggcgccgacgacggcgacagagacgagctcctcggctacgggctcatggtggacgccgcctacctgacctacgacgccgtcacgaagcagcagcccggcggcggcgagcgctacgaagccgtcttgtccggcgagctcgacaagctcatcgccaccgccgatgccagccgccgccgccgccggcacgtcgtcaccgcccacttcttcgccaccattgagccgctccaggcggtgctcgacgctctgcccgtcgtcggcggcgtggacaagacgtactggttcggctacgtcgccgtcgccaggcgcggcgactgctgggacgtcgtcgtcgcgtggcgcggctcgtcgacgctcgccgactggatgatggacatgcatgtcatgaatctcgtcgacttcggcggcggcgccggcaccgccggccatgtggcggaggggttctacaacgtgtacacgtccaaggacgtgaaggtgaagcacggcacggtcagcgccaaggagcaggccgtcatggaggtgaagcggctggtagaccatctccgacggcgttccggcgccgccggcgagaagcccgtcaaggtgcgggtgaccgtgacggggcacagcctcggcggcgcggtggccgtgatgaccgcccacgacgtcgcggcggcgctggccgccgacgccgacgccgagggcgttcgtgtccgcgccgtgacgttcggcgcgccgcgcgtcggcgacgacgcgttccgccgcgccgtcgccgcgcgcggcgtggaggtgttccgcgtcatcgtcaagcaggacatcgtgccgaagctgccgatggggaaggagtacgtcgacgccagcgacggcgactacgacatcatcaagctcgacgacggcggcaactggttgtcgccgctggagctgatcagggcgcacagcctgaacctgtacctgcaactcatcaccctgcgtaaccccgccatcacttccgtgctcagcaattcgaacagcgatgcgccgccgccgccgccggcggtgagagaggagtgggtgaatatgaaggaggaggagggatacatgcggctgccgctggagaagctagaagaggagctggacaagctagagggcccaagcccaagaaagtgaccaaagtttgaagcccatgactgaaatttccctaacttgggccatgcttcgaacgacttctgcagaaactattacttttgtaatttgtatttgcgttcatcctattttgtttactcctcctgttttgtttaatctccagataaataaaatggcatatatcgctgtttaaatatttgcatttaaatggtttgtagtgatctttttccataataacgttataaattccagcatcacgtcagtgacaatctgacgacaagatgtttacacgacagaacaagaaaatggatatgggttgtacaaaataaatcattgcatttctcaatggctgcaaaattaacaatcttccttgataacagatagaagtatatagaagaattagtttttttttctgaatacaagttaatttctcattcccctccgacaaacgcatttctagatctatccaacactgttaatgctaaccagaaacctgatctgaaatagtctacgcctaatctccagaaatttcaagttgggagtcatcgacaagtgttcctacaaccatttggccaggaaacaaaagaattgcacaataaagtgggttagtccctattttacgagttacatgttccccaggatcgacgctgcaaaaccaacataaatagcaggcaagacgtgttcttctgaaacagcttcaactaaatatatattcatggtatctgcaccatccacataaagtaagtattagacagttgggtgtgatgaaaattcaaagaaagtgaacactgatttgcaaattgcaaaatgttgccgtcaaacatagtagattgattttcatatggcagttgatattatgtatgtatgtatgtatgtatgtatgtattacaacaacagctctgtcatacgcttgaatatttcaagaacagataactaaagatttgcaaatgatgctggatgttttgcaaagaaacaacattaagcatgcagtgtgctgcaagaaagtatttttatgatacattactacatttctgcatcaaagtcttcctctgttatgatctaaacagaaagcagcattgatttctttctctttctagaatagcatcaggtaaattgaagatggtctacaactctacagttacagtatggtttgccactttatcgtgtgaaaaggaagacagaaatttgtcgaggtccaaaattgacttcccacaaagaaaaaatcagggcaaatacatctacacataattactttactatgatgtggataataaatacaaaatgagactattgtttagggagccaagcaaaaggcagtatgtcttattctcttcattgactaatacttcgaattatttattaattaatcatttaatatttaaaaaaagtagatattctgcctgacacattactaaatttgttggtgttaattcacttctttttcatagattggcaagattgttgttcatgcatccacaacccatcactagatctatgggaagtacagaagatatttgaatgctgcaaacaaaaaaagttcaagtagcactaaccactactgcggtgggttttgatgacagaaaccttctgagcctcctttttaaggacatatgacatggattgacaatcgaactaaggaaagtgtagctaactaagtccattccctgtgtcatctgttctggaactcttgtgctgacatacacaagccatgttaacaaacaaaaacgaattactctatgaggaaatttgcaataccagcaaggatcataatggctgtgtgtgctaccttacttttcttgtgcttatgcacatcggctgaatcctccattccctcatgcttccttttctgaaagatgtccaaagcccagcatatggaaagatggttagctatagaagttttcaacatacgaaatttcctacattaaatggacaaaccttctcatgatgtttctttgaatgatcgccaccagaatcatgatgcccacttttatcctttttcttgtccttatccttgtctttgtctttgtctttactcctatctttatgccgatgtttgtgcttcttatgctccttgtctttgtccctgtctttgtctttgtgctttttatgcttcttctctttgtctttggactcacttttcagtttaccagatatagtcggtatacccttttcagcctgatgaatggttcaatgttgtaaagaggacaatgagcaaatgaacactgtgatagcagaagtaggaggataaatggatcttacagagggcaaatctactggagccgtttctcgaagctgaaatgcttgccccagtgtttccatgtcaaacggctggatataagcaggcttgtccctcaagtatgcgttctgaaccagctgatctagctccattccttctcctttacgaatttcagtgtccccaacaacattgtcaagataatgtgtatctgatattgccaatggcaaaggcttcttgcaaaagaaatcatggtgggcaagcaatttatagtggcttattaaatcaacagcaccagtgagctccctagggcctgaaatatcagaaccaccagcatttcaagcaaccaagacatggaaaaggacatgtatcaaaaattatgttacaaaagagaaaatagcttataatgaacagtcgtcgcactggtaggctcaaaagtcagcactgatttaaatcacagcaaaaagaaaatcactgcataacacccccaccaaaaaaaaattgaccacaaatatttcaagatgtttgacagtgtttccggtacatggagctcactcagctcaggacaacaacatgatgtttgcatcagataaccaatacaaatgattatggtggcatcagctacacgccaaataaagcacagattatccctgcttattctttaaacatagttgggacgtttttgctggaaatcttttgatgttcagaaaaaaaaatccttatcaacaaaaaacctaccttttccaaacttcttgtcatcagaatccatcaggttgaatcttagcctaagcacagtgcatattcacctgaaattcaattgaacaaaattttacaactagcgtacaaaagcaaagtcaataggtcacagtatgaacttacactgtggcttaatcgatccctgttcccggaaacagaatatctaccaaaacaaaattgattttcatttcccaaaagcagacccatttattgaaaacaatttatcacatttcaaattagatcatctattatccatctatatattcaaccacataatgccatgactgcaatactgcgtaaatattaataaacagattgataagctaaactccaccaatcctggaagacacttacaataaatattctcatattatggaacatatatcttagttttcttgaacttcttagtacttactgtcgaactgtcaaagtatcacaacgaggaaacttaagtggctctatgagttttaaaactggttttctttcacaatttttacgatactggaaaactgaagattgtgtacatttctatactgacaacataattctcttgttccacatagtatcaaagtaataacagagtagtaacaaagttgggagatggatctctaactctctatttctttgttgaacatgaatgaagcagtaacatagcccaagattgatacagtaaaactggagagacataaggacgtggagcatgcatccaaaaacatctcttggttagcagacagaacctttgtgtgatctactttctagcagatccaagcaacattttgtaaataatctaaagttctactcacaaactttgacattgaccccaaagtctagaagattaatgtgcccaacacaactctgggttagcgggtagagcgttggtggcttggtatgctctatttctaacggaccaagccataaaccgtatgaaccctacaacctttacctacattgtttgaaatcagctcaaatctccaagagcccactactagaaactgaaagattaatgctcgccagaccagaggaacaaatttatcttctccctacaaaaaaagagcaacagtttttactcctcctttcccttttggagttaaaagtcacacaaaacatttttctagcacgccattcttgttgtgggggaaaatgcacagcatatggcggcatgtttctatcgtcactaaattgatgatcatgcgaactgcgctagagttcggcacataacaaaaaaaacgcactcctctgctactgcaagtgtgcaatgaacccagcagagcatagtatattcaactcgaaaaccctagttccacagctcccccatcaaaccctcaactggaattacaccgattggacgtggcagcgccccgggaaagattcggaatcgggttcaattgctcgcagcaacagcgagagaagcaactcagattaggtcaaactttagaaccaagtaaccaaacccaccccaccccacccgcccacccaagcaaaagctagggcttcctcaccggataagggggggaaagaaccggcccgccgggtcgtgtgtgtgtctccgctccacccccgccgagctccgggcccgaagaggagcggggagggaggagaggaggcgtcgagtctcgtcggcggcgcggcggcggcggcgggattcggggataggcgaggcgagtccgaccgaccgtcggcccgcacccgggtgggggggctccttatgatgcggtgcgacgcgacccggcgaccgagcccctcccgtttcgcacacggagaggggcagtatggtaaataggcgagataacaatggggagataaaaaaattgaatatttaactatttgtcactcttaatatatgacaattaataatttgtcacttgttgtctatgacatgtgggcccagtgacgtaagagtggaaaatagttaattattttataaaaggggatttttgggaaaaatataaaatcgaaaccaaacagtataccttggttcagtttttatttaagaaaaaggaaataaaaattcgctgtagtacctttgtcctataataattatatttctaagatttaaatttgttccaaaataattatcacatataatactaatggtctcattaatcacttctcattcagatttcttcttattttacactcaactatctttctacccttatataaacaggaattactttgataaggggattcgccgaaaccaaattcatattcaattataaacagtaattgagtcgattatataaagtccatgctcgttttagaccgtggaggatggacggtagaatattctgattttgtgtcgattatataagaacaccaacgaatgaattaaaaatcaatgtttaaaaatttaaaaatggaatttgaaaagtacgccatccattttattttgtttaacgttgattatttcaaaattagacaggtcatacatttgaaaatagaggtagtacttttttcaaaaatcacaccgtataggagatttggtactaggaccagtgacataataaatttggacaagaaaaaaaatagcagttttcgttgatagctcgttctttagtccgtcgaattctatggtcaggctacctggctgacacatcagtacatcacacaagaaactcaacgctatattttaaacagaagcaataatgcaatatatccaaggataacgtctgcgtgaaattcaatcttttttctaccgagcatgcattactaatttcaggacataattgacttctctgttttttttttctttcaaacctttgcactgctatagagttggcacattcaaagaaccagcacatactggcatacaaccaacaaaagaaatgatataatctcatccaaaactgtccacctccagttagtgcataaatagcagacaagaaaatgctttgcccctgtaccgtacttctagcagctaaaatgcaaatgtgatttctgtccctgcctcaggctttcatttccccacccacattcgcattcacctcaatcacccaaacacagctgtatggtactcctagatatataccacatgagctccgggaggtgaagcagtaaatatcccaccgatataatacttatcttggcgtagaagagctcctgtgaaatggtatccgctgtcagtcgagcaagacgaattcaggtcaagcaaatggagaccctggtccatgtatgcgcggcacaaaatattgccttcatggggggatcgatcgatgttgcctgctgtcagttgtgaaatcgaaggagtggatgagtgagcgtcatctgtagttacagcagtgtgctcggcctgatgacagtttgttccagaggcacagcatttgccaaggtgactggtaatgcgccgtgaagtagttatgcacgcagccgaactggcagaacctccagctgtgaatgtactgaactggcgcggtggtgttgaagtcttcgacccacatgcccatgctcacatcttccatcttgaacaactgcagtgccagtcaggtgacaatcagatagcattaacggtatgtgcagggaaaaatgggtgcaatgaagtttcagaataagcctcacccttagggagtgatttgcatggcgtgatacgatgtctcttgcaatgtcgattgaaataacatagcctggtccattggcatatggaggatacacaaattctggccattcctgttggtacccgccatgtttaaagtaaccaaatacatgtcaatccagaaagtttacattttacaaaagtgaacatacctcgtacgtcacagcccatttaccatgccggagaggtctgtgtaacaggtttaggttacccatataaagaggcatggttctgttgtagacggagatctgtttcaatactacatccagcctcacaaaggtgtcatcatcacatttcatgatatactctgcggttacattttgcacctacacacatattgcaatagtatctacttgaggaaaaacatgcatgctgtcagaaacattgttcggagctattttgagatgtatatgacttaccccaaattcacatattgcgactgttttcagaaccaccagctcatatcggtcaataaatggcagaatgacaacatctccaaaataatctgcttctgtcttaagtgctgcatttatctcttttctatgactctacagaagcataatggtcacagacttctgttattgttattttgggaaactattttgaatgagatatgcagaaattatgtataacagcatttgcagcaaatacctaataaatgtgtagaaaattatgagacgccacaccacccaacgtgggggggcgattatatttatatagctaaatacaatagagattacaacaaactcttaaataagatatatatacatatacgagagatacttagactatacaaatctaatctaattctaataaaatgtactataatcttaagttaaaaaaatgcaaaaatagcaattatcctcaaatctaaaattgtatatattgctgcatgcgataaaccaaccacccagctacatatacacgtgaagcgcatgcaatgtcatacaaaacaccttgtaaagaacacatatgtctgcatatatctagccacaaaagatctactagagtgaaagatgagtgtaaaacaaaccattgcccccaaggccccaactactcctaagtcctcatgtaatagtaaacatgtggaggattacaaatttacaatgtagcacgacataccatacattaacaaatgcgaccaaaaaccattgccaaatcatgaaagttatcttaccagtgcaacaaagaaccgagcaaccacatttcccagttggatggcagggaactgcatccagctttttcttatagccatgcgctcagcaaaatggtttgtagcagagattatgccaataaaaacctgaattggttcctctggtactgggcgagccttccacctatcagacatttccaagacctgctggagagagaaactaggatggacctttggaagagaggttgcatatatagagtgaacgtctacgccgcctgtcacagctaaacctgtggcatcttcaagagagaatccctgataaacatttgtaatcaagacagtagttactcagtattttcactcgaagaagctagagttctgtacaaggtaacataatattggccaaagtaacagaaaatttaccatcctatgaggaaatgaggcaacatgacggcctcccacgctaacgtgatatccttcgataccagcttggatggtaagaacaaacatcttcccctctgaaaatgggtatggccatctcatttctggtttctttgctcggccgatgaacctgttcaaccatgagcctgtctttgtttcttttgaatcaacactgtctctccgatcccatttctcacatttaattaatccatccactacaaagttaagggagatcaaacataaatacaggcaaggaatcggcagtgttttaactagaagacagcattattttgggtcagatttgcacaaaagaaaccatcaaccatgaaactgcacatttggcttgcaaggcaattccatttataaatgcgggacagtttcaacttttcaccttacaatgtgcattcactaaataccctaacaacatccagagtcaccaaatacaggatagcaaaccccactaggaattagctcaccagataaaaaaaaaattggtgactggttaaaaatcatgtgaaatgtaatcaaatgccagcaatgctatcttgatccacaaatactactattagttacttccaacttcccaacacctagcaatcttcttttattagatcaaagagttagcaatcttgcttacttgtaacttgtgagcaatgtctgaagcatcaattcagcaactaagcaagcttgagcacgactaattgcaatgcaatttgaaaatcaactgtaaagagtggatagtataagggatgtaccctggtcgtcatccttggaggggttgccatcgcagcggtgcgcctttccccactgcatgcggaagcaggtgttcatctccagcacggggcggtggctccagtcgccgcgcagccgcgggttgaggtggaggatcctgggcggctcctccccctcgacggcgcggaggccgcggagctcgacggcgaactgcgccaccatcaccgtcccgttccctttcccgcgccgttccagcgccttcacgtactccggccgcgccggccgcgccgttcccaccaccgtcaccggggaacccacggcgagcccgcaggggaggaacgccaccgtctcgccgtcgccgccgccgatgttgatcgacgcggggcacttggtctcgcccccgccgtcgcgggagaggatggagtccacgtcgcccgtgaacgcgcacgcctcctcccacgccttgccgcccagctcccacgcctcgtcggccatcctctcgagctcggagaagttcccgccttgtccccaccgcctccgccccctccctccagcttcccaccgccgccgaaggatctctccagtgatgcgaccgtaccccgcgacggcgacaccatccccatcaccccgcgcgcggggcgccggatcctcgagccgccgcggcatcaccacctctcccgcgccgccgctcgccgggcgggtgacagccgccgggtcggcgatgccggcgaggccggagagcttgaatgacacgaacaggaggtacacgaaggccaccgcggcgagcagaggcgccacgcggcggcgcgcgcgcccgcggccgcccaggaagacctcggagcttcgcgccctcttcatggcggcgtcaccggcggcggcgctcgccggcgaggagtgggcggtgggtgggattccgggtccggaaagcgggtcgggatccggaatggaggtgagtaggtgggtgggtggggtggcggtttccgggtttgggattcggaaagggaggggtaaccttagcgattaattaatgggattggtgctgacgtggcagttacttataagggcacccacaatggttatctataggctctctataagagatccatgtcagcatattttcctacttggaagagattaaatgaagagagagagcaaaactatctactaacctgaagatagtctatagagaaaaacgagacaatatattagagagctatagatacccatgtagacatactattgagatggtttactattaatttagtctattgctgagatgtacatgttttatagatagcaccttactttatcattttgggtgatctaagatgttaattgctcgtgtggttaatgcagttatgcttgtgtttggagttatctctgcttttttagtaaagtggagtagtttggatgttactactagtgctaccgttattaatgctgctagtagtgatgtcttttgatgttactctgatcaatttaaagtttatttaagtaatgagttcatatgtcattactttcaatgttattataggccctatttaatttacaccaaacttcctctaaactcttaacttttcatcacatctaatcacatctaaaacgttcctactcatttaaactcctaactttttttccaaactaccaacttttcccaaacttattcccaatttcagaaactaagatgttagtgttttttttcattcaaacaatataaaattacacaaaatgagtcaaaagtattttctatgtctaaaatatagcagcccaatactccgttggtcgcaatctaatactacactattattatatttttggtacggatgaagtaagatataaacaagttgatggttggctcttgccctacatcaaacttgttcgaactttgctaggtttgagacggtgattttttttctttcaaatgtttgcaagaattcatgtggaatttatatacatatctatactgtgaagtttatactttatagggattattaaaatgaaatagacatgggcatgaattcttcaagaaaaattagaaagaaaaacatcactcgcgtgcaaagtacaatatcaatccagttggaaaataaaataaatacaagttggaccatcatgtggatcaaaagtgcagaatgccgtttatttaattaatcaaacgagtcctaaactatataaatgactaagtataaattcaataatgcattcactgttaattactgggaacagaattttgtgattgcatagcagcaaacaactacaaacaaacatgcagcataatttgtgctgcttgtactgtcgcggtagccacagccagcttaaatttcttgcagcgaaaactagtgatcgaattgcatttgaaagattgtatacatgaaaacgtgtttttttagttgaactatagaagatgatgtcattagtgtccacctgccgggctctctaaacacgagttaaggatgtacttcctctgtctcaaaatgttgatatctaggacagcatgtaaaatctcatctagatagcaacgttttggtacggaggtagtattaatggttgtgtgagtgtgttacgtgaactaattagggcccctttgaatcgcaggattgagaaaatagaggaataggaaaaacgtaggaattgaattcctatgggattttgaaacacaggaaagtcttcaaactgtcgtttgattagcacacaggaaaaacgcaggaaccttagacacatgaaaaggaaaacatgaggtgagacctcgtgctttttttcctccaaaattgctctagtaaggttcattccataggaatttcaaagaaattgataggaaacaatcctttgtttcaaaggactctatagaattatttcccataggataaggcccctttgaatcaaaagatttatgtaggaatttcatagaattcaaatactataggaaattttcctatttggccctttgattcaaaggattgaagctttccaaatcctatgaaattcctatggaatggcacattgcgggcccctttgaatcaaagaatttatgtgggaatttcataggattcaaatcctataggaaattttcctatttggccatttgattcaaaggattgaagttttccaaatcctatgaaatttctatggaatggcacattgcatatggattttggaggaaatttagcaagagctccaacctcttggaaaatttcctttgagtctatctctctcatccgattcctgcgtttttcctgcactccaataaaacgaccattcctgtgtttttcctatgttttgcaatcctctgttttacacttcaattcctgtcagaatcgtgtatttttcctattcctccgttttttctaccatacgattcaaaggggccctgcaagtggatcttggaggaaatttagcaagagctccaaactcttggaaaatttcctttgagtctatctctctcatctgattcctgcgtttttcctgcgctccaatcaaacgaccattgtgttttgcaatcctctgttttacacttcaattcctgtcagaatcctgtgtttttcctactcctccattttttctaccctgcaattcaaaggggctctaaaatcttctagaattcctatggtttttctttgattcaaaagggggcttaaagaaaatactgatgatacggtgatagtagtatgaattgcaatttgcgaccttgtcctttcctagccagcaaatgggatccagccacgtgtccacgacaactggcagttgccttccctctcatcagagcaagtttaatagtatagccaactattggctccaattcatctatagccaatctaatagttcattcatacaatagttatatactgcactattgatacttggccccacctattatacacatactgcgtcttggagttcatgctacagctggctataaatctatagctcgctatcattctctctccttatttatctcattaaaaatatatttacagctagcttatagcctactattgtacctgctctcatcacgcatcgctgttccacctcatcagagcaccagaaaggccacgcttgggccgggcccaccgatactttcagcccggcccacacatgcgaagaaggcccccacccctgcacgacacgtcacctcggtccagtgggccccacgcgtcagtgggacccgcgctggcagtcgggccgaccaccacaacacgagccgtcccgtcgagggggtggggcccacgcgcatcggacggcccggccgccgtgcgctccgtcaggtcccatcgtgtcggcgccgaaccaagcggcatcgcggggccggggggggggggggtgtggttgccggcggtggtaaaaccgtaaaaaggtgaaaggaaaaaataaattgaaaaggccttggagcgtgtggtaaaaaagaaagggaggtcggcagggggtgaaactgcaaggctatgttataaggggaaatgagaggttagattgagattgaaaaataaataaagggttaggattaaatgaaagagaaaaaaataaatggttaggatttaaagatgtcttttggtggatgggaaattatttttctaacccattagtcaacaaggcctaaaagataaaaggctcccatcctaatcagccaaaagaaaaagacaaatttaaattttcaaacttaattttaagattaattttgagatattttcaacgtagtttcttttttttagctttagcttttaagtcacaataacacatatataaaaattttacctataaatctatgtttattttctaataagttgttttggcttattaggaaaaaaagacaaaaggccgaaaaaactgaacagccatgcatgcatgggctggttgtactgggaggagtgtactgtagttcagagcattttgctatcaggtgccagctgaagattttgactacctctgctcttaaattggagtgctcggcctctaatcatctgcttgattttattagctacagcccaaaatttaaatttaaatttcaaatttaatgatgaggttttattatagattattttcttgcattagcttttccgtagtaataactgctaagagaacatgctacgcatataaaagtttgcctataatctattttggtaaaatttactacgtggcacttaaatgtacggtctttgttaagagacactgcaccaacatgaatttacccgaagacactgttgttgtgatgtctcctaacaaaatcagtatttctaagtgttccctgacaaattttgccaaattattttatgtgtttactttatctttccatgacttatgatgtagatcaatcaatagtaataagttcttttagttttgactgctcgtccttttttaaaaaagaaatagtatatacttaaaaggttgttacatattagcaatatgtgtcatgtcataaatacaacttttgtcaacaataacaaattaatcgtataaaagttactcctactaatgagtaaggttaagatatcgatggtaaacagtgataggtaaacgagacagcgcaactaattgaaagataagcctagagagtgactggctgcactgctgctgctcagtacaaataggattactactgtacttcggagtacaaaatgtagtagcactagtcatgactactcctacatacttagatgtgtttagttcacattaaaattaaaagtttgatagaaattgaaataatataacggaaaagttgaaagtttacgtgtgtagaaaaattttgatgtaataaaaaagttaaaagtttgaagaaaaaattgagatctaaacccaggccttgggagtactatacagtcgaaggatttggcaggaacagttgaggaaatcaataacacaagaagtccttgtcattagtgacattgaagaactgtcttttcgaggtaattaaatggtgagatttgggaggacgcaacaaaccttccatatggtgtgcactgtacagtactcattagtatttgcgaatagggggttatactgtggcaggacgtcctcgatcgtccaaagcgtgaaacttgcatggagaggtctaatgcaagtttgacttgatcgtttgatgataagccatggtgtgtacaacatttgaacaatggtgttattcgtttatactgaaaatgaaaatgaagataaagttaaagcaaatttaaaaaatattagtataaaattaattaagttttaattattatttacttgagaaatagaattatctgttttttttaaaacaacttctgtacaaaaagttttacataaaatatcagtttgaaaagcatgctagaaatatatgttaatcaaaataaaatagaccaacgtaaatcaaaggcacaaggctgatttcgtttaggggcaacgtttatgtttgaaaacggtaagtactaactgcacatatatatatatatatatatatacatgtatatatatatatatatatacatgtatatatatatatacatgtatatatatatatacatgtatatatacatatatacatgtatacacatgtatatgtacatatatatatatatacatatacatatatatatatatacatatatatatatataaactacctccgttttaaaatatatcaatttttaactttgtatttagatataattttatcaacgtatgtaatcgtaagttgttttttaagcgtaatcagaagtatgaacagctgaaaattgaaatcagacaccacaagcgaactgcacggagtagaaagctcgcacctgttgcgcagagctacagaggcgatccacgccgtccatctcccgatcggacggtcggcatactccccgagacacgggcgcgaggaccgcattaaatcgtggtccacgcgcggcatggtggtgggccccacactccggtggggaaagaaagggacgaatcctcgtacgccgagaaacgcacgggggtgggggaaaagaccctgctgcccctgcacgtgcccaccccgccagcttgggcctcgggatggctcgagccgtctgggccgtccgattgtactgcggtggtgttggttccacggatctcgaggcggagcgtcgagactgccgcccaagggtggggtggtaatttggtggagtactacttcaacgtcacttgtacaggaggagcgtggcgtgtggtgggttctttggcttgcatcttaggtaggttttttatttgcgaatgagtccttggatacctcgcacacatcgagggcatgtttggcacagcttcagctcagccaaacaatttcagcttcacctaaaatgaaagtggggctgggtgaagctctctcacaaaatgaactatagaggtggagctggatttatacagctcacaacttcactctagacctaactcctaaagcaaatttaggagttggagctctaccaaataaactatgacttgttactctaaacagtactacagaacattaatttcgctatggtagtagagaagcactcgagtgaattttttaaatttttcaagcggtagataaaattttttgtgtatatatcccgagtgacttaaaaaccaatgttgaacaaaattatactacagaacattaaaatcaactccagaatcaattgtccaaatcaaattttggcaacgtcttataagccatagggcaaacgatgaggtcctatgttttgtcgaaacaaactactcgttgtaaaattgttgtgttaattttaaaactgtggcggtaggacctccgttagcacagatgatacttcaagtaaaaaacatgtgataacaaatcgtgtctagagtattagttgacactatctcaatttctttcagaattaacatttgaagcaaagtaccccttggccaattgcaccgcatgctagtttcatctgttttggaatataggataattagagaaatcttggagaattgaaatagtacatgaatgggtcaagtgacttttactaaatattttaaaattcctatgcaaattttagccgtccgtccctcccattcgtcaacctctctccccgaaaaaaacaaaaaagtacccatagagaaaaactaaaaaacactttgagcaccattgacccataaacatataaaatcattgacccatcatctcccgatggacatgtccttggttagcggaaaattagcaagtattcccttcgtttcagattacaaaattgctttaaatttgactaaatttatagaaaaaatagtaacatttttaacccataacaaaattattatgaaaatatattcaattattgatttgatgaaactaatttggtattataaatattactacatccatattttaatgtataacgccgttgactttttttccaacatttaaccattcgtcttataaaaaaattatataattatcatttattttattatgacttgattcgttatcaaatgttctttaagcatgacagaaatatttttatatttgcacaagaattttgaataaaacgaatggtcaaacattggtcaaaaagttaacggcgtcatacattacaatacggagggagtactatatttgtctataaatttagtcaaacttaaaacaatttaactttaatcaaagtcaaaatgtcttataacttgaaacagggtgagtagtaagattttatcgttgtctagtttttatattagtgtaatcaaacaataattttaaaatttcctatgaattcactccacacataatttaaacgacgcatgacctacggggctgtttggttggtggcctcagtttgccacaccaaactttaagcgtgccacaattttttagactagtgtttggttgcgtgccgcagttgagtcaagccacactttattaacacattggcccaagcgtcatactctcatttgctagccaaagtttgccatagttatggttaacaaattgttggccacactttgtgtggcttgccacaattatagtaaatagagttatggcaaagttagcctccatccaaacagcgtttccaaggaacccaactccaaagaatctagtcaaagataccacaacccgaaaacaaaaataacccatttcaaaaggggcgacttgtaatttgtagcagtggtaagaaataaatctgacctttttcttttcatcagatttgttttactacctccaagaagctctctctccgtttttcttctcttcctactaaacccctcaaaacggaaagaaaaaaagaagaaaaaaaaaactcgaccaccacctccaccactcacacctcgatccggccatggcggcctagccctagcacctagggttcgcgcccccaccaccctccccgccgtctcggagaccgcgcgcccccagctcccgcctcgctgtcgcgccgcctgattccgccgccggcgccgaatgctacgccgtttggtggtggtggtggtcgtcgtcgcctgattccgcgatctcgtgagctccggggggtgcgcggttgcggcggcggcgcctgagaggaaggctggactcgtccgcggcggcggcggctgcgggctagtgtcggtggcgatttgagggcggcggtttgggttagccgtcgccgagagtgaaggtgctgtgttttgagtgcttgggatgagctgcgtgttgatctgatgaactcggggtcggcggcgttcttcggtttctccgctcacttgctcccgccgttggcgaaaatccggttcttcggatcgagttgcggtcgcctgggtgtttttcatcagttttgggtgaaaatactcgagctctgaggggggtgattggtttccaagtttgattgatttaaagagtttgtgtgaaattttttcggggagatgaaggggaggatttgctgcgacggtccaggttttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattgaagatgaagctctctccgccggcgtcggcggatatgccgcaggccttgccggagaacgacggtatatatccttgctcacaatttcgacattgtttcagttctgcactttctcagcttgtgttgatgcctgcattgtaaagtggattatggatcatggagctttgtgattctgcactttgagttgtttgtgcatgattacataatgcataaatgagtctccattgctgccttgcacacactccgcacatacacacacaaagaaaaaagaaagaaaaaaaaagaactactcctacattacttggctctgttcattgccctcatgttataacattatttgatactgactgaacctcctactgtctgtgggcaagtacaaatagtagcttcacatgaacttaactttctggtggtttgctgttcagctcatgtgtgtttggcatgttgcaggggaacaaagatgtctgaactcggagctgtggcatgcatgcgctgggccccttgtgtctttgccagtggtcaggagcagggtcgtctactttccacagggccatagcgagcaggtcagtcacttggtttgtagtctgtgcacatctctttcattatgctaggcatggccggattttgttgactcgaatttactagaatttataaaagaaggtagaacagctctgcttttgcatttgtgcatcagtacataatagggcagaggattgtctttattgtttgctcagtgcatcattaaacttaatatggcagaagaatgaactgaaactgtactgtctaaagtaattttagttctgtgcaggttgcggcatcaactaataaggaagttgatgctcaaatcccaaattatccaaacttacctcctcagttaatctgccagcttcataatgtcaccatgcatgtgagttcactcttaaagaaaccatcatgtagcttcttaataagcagcttatgataattcacctggtgcttttgcaggctgatgcagagacagatgaagtttatgctcagatgacattgcaaccattgagcccggtatttgaccactgctttgcacttctagccttatttcttttaaaagggcaaagatgttacaaggattatgtatttgtcatgtaatcctgttgacaggaagagcaaaaggagcctttccttccaatggagttgggtgctgctagcaagcaacccactaattacttctgcaagacattgactgcaagtgacacgagcactcatggtggtttctctgttccccgccgggcaagtgagaaagtcttccctccactagtatgcctttaagctcagtcttttttttggtaggaaatgttcatttgctatgtgttcttcaaattgactcctttagttctctgtaggaattttcacagcagcctnccgcacaggagctgattgcaagagatttgcatgataatgaatngaaatctcgccatatattttcggggtatgtaactatggccgacacacatagaactgattatgagttgtttgtgtacacaaaaaaattgacataaaatcatgtactatgccttttagatagcatttccattagacatgacatctatccgttttgctcttttttctttgttgccaagatctgtttttgcatttttatctggctaagaaattacctggacatgctataatgacaatactgcaactagcctccttctgttcctgccttgcagaattgttgaattatgaaattatattgtgagggtatcttcttctattgaactttcaattggctatgcatttgtcgtgcaggtcagcctaaaaggcatctcctgacaacaggctggagtgtgtttgtgagtgcgaaaagactagtagcaggagactctgttatatttatctggtaccacccactttattccttatttaaattgtatactgttgctagaggttgtactcattgctgagacttaattacctttatcatttttaccaggaatgataacaatcaacttcttttgggaatacgtcgtgcaaatcgccaacagactgttatgccctcttccgtgttgtcaagcgatagcatgcatataggtcttcttgcagcagcagctcatgctgcagccacaaatagtcgcttcactattttctataaccccaggtaaatgtactgcaatcttacagcagagcctttaacgttttattttatttccatatttaattgacatgggcattctttttcagggctagcccttctgaatttgtgattccattggccaagtatgtgaaagctgtttaccacacacgtgtatctgttggaatgcgttttagaatgcttttcgagacagaggagtcaagtgtcaggcggtaagctgatattaagcacacagcatgaaccgtgaaagctccattaattcttatatttacctcttactttcagatacatgggtacaatcaccagcataagtgatctagattcagtgcgctggccaaactcacactggcgttctgttaaggtaatatctgctaaatatattttgtggtctctacagaaatgatgttatcttgttccattatctagtagtctgtcaaatctgttatcacatccctcatggatccctttctgtggatatgttttccttgtgatttttttttcattttggatttatggcacattaggttggttgggatgagtccaccactggtgataaacagccaagggtttctctttgggagattgagcctttgacaacctttccgatgtaccccagtgcttttcctttaagacttaagcgtccgtgggcttcaggactgcctatgcatggcatgttcaatggtatgctgattgatggccggaacactagcacgcataattctaagagcatactctttaaccacttctttttctgcaggtgggggaaatgacgattttgcacgctattcttctctcatgtggcttcgagacggaaatagaggaacccagtccctgaattttcaaggacatggagtctcaccatggcttcagccaagaatagattctccattgctgggccttaagccagacacgtaccagcaaatggctgcagcagcactggaagaaattcgatatggggacccttcaaagcagcatccagctactctgcaataccaacagactcataatctgaacagtggattaaattctctgtttgcaagccatgttctagggcaggtgcagtttcaacctcagcagtcacccctgcaagttgttcagcaaggccattgtcagaacactggtgactctgggttccttcaaggtcagcttccacggctgcagttgcataacactcagcagctgctaaaggagcaagagttgcagcagcagcaaagacagcatgttttacaagagcaatctagtcaagagatgcaacagcagctcccatctagtgatcatcatgttgctgatgtagcttctgagtctggatctgctcctcaggcacaatcatcattgcttagtggatcatcattctacaatcagaacctcttagaaggaaatagtgatccccctttacatctacacaacaatttccacaacttctcttaccaggaagcctcaaaccttcttattttgcctcgaagtagccaattaatggcatcagatgggtggccttcaaagcgattaactttagaatctgctgttcatcctgaagctccgtccatgcaccccaagattgagaaagtaaa

SEQ ID NO: 35873 - DNA, 8367 bp, Oryza sativa
attattttttaaagttttgtatgaagtttggaaatgcctgtttctcttctttttactaccctacttaacatgtctgtgagtgtgagctgctcatttattctatatgatctggctaatatcttctgcattttcttcaataggtttacaaatcagggtcccttgggagatcacttgacatctccagattcagcagctactgcgagttacgtagtgagcttgagcgtctctttggtcttgaaggccaactggaggaccctgtaagatcaggctggcagcttgtatttgtcgaccgggaaaatgacattcttctcgtcggcgacgatccatggcagtaagcacttacaaacctaaaatgtttcgtatgcaaacacaatatttgtcaatgttcaaagcaaacaaacatgatattctatgccatctttttttttcagggagtttgcaaatagcgtatggtgcatcaaaatactctcgccacaggaggtgcagcagttggttcgtggtggagacggccttctgtcctcacctggagcaaggatgcagcagagcaatgcctgcgacgactattctgcaagccacaacatgcagaatatcgccggaaacattgcatctgtagcgcctctggactactgagatgtagaccagaatccaaactaagcacccttaagactgcagggtcaccattcgtgatcgcctgcattccatgcgatcttcactagtcctgtccgaatcagtagcaactcagtcaataatatagctagatgatccgttgtattccatctgatcatggacatgctgtatgatagctgctttagctctattaaatctctaatggcaggcaactaggcaagaacagttctatgatgaatgatggcagtcgctgtagaattgaccttattctgtagctataatatgatgtctagaactgatgattccaatttccaaatggagcccggaacatattaaaatcaatcatttgtcgccttcttcatgtttttgccataaattgtggctagatgatcttgtttcatgctactgagtcaacattttgtcctggtttgtaggctctgacctgcctgcctacttatatgccattgtgcatgattcacgcaggatcaattttgctggacaaaatcatgattccatgctgcaaatttccaaagtgtggtctatatagttgataggaggaacttttagaggaatcctagtagctccatgtggtgacattaatactgttggactccctacttattacatacttattcaaagatttcaccatgccatgaactttaagacataattatgcctgtttttaacagaatggtctaaaattttccttttgggtttcttggaggctttcctgtgccagccaagcataaaaagggggcctgaagctttgttcttttcgtaacaatgcaactgactaaaaatctctcctctcttgaaatgttcatcagttaaaaagacaagtaggattttcaagtcagcagagcaaggttgctgcaaatccaggtgatcaatgtcaaatactaccagacccaaattcagatcacacaaggcaagcagcagctaaacatcaacaattctagtctacagcacatttgctccaaacaaaccattgcagcttagttccatttcatatacagagctcccatggcattttgagtgacagcatgatgatcatgatcatgatccatcttgagaattctttctttcttttttgtttttcttcagatgttcagaggaacagccagctgcagcagcggcggaggcgcgacggcgcggcgccggtctcccggatgcggtgcacctggcgggccagccgcgccgcctgccggctccggcgagcctccaccctcgcctgcttcccctccgccttgtggctcaacgccgacagcctcctgctcagcttctgcttcgccctcgccttcatctgctctgcctgcacctgatgataacatacaggcatctgtatcattcattcattctctaaagaattctatccaaacttggtttttagataatagatttataaaacccagcctctacatcaaatcagaagtacacgggcaaacctaaacttgtcgtccctcagttccataatataagggataatgggtggatgtaacacattctagtataatgaatttgaacagacggtctaagtttatatataggtttgggtttagccatacttctaactaatgattcaacaaattagccataattgcttgagggatgaataaacattatgcatactccctccgggttgataatacttgtcgttttggacaaaggtacggtttcccaaaagtaactttaacaactattttctattataatatatatgaaaataccaaaaaatatatggttttattgaagtatattttaaggcgaatctacacatatggtttttatatttttaagataaatattttagaaattatttgtagtcaaagattttaaagtttgactttacccttgtccaaaacgactaatattatcagcccggagggattactatattatagggctaaaaatagcttagaaaagatatctaagcatgtatagaaagtttttatttttaatttatgaaaaaccatacttttagaagcatggcacgaataatctgtattctcatagctgattagaacgcccaataataaaggtttaagtttttgaattcgatgtaagtttacctctgcgtgcctcatcttggcttcgaatttggccttctggcagctctcccattcctgaatcttcacctccttcctctgaaacctgacgaattctcgtccaaattttcgattcaataatcaaattccagaccaaaaaaacaacaaaaaaacaaaagttcagagaaccaaaaaaagaaaaagagagtgatatttgctgcacctcaacgcgagcttgcacttgtgcgtcttctgccacgccatggcgcgcgcctcgaactcccttttcttggcctcgccgccgccgtcgccggagtgaggtctcggtctcggtctcggtctcttctccggcgaggcgcgggggagctcgtcgtcgtcgtccttgctggcccacgacgcgatgttcatcttgcccagctgcagcccgagcgcggcgatctcgcggcgcgtcctgatctggagctcccgctccgacgacgccgacgacgcggacgcggcgcccctcgggctcgtcggcaccgagcagagcggactcagcgacggcgtggcggcgccggcgggcgtgccgctccgcgactgctccttgctcgccatcggcgtcatctccgtccccacgtcccgcatcgacaccgccgccgcctccgacgacacgcggagcctcttctgctggcgctgcctgctcgccaccgacggcggcgacgacgacgccgaggcctccggcgcaacgcggccggacacggccgctgctgcggcggcggccttcttggagaagattgggttggagtgcacgacgtgtctcccggcgagccacttctcggcgtcgttccactttgacggcacctgcctgaagaacgtcccgccgaccaccgccaccgccgccggcggcggtggcggcggcctctcctccctgtagaactcgaagccgccgctgtcgtagccattgccagctctcccatggctcgcgtcggagcgcgagcgagaagaatccgactggtccttgggataatctgacgaagaaatcaccggaatcaaacacacatcaccattgccattgcaagctccacaatggaatcgaagaggaagcgaaccttcgtcgagttcttggggcaggaggctgttcttggggtggtcgtcgtcgtcctcgtcggcgtcgagcctcgccggcgacgctcgcggcgacttctttgcctcgtcaaccctgccgatgctgccgccatgggatcccagcagcttcatcctcagcttggttggagacatcactcccatctgcattgcaacaaaattatcactaaatacatagtaaaccttaaccaatttgatggtttccaatgaaaatcaatcacccaagattcaggacaaatttcaaactgtcattactagtatccaagattcaggagtagtactagtttaattaatggcttggtaaattggggcaaaaaatttactacaagaattgactctggcttcctgctgcaaagaagagagagatttttaactgctcatactgcagttgccattggagagcagccacagctttgaatagagcagccatgaatgttggctactttgagcttgagagagcaaggtagaatccacaaccaaaaagtccaagagagagagagagagagagagagagagagagagagatgtataggaaccctgttgtggtagtagcaataataaatcaaaagcaccataaatggacatggctagagagttcaatattggaaagtaaagtaattagtggcactatgccactactatcttgacccaccaaaaatgttcatgatagatgagaaaggggagtagtcacattgcattatagcagtacttagcttcaagaaggggttaaaaaagagagatggatcaagcatagtagtacatggatattggatgatacatgaaaaatgaaaatgacatacctacagacatgagcatgaacttaattctacaaaccaaacacaacctaaacaaactaaggttgaaattgtagctaagaaacaagcatatggaggaatgaactaccaccaccacgactactactgtaatggaatactcggatagtgagtttgttacctgaactttgtgtatcctctcgtactccatgacagattataacccctctctctctctcagctttgagcttgctaaactgtactacctctagttacctgcaaattagcaagaaagcaaagaagcagggagggaggaggaagaagcagcaaagcaaagcagaatggctgcgagtgttgtgctttgctttggctctgatggggaagacgataaatactagaggaaggagacacgtagcattgtagcattggtgcacttgcaactctgaagagagaaaaattcagagagagatagaaatactagtattcagaaagacagagagagaaattcagagagcgagcaagcgtgcgtgcgggtgggcgtgcgtgtgtggaatccgtgtggaggaccactcgccggcgcgctcatcggtgtggctcctcttgctgctccacgagccgtccgatccacgcgtgatcgcctgatcggacggcggagatatcatcgctccgactggcaggtggggcccaacggctcggctaaggcattctacagcgagcgcgcgaaaatttcgggacgtatccgagctaaattcaactttaaataaacgagatttggaggaagagatactttaaaaaaattttaagaagaagttgtgaatatcctgcgaattaaacacatgatctcaggattaaaactaaaccctccttgttaatatattattaagtgcatctcctaaattaagtaaattaatgcagtacaagtatgaaattttccagggcattgtctatttgtttgttgttttcattcagacatgacaaaacatcatcaaagttttctaatcaaggttagagtgtgtgttaggaggcgtattcacgagcatgtaattgtggtgtgtgcatgtgtaataatggtgtgcatctctcgtataaccgctacaaaaatactcctttcatctatttttgaaagtcatatttccaaatctgaaaaatttatttttgataggcatattttaatccaacaacctatcatcttaatgactttctcggatttaatgcatgactctccattcttacacacatgattggctacatggacattgagaaatgtaaatattaatgaatcgcttgtttacgatgaatgactagtagcatgtttaaatggatgataagtagaattacttatccttggtctgtgtgccaagatgaaatatgactatcaaaaagtagatggatggagtagtacttagtaacaaattaaacagtttcgacccattcgaatttaatgaagatgaaaaaaccattagcatatgattaatggtgttttaattatttttaaacttgaaaatggacttatatgatattttaaagcaacttctataaaaaaaattcatatgaaatacaccgtttaacagtttaaaaaaacgtgctaacagaaaccaaactaaaaattgtatcttaatcaaaaacagggctttgataaattttaccgttaaaacataataaaaactttgttatggcttattcggttaatccctatatgcaaaagattgaaagggattaattatcctctctaaatcctattcaatcttagtagtatttgagaagggactaaccgaacaagtccttaatgttattacaaaatttcttggttttgggtgtgtttatttcacgtcaaaattgaaagcttggttgaaattgaaatgatgtgacggaaaagttggaagtttgtgtgtgtagaaaagttttgatgtgatggaaaagttggaagtttgaataaaaactttgaaactaaacttggcctttaacaaaaaaaaaattctacgaatttcattcagatttaaagctttgctctgagaggagaggcaaacgagtgtgttgtttgctcgttgttcttcccgagaactgaatgagctgatgagctcacctcacacgaaaccacatcacatgaatgcatgagcactagtaccaaatttttacctctacatatgctagtactggtagaagtatcagtgtgaattccagagtggcctatggcaagtagctacgtgtagttgaacactttttctccctttctgtattgtgcccaactggttcaaaagttctctaggactacactgttgattggagtacaatattttacacatttgtgcatgaaaaaaaataatttcccctcacttttattttgcaaaggacaatgtgatgtagttttatgattaaattagcagtaaacctatagttttatgataaatttgctacttaatctatagttttataaaactctattctaaatatgtagtttcatgataaaattattattaaatttttagttttatgataaaaacatcttaaatatgtagttctataatagtttgatcaaagtatatgtagttttgtaaaatttaccaaggtcaaacacaaatcctttattacatgtatcctttattacatgtccaaagtttctctagtctcgttattttcaattttttttaatgtgtgatgagaaatgttatgtgaaattaggatggaggcttttctaatcttctcccacacagcacaatttattttggataattcttcagcgtggtatcgtttacgcctttctcgctttcacataaccagagtccatgatggtacaatgctttagcttacaaaagtccttgactttgtgttttgaaagaagtgaaatttcctactctcaaaatgcccattgcaagaaggaagcgaagaacatctgagttgtttaatgatttttcaaaaattctcttcacccaacccctatggccctatccaacactagaccccatgtacacccaaagataaagccacaaagaaaggggagggagagaagactccaaagcccaaaacccaacaagaggaggagcacaccacaacaaaagaaaggacataaccctgcttaatttcctaattgtttagcttgctcctccttagaggacacaaagccacaccatcagctgccccttaaaccctttttccttctagggtttggcaatgccgtcagctcatgttcctcaagcacagcatcagtccaccaaaccattttttgttaattacccttttttaggtgatttcttgtcttgatgtttctagttagttccaccagcatgtaatttaatctgaccgttctggtttaggtttttgaggccacattatccaatgcttgatgtcacacttatgcaaatatacatctaaattatgtgcttgtctaactcagccagggtaattagcttcaacagttgatgtgccaaggagaatccagtttgtcttgtggcataaattttttggcggcaaattttcttcaaaagagatggcggcaacttgcatacttaaattaaaattaataagaggatactcctattatcctatacatactatagtaatgttgtattcttgtgtagtgctactccaaaagtccaaatggtgccatgaattgattcttctgctatggaactatggcactataggggaatatacatagatcattataaaagatcttgtatataggatgctatgcttttaagaatgtaatcatttcaattgtgccatgccctaatatgtgaagggtgttcttttacactaacaaatgatagtactagatgtgatcatgtcttttgggtcacaaa

SEQ ID NO: 35874 - DNA, 22969 bp, Oryza sativa
  unsure (1)..(22969): unsure at all n locations
tgctacagagagaatcaaaggagatttgagtcattgtcatagtatgttcagagtttgacagccaagagtggccatctatatgagccattgtcatcgccaaaaccaaaggagatttcggacagttgaaaggagacgaggagcactcacggaccaagatgcagctaagccagagcaagcactgtagatgctgctggtctcgctcctttcatgttttgacatgatcatcagccctctgcctctctgcagtctgcatgcatgcttcacaaagcaaatgctttcttcctgttgattatctgctgctactgtaacctgaaactctgacgaaacaaaaggaaatcctcccctgcattgtgatttgtgaacgaaaatacacagaagacaaacatatgcattgcatgcatcaacatggatggatgcaggtagccagccagaaaggcaattcttccaagggtcaggtatggctacagtgcatgcaacatgtcaatacacaatacacacacatcacttggaagtgacctgtctaggttatatagtactcctaggctttactaggttactgcagtggcacatctcctggcctggttttggtctgtgaggatcttgactaccacttcaaaggcatgaagaaagttggaaggaggagcagcagctgtagcctgtagcagactggaatcagtccatgtttttgactgcattttgaatggaccaagttcaaaggagtgagcatccactcaaaaatgatggtgctatcatcatcttgttcatcatcatcatgaagtgttgctgtggtcatgaatcatgatggcagtcacagaaggcactccacaaagcagcacctgctgctccttgagaacttcttctatccttgagcaaactgggcacctgtaaagcccaagaaaaacacagtcataggacatgtctttgnaaatcaagagagcatcttggcncagcncagtatgtatatatcacaaatgtactatgtacacatgctatatgcattctttcaatgcacaaggccaaaaggaagagcacactgtatcagcagtaaacaagggagaagcctagtgctgacatatttatcagctggaggccaccagcaagcccaaaaaaaagtaagatgtgatgtactaatactcttgcactttgtattagcagtggcaaaatgatacatctcagtgagtatcaatacaaaattttgatgatttagcagggcacccagcactaacaaaatgggcataataaagcaatttcatgttcctcctgaattcgccacacacgcagcattccctccagttcattctttctgaaggctgatcatcatgtaaacgatggcaagaatggtaaactgtgagcgactcgcaaaattgaagcgatcactcgtcatctgaatcgttgaacttgattgagtgggtttgtaaatcgatctgcccacccctgtaggttccacgcttcttcttggtcttctcatgtctaaagcccctgcaaaggcaaaattgaacaatgatgaaattatgttcggcactaagatgatcacaagtgggaaagaacaaatgactcgattagcaaggagtatgaaggtcagaaggaaagaagagcatctaaccttcctctaacttgcccaagaacctcttgtgcctttgcaccatacccagagtctgcaccaccctgtcataagataggttcaccactcggttattgtcaagaacagttgaaatttctacatattactagctaaatgcccgtgtgacgtgtgttgtaacagagttctaaaagagaacatctttctaaaatcattccccattgtctacttccgagactatacttgcatcaatcaaattctattggttagctggcatcatgtacaaaatgatttctaatcatgatcataatctaaggcgatattaaattttcttatgggatttttttactttcataagctagctatatttacataaatacgaaaaggacatgtaaaatatctatttaatttttcttaaaaatcaaacgttaatctaataaagttgtgcagatacgactgttgctcctaatgaagaatggacaaagatcaaagaacatctttttaccagctagtccaaacaaatttttctttattttgtcctttattataagaccattgactgtatgtgggcccatataacagtgggtaggtgccaccaccaccattggtgtcttttataggagtatagatatggtcagtgcaacgcaaaagaaatgtacattaccttagcccaatatgagttatcctgaagcctatcatcagcaaatttaacatcctctagtttcacccgttgaaatgcattcacagttttgggctgcagtggacagagatggcatggacaatcagattacaagcatttcccagacatcaaagatatccataaccgagacatctataaaactattatcagaagtgaatgctaaatagtaagatcaaaatgatgttattgttagtcaatatacaagacatggaaatgataaaccaccttaatgtcagggcatcaccagaacgtatgaggaaatcaccatcgcaatgatagtaacaaactaactacaaatatccactgtccgatacaacattatttggttattctgaaatactagtaaatgtcagaaaagaaagaagttgatccatgactaacacaaaacatatacttactgatcatgtcatagtttgcctaaaatttctagatgacaggctttgtggttcataaacataacaggaacaaattgcactaaagtaggaaataacacaaggcaacgaaagaaacagactataacatacttcagatgattttttctgccttttattcggtttggcaccatcatcctctgaagaaccattgctgagcttctggctagctgtgttatcttctttagcagggaggttgcttccttcgacttcttctagtttccgctttttgccaactaccgcattatcacttggaggcattccattttcccccttctcagtctccattccactattgttctcatcatttgatttaggagctgaatctttccctgcaacttctttgttttcaaccacctcaacgttttccttggacttcttcagcttctttttacttttcttttcattggtgtctttctccatctctgcagcatcaccctttcccttggcacaatcagccccagcatctgtacttcctgtgtcaaccttatctgatgtctcaggagttgattttcctttcttctttttcttccctttctccacaggagcaacatcaaccaaaccattcttgctatcctccttcaatgtgtccacggtctcaaatttgttaatgatagccgattctgccttttccagcctagcttcgacatcctcgtcgttttcttgtttcttgcttttcttcttctgtttcttttctttggtctcgacatccgcattttcactgggcttttccacggcagaaggctcagccaccttgttctcagcttcactcactttcgtgtcactgcctttctttttcttcttcttgccagcatcttccgcgacaacggcggctgttttctctgcacacgattaagcttcaaatcagcgccaattacgcgagcctacgccaaatcattacgcgacgtaataatgaacatcgacgctaaccgtgctcgatactcccattgatgctggctcctggagcataattgctgcattccacaaccaaattccaataagaaaccaatcatggcacagggatatggatcacctacgaaatctatcttaagttcttaacacgagatttgagcatcgtgccgttgattctaagtaggagtacctcgagtcctccaagaatccggaaaccaactcttccaggctcaccggcgacgaccgccaagaacccgcctgcgaacgcgcaaaaatcctcattcacccactccaacacaaccgaaaatccgaaatgacaagcacatcacgagccaattgcggggccgttacctcgaggttggcctcggactggagcgcggcgagcgcgcgggggaagccgctggactcgaggaaggcggcgaccgcggccaccacggcggccctcctcgcgtcggggacggcggcggcggaggacgccgccttggtcttggccttcttctccttcctcgactcctccttggccatggcggcggcggcggcggcggcggagagggcgagttggcgcgggaggaagagcataaagagggggggaggctagggtttggaggggtcggggtttatacgccgcgaggggcgggctacggtaagaaggtgggtggatgggtggatgacatgtggggccgggtgtgtggtggggcccggttgtcagtggcggtgtgggtgttgactgttcgtctgggcgtggaagcttctggaaggggaagaaggaaggtgctagaagacgactgattgatggactgatcggccccagactcctagtgtcagtgtctgcggtatagtggtgtcaaacgttaaaattgggtacgattcgctagtggattcggttaagaaaataagctgattggtagataagagcttatctagatcaagctaaatttaaagaggaatcatgaagacctcgataatgtatactcccccgtcccaaaaagaatcaacctacgacaatatatgtggacataggggtgtccacatacatcaacttaggagaggtcctcgcatcccctcctagtttgattctttttgggacggagggagtagatccatatattagcttatgctgatgatgcttatcagcataagcagcctgatgcttatcagcataagcatttccatcaggtgtagaaaggtgtccggaaagattgtgtccactaccaatggctaatgcttattcagcccaacaagctaattgatgggcttttgctgaaaatagcctcagcaacagcaaatcggtgaggctgacaaggatgacagttaaagtattctcatgtccgatcaggacttttatcaacccgagggtataaatatatatttcccgggatatttgtaatctatctttcgactaatacataactttcggtacatcgctaccatctattccggagagttcatagtttcgagcgacgctgcattagttaagttcgatcttcggcgagaattaagttccgctaacttcgcttgtattagcgtggctagaactttatcagtgaattccaatattctattcaagttaatgcatgggttgtctatctaatatatagattttgtccttaactgcatcattgtttagagtcgtattagcttagttacgactttctcggttaggtttgctatcctgactaagtgatatttctataaatcacattattgttttagactgaccgatatatctatcacgtttgtgtagatctatcggctaaataggtttttcctattatcttcaatcatatattgtcacagttgatctattagatcatgtataataatattgattcagtcggcaacaagaatcactgcatgggtattgtcatacgtggaggatggaggaaacatgagaaataacagagcaagtgattctgcaagtgccggacgatgatacggtaaactaggcaagatgaaatattttagtttagtttagttgatcttttgtacatatgcatactgtgtggctccatgcacggattattttcatgcttaggcaggatgggccacttagatggagtctagttttgatcacatatgcatgcaacaattaaacccattcatgcttccctaaagccaatatttcgtactacttactttcgctattgactttgctcttagattgttactaaaaagtttatttatatgctgttagttgtaggatcgaactaatgggcacgctcgattgataggaactttattggagctccacgaatctcccaggccttcgcgtgaacgacgaatttcacgtcaacaagttgtatagtctaaaatgttcgatcaaatacttaaacaatgtctgcccgaagccattttgaacccaagaattggaatttcatatggctgttttaaaactttaagtgaacttcatattcaattgctatgtttagatagcatattcaatagaatggcccccactgtttggtatattggagaaaaaaccgtaatgtcaattttgcaaatgaaatattctatgaataaaagttttatatacgtattcttaacgttataaacgtactgactgaaaaataaactacggtgaattttttttccaaaatcacctctaaatttaaaagttgaaaaatttaaatttggatgataattataatcgaaaagatgaggaggacggaggacggctggccatcggcgtgggtcccgcccccccctctctctcaccctctccccatccctccccgcccaacgccgccgtcgacccgtcgtcgtactcccgcccacccagcgccgccgccgccgccgccgtcctcccaggccgcccgcccagcaccgccgtccatcgtcgccttccccgtcctccccatccccccgctcgagttgcgggtgaagaggggctcgaagcggctgctccgccaagcccctcctctcgccctcctcccctctcgccgagcttgccgtcgccgccgtcatcctgctgcatcctggtgaggaggatccgcatctgtttccgattcatctctctctctatcgagtagttttgtctcgaatttgcttgctcgcgtgaaccctagcttctcttgtagatctgtggaagtaacaaacagttcgtttgtctgtttccccgtaaaattccccaagctggacccgcccctggaagaagaagaagtagcttagtgttgatttgagcataatatgggtgccccgaagcagaaatggaccgcggaggaggagtccgccctcaaggccgggatcgcaaagcacggggctgggaaatggcgcaccatactcaaagacccagacttcagcaacgtcctgcgctaccgctccaatgttgacctcaaggtttattacagctgaatgagtccggttgcttcagggaaacgaagttttatagtaacttgttcctgatggattgattggttttggttgcaggacaaatggcggaacatgaacgtaaccgtgaacgcgtccggtgcccgcgacagggtgaaagcgcccgtcgttaagaagccaagatccgctcctaagcatgaaggccactctacctctacagctattgccgcggtaacttcagatggtgatgatgatgttgcggagcctgtgcctcttgcaacgtctacttcatccaagagatccctctcgaggtaaatgcccccaatgctctggtactggcctcagtctaatgtatggataatggtggtatttccttctttttgttaagccagttcgtttactttcgtgtggcattcctgcaggctagacaatatcatagtagaggcagtaaggagcttgaatgagcctacagggtcatacaagacagccatagctaattacatagaggtctgttttcatcttataagtttttctgtgtattatgattgtgaggtaccaataataacccatcattggaaattcctttcatcctttgcgcaacgttctgccgaaccaacatttcatttgtgtatacatgtctaaagtcagttattgttatcctgttgatccacacactcttctacggtactatattgcgtagaattggagacttaaattgatgagcacaatgcattgatattcaggtattttgcatcaagtgcatatgagattctgtgataatgatagccttgaaatgatctcatgaaaaccagtgggttctatttcaatatagctgagtttcacttgatctaatttgctgttcgacctccttaacctttgtaggagcaatactggcctcctgctgattttgatcatgtcctgtcttcaaaactgaatgatctgacagcatctgggaaattgataaaggttataatcccttctgtttgggcatgttttattatgcatttcgagtaatggcagctgatacaattttcatgcaaagaggtgaaccaggatgttgtgctctgatacggtagcaaattcagtaaaatgttaccaattatcattgctatgacatgttaaacttttgttgtgtactaaaatataatgcgccctccaactaacacattctagcaggctagcagcaattcctccttcattcattctttcagtgttgtaacatatctactgcacctgtggatgcagcagttgaatccaaaatgccatcccatattttgtagaaaaatattcttttgtacttgttaagttgttgttagtcctttttggtgtctcatggcgtattctcaatccttaaattcttgtcttgtccgccttcaaattccccggcttacaggctttgttctaaatgaaaactgtagaaaaaagtattatggattttgttggcatgtaagggccaagatggataatctttctttattatttaagcattgacacgtatagctaggcgctaggatcctaggactaccattacacacatcatgactttatagcattatggcacgcaactcattactcatgttcaactattttaggtgaatcgaaagtacaggatagcccctagttcatctttgtcagaagggcgaagctccaaagtagtgctgctcgaagatataaaaaaagaaccaacaaagttagatagggaagatgttgcagtcctcactaaatctcaaatcgatgctgaattagctcggatgagaaccatgactgcagaagaggctgctgctgctgctgctcgtgcagttgcagaggcagaagctatcatggctgaagccgaagctgcagtaagagaagcagaggctgcagaagctgatgctgtagctgcacaagctttcgcggaggcagcaatggcaacatttaaaaacagaagttcagcaaaattggtaattgctctaagtacctcagttctagtttcaaatggttcaaacgttttacttttgcatatttgcactttaaattccttgcttcctcattttgtatatttcaaactcaacaagtcattcactttgaccgtacactgtctatacctgccttaaagatccctctacaaatagttagtccttcatactaatgaaaggtatagatgtacatagactatgagcattccaggtagacacttctcatcaagaaagttatctaggaatggggaagtggagaactgtaggactatctgtcttatttctttctgcaaattctgaatgcctccattcgcttgcagatcattcgagcttgaagctacctgtgggagctggtgcagcatcagtttcctccgaccttgttgtatgtacacttgtcccgcgttccaatgcaatgcaattgctactccagttgggctagggacgaccctattccatccttaacttatgcaagcttattacagaaccaaattgcccaaagccccaaactggaattgcaccgcatctgctgaatttgccaacaattttgttacgcctggatctgcacaggcattgcggctacggcatcttttgactcgctcatggtagtaacccacatatgctgggataatcagggagtgaccagtagaagtacatcatggttatccccattcctccttgggtgattgtaattcaccttgtaatcggttttggcatcaaataatcagagtattgcgttgttgttgcatgtacagatgtaacagtgtgtgtctggttgactggttcacttcattgtgtatatcaactggcttttttttttaagctctttctcatggataatatggtaatgctgcagcgtgatgtattcaatcttgtttggctcctgtttaactcaaaatcgttgaaaggaccgtgcatcctactttttgggtgcagaagtagtactaggattggtacgcatgcctttgaccaaaaggagggagaggaatcaatggtggatgtacaaaaagatgaacaaatttcggcaggtctgtcgaaatcatcatccatggcggcaaaaatgtgaacactggtctgctgcaacaagtgtctttctgtcggtggatgctgcaagtgtccatcctagtactccataattctgacctagtatactcctatgtttatagggtttataaaaccaaccaaaaccggacatcccttggttttccagttaggttttaaaaaaaccaagctaaaattaaaaggcctctttgaattgcagggttagaaaaaatggaggaatatgaaaaacataggattctgataggaattgaagtgtaaaacagaggattgcaaaacacaggaaaaacacatgaatggtcgtttgattggagcgcagaaaaaacgtaggaataagatgagaaagatagactcaaaggaaatttcccaagaggttagagctcttgctacattttctctacaattcacatgcaatgtgccattccataggaattttataggatttggaaagtttcaatcctttaaatcaaaaggccaaataggaaaatttcctataggatttaaatcctatgaaatttctacataaatcctttgattcaaagggccctaaattgttgacaaaatctgaccggaagtcaacgtttttcatgaaaactgagaaattttttgtcccgttttgctgcctctaacactgcaagtctgcaaccccaaagcttcaaccatgtggccatggcagatgctggcttcactccctgtactacttccatgtactcacaagtcgcagcagcagcagcaattcaccaaatctctctccaagagtagtagtgctccctctcccaaagtagattttgctcatgtaacctcgtagacatttttttatatattttaggactaatagagtactacaataaataagagcatgcttagtagggttttatcaaatttaactctagcaagttgggtctggagtgaaaatggagcagcataaacacattttcacccctctaatgtattttgtgagaactccaaccaattcactctgaatggagctggatttgggctctagttccattgagctgtgccaaagaggtcctaactcctaagggaagagaaagaagctgctaattactcccttttcataatgagcaaagttaactactagaacaggattcagatttaagcataaataatactgtggaactgtactgtactgtatgcagtaatgcactgtccttgctcctgcacaagtgcacaggtcccccacactctcactcagctcagccactctccatgatttcatttcactcccatggtgaaatactgagaaatgaaaaccaggataggactagtagagaggataggagtaggagaggatctctgtgcacttggccccagatttccagaacacacacacacacacacagagctttttgagcttttgagctttgagcccctacaagaaccggccacactctcactttcagtttttttttttcttctcttcaccctctctgcatgcggacaaatcttgcaggctctcgtcgtcgtcgccactcgccgtcactctcttgtccccagttagtctttttcttgcaagtcgctggctttcggtttcttggcaaagcaaaccccccttttcattgcgttttgttgccttctccattgctgccgcatttgagtcacaaccctccaaattgcagtcaagaacacactgccaagaatgcagctaagctgctagcccgaatcttaggagatttctactaacttgttttttcttttttttttttactgagttcattcattcattcacagagaggaagctagggctttgttgttcatcagcaagagagcccccacaccagtttggtcttctcttctgtctctggaccccattgaaatgatggtgtcttcttggctgctccggggagattgattagatggccagggggggtggccattgctgagctttggagtgaagtgaagtggagtgtactctgttcttgtgtgctctcttggtgtgtgtgtgtgtggtggctcttcctcttctcctctccggagagagagagagagagagaggcagcctagatccatttgcaggatgggttccatgaagctaagctccaagccggatgcattcacaaggcgagggcaagcatggtacgggttttctctttgctctctctctctctctgagacaggttcagttttggtttttgtttagggttagtgtcatgtatggatgcttcttggccggataaagaattggtaaatttgatggtcttgtcttcttcttcttgttgtggttagtttgttgggggtgaattaaggaaaaagaacacatttttatggggatttgggaggatagaaatggaaggttgtttccccccttgtttcttgatctagtttatgtgtctaatctggtgtgagtgagcagcttatgctgcttcaatgtgcacattgtgatacttgccaaacaatttgtttgtgttgcttttgaaagctatggggatttcccattctacttttgtgcatttttcctgtcattggtttaccactttagtacctattgtgtccatgagggaggagctcaagatctttggagtaattcaaatctacttactgaaatttgcttgtcaaaattagtttttataggtgtgttggaagttacagatgccatacatgatacatttgcgcgaatgtttgtcaaatgtgaccctctagttgttttaaaaaagacgcttcagtgaataaactgctaaattttaggcataaggacattgtgaagctccagaatttacgagcaatacttatgtcgcatcttgttcacaagtcagatgcctcaagactcatgcctatgctcacctacatacttttttttcgataatggaagctttggggcacctacatactaatcactgatgaactgtgtggttaatattaaatgtaagaaggatttaactattccatcaataacgaagataaggttgactgttttgagtatgtagtgttaaaatgcttggggagggttcctttgtgtctcttgtgcatcatattagtcaaagattctggattttcaaactaatctatcggttcaagttgcattatactcacatgtgccagccaataagctagtatgctggtaggctgatagcacatatttcggtatggtgcatgaaaaatatagtaatatacacgtgacatgatacctcactctgatctcaattggatggttgtacattttttgttgggaaaagatagtgcaagtatctcagtttgaatagtttattgttagcctgcagcaatgttctgattctaatctactggcttatgcaggagctgtactggtttgtttaattaattcatcagcaatctgtatcaaaatatttagcacaatcactctgttttccttttttttttaacaatctatagtttcttaaaagaatctttacaccactgtagcaaatgcattttctcacttggttaacttagactgtatgaggtaaacgattaatgattcgttttactaatcgtcttcttcttgtgatcatcataggtactgcacaacagggcttcccagcgatgttcttgttgaggttggggagatgtctttccaccttcacaaggtaaattgctacacattgtaaatttgtagatgcatgaagcaatatgtacaactttgcttgtgattatggagaattttgaagaaatgagctttaatgaacaaccacaacttactttttgcacccccagttactcaagaaactttgatgaaagttattcttacagtcacagttactggctgattctcaagaggggcaaaaatgcttttataagtgatttttttcctctgtacttggtatgaacttgagatttgaaaatttgtcctttcctctaattgttctttatctgcttgcagttccccctgctttcaaagagtgccatcctgggaagattgattgaggagaattcagacagcgatgaatgtgtcatcatattgtctgacatccctggtggcgcaaaatcattcgagttagtggcaaggttctgttatgggctgaagatagagctgtcttcagaaaatgtcgtctacctacgctgcgctgctgaacatcttgagatgacagaagaaacatctggggataatctgattaatcagacagagtcattctttaaccaagtagtcctccgaagctggaaagattccctggaagcgcttcggacatgtgatggccttctccctcatgctgaagaccttcacattgtgaagagatgcatcgaatcattggctggcaaagctagcatcgatccggacctcttcggctggccagtctcggaacatagtaccatgcaaagccccgggggaagtgtcttgtggaatggcataagcacgggtgcgaaggttaggaactgcagttcggactggtggtatgatgatgcttcctccctgagcttccctacatacaagaggcttatttcttccatggagtcaagaggcatcaaacaggagatcattgcgggttcgctcacatactacgccaagaagtttctcccagggttgaataggcgtcaaagcaccggaccaatgcccctgccggctgctaccctgtctgatgaagaacagaggcgcctgcttgaagagattgataggatgttgccacttcagagaggtttaatatccacaaatgttttgctctggctgctccggaccgccatgatcctgaaagtcgaccgcgcttgcatttcaaacttggagaaaagggtcgggatgcagctggacgaagccacattggaggatctactgctgccaaacttctcatacaccatggacacgctctacaacgtcgagtgcgttcacaggattctcgaccacttcttggcaatggatcagaccatgggtggcggtggcgcctccccatgcttggatgatgtgatggcatctccttcgttggcaccgatcaccgctgtcgcgaagctgattgatggctaccttgcagagattgcacctgatatcaacctaaagccactgaaattccagtctctggcagctgttttacctgaatatgctcggccactggatgacggtctttaccgcgccattgatgtatacctgaaggtacactttcgagccgctattcttgcataaaaaatgccattgcgcgatttcatcctcttcatatgaatgaaagctatagtttctgaatctgatacttctccagtagtccagtgacaaaatgacactctatgtcactgtgtatactatcatcgaattcgcgatagaagttcttgagctgacaattgatcatatcatcataccgaaaagccatgtgccaagtgctaacatgagttcttcagacaagtcatcatttgcacttgtttccattctttcatacctgaaacccacatgaaaattgccatcctcactgtcttgattcttgaacaacgatggcgctgatgtgttcgcttcctctttttttttttttggcagtcgcatccttctgagcccgctattcttgtgtcaaaaacgctattacatggtttcctcctctttatatgaatgaaagctatatctcttgaatccgatacttttctccaaaggcaaaaaatgacactctatatcactatgtgtatactattaccgaattcgcgatagaggttcttgattacagttgatcatatcatatcatactgaaagccatgtgctaagtgctaacataaattcttcagacaagtcatcatttgcatttgtttacacctgaaactagccacacacacaaattgtcagtttgtcatccacactgtcttgattctggatttcttgaacaacaatggcgctgatgttgtttgcttccatttttttttgttggcagtcgcatccgacgctgcctgaagctgaacgggagcagctatgccggctgatcgactgccagaagctgtcgctggaggcgtgcacccacgccgcgcagaacgagcggctgccgctgcgggtggtggtgcaggtgctcttcttcgagcagctgcagctgaggacgtcggtggccggctgcctgctcgtctccgacaacctggaggcctcgtcgaggacgctccgcggcggcggcgcggtggcggcgtccggcgaggccgggtgctgggccacggccgccgtgagggagaaccaggcgctccgggtcggcatggacagcatgcggctgcggctgatggagctcgagcgggagtgctccgacatgcgccaggacatccgcaagctcggccgcggccgccgccgcctccgtggcggtggtggcatcgtcgccggtggcaaggacggcggcgggtgggcagcgcgggtgcagcggatgctgacgccgaggatgatgaagctgcagatgtgcagcgcgcagcatgacgccgccgagcagcagcggatgaacaatgagcacaagaaggtggagaaggtggccaagaacaagaagcagctgtccatggacgacggtgacgacgaggaggaggcctgaaacctgaaagatttcttcttcttcttgttgttgctgcgccatgatcgtgttggtcaaggtgaagtgtcactgagccgaagagggaagagattgatggcgtcatcagtttgtagttagtaaaagtataagtaactctttgagttgactaagtgactagtgagagcgagtgatttacctgtgagactgtgaatgacttctcatctctcaatctttgactctttttctcctgaaagcgtgcatgcagggagtacacagttcttcatttcgaatgactcccattcttattctcccaaattcagatactgcagtatccaatcttatactaagtttttactcccttcaggttaataatattagtcgttttaaacaagggtaaagtcaaactttaaaatatttgactataaataattcctaaaataatatcttaagaatatgaaaactatacgtgtagactagttttaaaaaatacttcaatcatatttgtcaaagttactctttggagaccgtgctcttgtctaaaacgacaagtattattaatctggagggagtatattttaacgtaacaagtagcatgtttacttattatttactcttgtttgttccgataaataggctccctccggtctaaaataagacgtattcaattttttttccgtccatgccaattgcaagagttgggccgagtttagtttcaaactttttcttcaaacttccaactttttcatcacatcaaaaatctactacacacgtaaacttccaacttttccgtcacatcgttccaatttcaatcgaacttccaattttagcgtgaactaaacatacccttggctagattaggccagtcttaacacttcatctcagctagtatccatagcattaaatccactgctacataagtaaaaatctgatgtggtaagagaattaatgagaagaggagtaaatagataaagaaatcatttctcatgcaataacccatctatacacaaaaagtaagaattaaaacaaggtaatatgtaaaaaaatgaaagagaaaagaggtgattgataataatttaatttgatgacactatccatacatagtgctatatgacttagcaagtatggaaactatttcaaagtttatgagttaggattggccttagaaagttatgaaataatgttctaaacattttggagctactagtagccaactatactactactatcttagtcccaaagtaattataattttgtttagcatatattaagttttggaagaaagactatggtgcccctcactaaatggtgtatagataagagtggaaaggtggttgaggatatatcatagaaagttttgaatgagaagtgattaatgtgataattaatacttcactgtgacagctattttaggataaatttgaatcatagaaaattaattatatgagacagagatagtattaaacttgctcttagtagcacaactgcaaaactgtacaaaatcagagaagcctcatcagactttggctttgcttggaagcttaatattacgataatctgctggttggtagttagtttctgaaaatataaaaaagatgggtttttcaacttatggtttctattcattttatggatactatcactatggattattagaatctaaactatctaagagagcctctgattttagaataagctgtagctagcagaaactctccaaatagatccattgttgccttgtatagaactcctactactagaggccagatcgaatccgttggggtggcaatggacggtggatgcagcgcgaaccgcacgccaatcaaagacacacatacatccaagagtcgcgaacccgagaagagagagagagagaggctcatcgccaatccgaccaacgcaaccactccaacccaccggcggcggcggcggcggcggtggggcgcggcgacccggcaccacgcgaccccggcgtcgccatgccgcactcgcgctccgattcggtaagctccccctctctcccctcccacactctccggccggctcgtcgtcggcgtgttagagatagattctagggttcatcggagctcttagatccgcgggttgattggttcttcaccctaagaagaggaggaggtggaggaggaggagatctgctggtactgacgcgatgattttgtttttgcgggtattgtcggtgttcaggggtcgggttcccgcggcgctgacccttgccgtgggaggaagcgcgggaggctgttgatgctcgaggaggaggaggaggaggaggagtcggggatggaggggtgctcggcgccagcatgcggcgatgtgcggggggatttcgttggatggtacagccttcactgatcctttccttatctgattcgtcatcagttttacagttgatcgaccgatattttggccttcgccatctcacatggttggttgtgttgctcaggtgttcggaccggcatcaggtggcttcctgcagcggcgaccagacgcaaagcgccagcatgtttgccgcgatgcaggagaacgcctgctccatcgatagcaaaggtgtggtgtgtccgcagtccgggctagggtattcagctggccagaacgggacgcacggtggtggcgggtctatgctgcatcagaatttggaaggctgcatgtatatgaatcagcttgggcagatgtgcggcccttatccacctgaacaactgtacgatggattatccactggtttcttgcatcgagaccttgctatttatgccgtttttggtgggaaaatggccaaccctgtttccttaggttccctgaaacagtttctttcacaatggagttctgattctgtggtcgccacaagagacgaatcggtggagaataagaaaatggcccctgttaacaaattgattcttcctgatgtatggcttttatttctttccatattagcacatcatcctcttgcttgtctaccttccttatttgtgtgattcatgttctctctgccagaatctttcaagtgaagaatcatgttggatgtttgaggacgcagaaggccgcaggcatgggccacattctcttgctgaactttcttattggcatcacagtagctatctacatgacctttcaatggtaagaaaagcatcagtcgaaaccatgtgttctggatccactcttacgctttgcttgcaaatgttctattttattggactgttaatgtgattaatgtgacgtgcatagtgtttttaaacaagtaatgaaatggctgttgtagaataaattgaagatattgtttcaatttggccctaactaaccactacatgtagaatatcaggctgttcaatgctcttatgtactagatgataaaatagtacaggagatttttacggtgcaccaaattagagtgctgcttggtttggctgtttttctccacaatccattgacactgcaacttgattaagttataatttatttggtttgcgtacactagtattggatactgcagtatacaatacgggcccaatacaatctcgttaccactgaatatcgagtgcatttggaaagtgttactgcaaaagcgatcgcccactcaatccaaacaatatttgttattcctcatcccgtttccattagctgtcagcttaattggaaaatgttacggtgtttcaaccaaacatctatattgagccatccattctatgagatctaatggttagtattactattactatctataagaggtaataaagagtattactattaccatctataagaggtaataaagactttctgaccgcaccataaataatgaaatacatgtaatctttagctggtggaatcatttaagtgatggataataaatgttggtttaacttttatgattcaatttaattatttgacatttaggactagattcgatttgttgtcttcttttttttaaaaaaacctcttgaaacataattcatttattggttttggtagatagcatcacaaaaagaatatttgatgtgattgttcttatacatattgtgattgttcttatacatatctttttccctcctggtggaggaatttttttaaggtatctcaattaagttggaataaatcaataaattaataggctatgtgctgtatggaaatcatttaggttcacccaacttatgggtaaaggctaatatatgattatggtggaacttctgttggttaggtttttttgagtatcttcttgtaacaggatgacagatcagttataacgtgttatgtacacagctcccccaattccagtggatttacatttgtgaattattcttggttcacactagtacatgatctgaacaataacacttctttttttaacagatttaccatgttgatagcaagtttggcccatttacacttgtatcactaattgattggtggagtggaggcacagagcattcagaatcttcagccaatgattctgggtcactgaacgctttaatggatgatgtagttgaagatatcagccatcagctgcatgctggaattatgaaatcagcccgcaaagtttttattgatgaaatatttagcagcgtacttccagaaatgattgcttgcaggaagacagagaagcaaatggctgcaaaacgtaagagccaagctgctaaggtgtgttttatctgtcatggtttttgggacatgaacttcttttgtattacctacccatttgcaaattttaatcctgtccaagatggttttatttttccagactgacaatgtgagtaacaagaatgctttggtacttaagggcaagggtgatggaacatctactcgtccaaaaagcctaaactcgtataataataaagtaccggaagatccttctgtggctgttcaatcaactgcaatgcagtatgaatttgctgatatattatcggcagtttgggaaacaatttataacaaatccatgaagagtatctgggatgaagtactgtatgatcctgtcatggactactgtgatgcatggcttaaaagaaaaaatgagtcgaatcttctctctacagttgttcctggagcctctgataaccaaaagatgcaagacacagatgaaatgtcaccaaaggtttctccaataggactaaacacatttctttctttgaaagatgggtttaacatttaagatgtaaatccttctttcgctgcagatatgattttctgacagtttcatggtttgcaggcaatttgtgattcagatgctcctgaaagtgacatggatttccctccaggatttggaccaaatcaggaatctgctgagcattcccactctgcgtgtgttgagtatgttactgaaaaaacagatgggaggactggatcaagtatcacgttgttttctggccccttaggacgagttcaggtaatgctggcaaatgaactatatgtggcagcaaaggaagctttgttccagcattttgaggaggtcatttcagaggagataacaaactgtttgtgcattggatttgaagatgatattaatcaagtgagatgacaataataactactttttattgatagctgttaatatttcagaatttgcatgatttttacatctaagtgttgtattgcaggaacgaattcgtacgcctgttcacgcaccagaaccatccagtcctcctggaatatctgtgcatgaaacgcccagtcctgctgaaatgcctcgagatgaaatttcggatatggctgaaatggctcgagatgaaatttcagatatggctgtagatacaataccctgccctgctgatatggcggcatctggaacatcaactgttcctgaagtgacaacagacaaactgatcattccttacggtaaatgaataacatcttctgttgcattgccttacctgagcaacattaaattattctaattccttaatttggatgcagtggaacatcaatcgccctctgcatctcatgcaagtatatttgaaaagttggatgcacatgaagaagctgaattggatgacagttttgatgaggtgccttctggaacagaggctggcttagcttcattggtgattatggagaaaaacaaataccagccctcaaaatcagtagactcagtgcttgacatttatagatatactagttgggcattcttcaggcaaatactgcatgagagtgtaatgaaagagtgggcatctctcttctcaggtgctctcagcaattgttttgactcatggtatgccaggaaaaatattgtggctaaaaccatggatgatacattgagacccaaagaatatacttactacaggaagaggaaactgaggaaaaactgtgaagcatcatcatcagaaaaaccaatggatgagcagctctccagacctcttcgtgatcttgttgaatgcaaggttaatatgaaaaatatccatcgatcaagcaaggctgggatttcgcagagagtttctgttgtggagaagccctccaaaaagcgtgccaaaccttcacataatgataatattaatctgaatatccagcaggacttgaaactcctttccgacaaggtgccaaagagtgagtcattcagtcctcatctccatctcctttttaatataaatacatttcacagagtt

SEQ ID NO: 35875 - DNA, 12785 bp, Oryza sativa
agggctcatctgcaagaacaaaccgggttaagctacggaatctgttagcagccgctgaaggcactgacctactaaaaattatgcaatcgaaggtaaaacagtatattttatttgtcaagtgcaaatgtttctattctgtgaaatttgaaatttgaaaatggtatacagtcaaggaagaagcggctacgttttcaaaggagtaagatccatgaatggggtctggtggctcttgagtctattgatgcagaagattttgtaattgaatatgttggtgagctgatccgccgacaggtaattatgacttaatgaacaacgatcccttcattgatttactgcatttgagcaacatgttataagattgatttatatcccacaggtctcggacatacgcgaggatcaatacgagaaaagtggaattggaagcagttaccttttccgtttggacgatgactatgtggtaggtgtagccagtttccttcaactacatccatctaagatgctatgtacatttttttacttcttttttatgttcgcctattagacaacagcagagttagttggtttttgtttgttttgatgtatggtcaggatagttctgttgttttgtaacctcaacctgttctatattgtgctctttctttaccaaattttatgagtgcaccttgtgctcttctgtattaattgtgcctattttcttaatctttgaaggttgatgctactaagcgtggtgggttagcaagattcatcaaccattcttgtgatgtaagctgtttaacatgaaactttcagttgtgatgcttattctatgctaaatgacgtcttgtttttcctaccagccaaattgctatacaaaagtaattactggcgagggccagaagaagattgtcatttatgcaaagaggcgtatatatgctggcgaggaactgacttataattataaatttccactggaggaaaaaaagattccatgccattgtggttcccagaggtaaatctgcttgagatagattttcaagcatgacaaacttgtgccaaaacataatgttgtcttgtcctgaagtagtcactacttaatgagttttagaaagaacagttattttattttatgctatgtctgaagtatgacgtttctatggtatacatacatgccaaatccaattttttttttaaaattaaatgcttagttcgttaccccttttttcataaattttgctaacagcattctgttatatatgtttgaaacgagcttgtaaatgctgttgccaaggttgcatattttatatttaccattgattatctcaactgtggccttggcctagcctagattgctactctcatggtacagcattttgaatctttggagttgcataaacacatttcttgttcattgaatgcaatcacttgtgctattattgatgcaatacatatttttatttacctctcccgctaactattttccggttgtttaggtgccgcggatcaatgaattaggaagtaaagtttataagtcaggtaattgttacagttaatatttgcaatgtaaagctcatagtcatagatgagcattcagatcattccttttcatatgcttggccgtctctcctgatctgagcataaaaaacttgtgttggaaactagaattgttgtttggttcagtaaatttatagtgttcatttttacagtaagcgaaaattctgccaacattaaacaacatatgtaaatttgcctcatatggaccaaaattcgttgaattccttccattgtgtattctgatcacttgttatctttggcaggaggtaactgcaattgggtgctaccccagtatgtatgtgtcatgcgtgcttgtcgattgtactgggcagaagttcactgcagaaatgttcttggatttactgacaggtacctgtgcaatctgcagctcatgctatcattatgcaccaaaagggaaacaaaaactgaaggtcattatttgttgagtaaattgcgctttgggctaggtattcttgccaaagtttcactttggatcacccttaagtgttattttttcactttgggctaggtattgttggcaaatgttaatcagacattttggaccgggtgacccacatgcaaatgagacatggacaacagagatggttagtctcattgacatgtgggccacccagtccaaagtgcaacttttgccaaagaatgttcccaaggcggtccaaattgaaactttggcaagaatacataaccgaaagcacaatttactattgtttgtttctagtgacataagatccctactaggtcgttgcttacttaacatttgctacctaccctaaatagatacactgtatttttcatccaaatttcgctgaaggttagcacctgttgtttgctaagatttttgtggattttatccaaatcaattgaactgaagaaaattgtttaaagattaatatccatacagtgaatttgatcacttgggcatggagaagtgattccagggtttaatatagcgattttgttcaagaacaaaattattgcactcacagttagatttattaaaacaatcatgggtaatggatataaatttacttagatttattaaagcaatcatgagtaatggatataaatttaccttagatttattaaagcgatgtaaatttactgcagaaaccttatgtcggtatctccagttccttcaacatgtgaggactatgagaaaaatgtactgtgcatgacaatacctgatcttctggccaaccttcaatgctgtttcaatcataaaattctgtacggcttgttgactttaaaatgacttcatggagatggagttctttattctttcttttgtccatttttcaggatggtaattgtgtagcaaggtatgggatcgtggaacatactgtactgcaaaaagatcacaaagttgctgagctttctggcgcagaagaatttgaacacgttatttatttaggttagatggactaattcgggctatccagaggaaggtaaagcgctcaagtgtggactgatggacttgttggttgccttagtgtgtctcctgaacgaggttcatgtttacttgctgacaaggttaatactgccccttcttgtacaggccaacaacattattacattgactggattgaggatatagagtttacacggtgatttcttcccgggggtacatttgaatgaacccctggtcattttcaattttttttgaagcatctaattacctgtaaagttaaaataaaccctataccaataccaatgaccataataatatctgtcttccccttttaaaatgtgtgctgtttgcactaaagtaagtcactctgatgccttgccattctgtgaatatagcgaccggattagccatctcgtttgcacataagaaatttgcagtcctgcttcatgggcctcttctgcatgtgccaacatccagagtcaacatgagtgcagtttgggcttctgtttgtatatatatcatttatttataatcatacagtacccaagatgtggttttagtttcagcagggcaagtctactgcttttgagaccattcttgatgagaccatttcattttcaattaatgtcatgctaaatcacacttccatgcaagcagattttacaccacttgtatgctataaatcacacttgtttgtgtgagccaatcaatgttcatggacctactcctgttgttgctgcaggtacatggatacatttaatctatcatccgtggtgtatgtgtatgtatttcgtccagaaaaaaaaaagcatccgaatcatgtggtatgtgttccattactttgcttgtccggattctttaactgttaagtacggggccatgcgcccatgccttttttatttggactgctcatgcattaatcagccacagaattaccattggcaggtcaggtggatacagacgtgcatgaatatctgatatcacaatcgtaagtatgaattcaagtattttaccagcttatatgtactttgtgcaggctaacaacagggcaaaagcaagccactaacaaccaacccgttccaaaaagaaaagaaaaaaaaaacaaaggtcctggattttgttatatcaaccgacagaaaatgaacacattcttagatatgttaattagttagcgagtactatattgttattagcttgtttgcctagtgggaaccgaaggtgcactcgtagaccagcatgatatacgtcgcataatcatcttcagctcaggaggaaactaggcgtctagaccgtcccaagcaaatcaccagtcgataacatcccttccctcactgttttttgcggtttctttattctttttttttttggctatttggaatagctgccacgttttttttggcaacagtgctccttgattggacgagcgaactggctgcacgagagtccacggtaatattgctgttcacctgataccaattgttgctgtatgttagaaaggttttcactgtggaagaatggaagtgtttagagagtgagaaagagaaaagatgcctcacttcatgaccgcagaaaccatatatattaagcactacaattccaacttgggggtacgtaacgtattattggcacaaagctatgaccctttcttcctaagcccaaaatccttggacagaagaacgatgagcccaaatatacttcggtgcagtacttgtttttagagtgggctacaatacattgtcaaattactgttatacaatttaaatttaaaatgtgttttgtacaaagggaaatgccacttatgagccattttcagtgggtcaatagtaaagcggtccaaaaaactgtttaaactaataatggatctgacgaaatagttcaagggtgactagaaaattctctatgtttgtgttagcccatagcatacatgtccagtgagatcacaagtgaatgcttgttactaaattgaaaataaaaggagaaaataataatggaaaagtatggttcatgtgtgtcaataaggtgtcaacggccttgtgctcggtcggaagagcatacaaaggggatatgcatgggatggaggtgaaattccatgctcacctaatcactttttggtggtcggttcgaatccggcaggccgtcatatgcatgcctatatttatgtcattgctaattctgatttgttattattttttcaaagttatccgtaggttatagttaggtcaatagcattcggatagctcattttttattctttttggcgacaaaggacatgtgtaagtaggagtattactcatttcatcccaagatataagatattttgattggatataatacatgatagtactacgaatcttcacagaaatcgaaccaaaatctcttatgttttgaaaggatggactagtcaatagtcgtcgctattgtttcaacaaaaaagaagtctatataattcatgcaatttttgtgcttttgtcttgggaagatgtattgtaaaggcagtcgaaaaagaaggaaaaataagttgcacgttaccaaagcagttctctttttgttgtatgcaagtgtagcgaggccttgtgcaaacagtccgtgcatacaaggcttggttttctacgactttcagcaatgttaacttggagtcaagttttttagaccgcattgtgcacacagctacactgcaatatttttgtttctccggctgattcctgtatctccactgtgtgctctttctaaggatatagaagtagaactattccattcagttcgtaaacggttcgattttcacataatcattctatatataaattccttataaagaactatatattaaatatattttacaactttttaattctagttaatttatccgtttgtgtcgttgaatagttatcacaaaatgattcagctattcccaaaaaaaggctgaatcattgtagtgaaattttcgtatattatatgagcgaaatccagtttttcaaatataatccttgataatataatcctcgataaaggccatgtttaaatttcaaattttccgtcacatcgaacttttctacatatacaaacttccaatttttccgtcacatcattttaatttcttccaactttcaattttagcgtggaactaaacacagcttaaaaaccttctgtttttcaaatattggccgtgccgtgtggcttctcccacaaactgcttactaattttgtacccgtcttcccctcgtaattaacccaaaataaaataaaaacaaacaaaaaaggaaactgatgcaaccgcccggtgccagaatctgctagcctgtctcgtctgtgctgttttacagctgcgaacggtgggcccagggaatattcaatattcaccccagcacgaatcttgacgcccaacagattcaccacagacttgacctggaatcaaggcaggtgcagatctgaatcggacggccgagattccctccggggctgtgtgtggactggtatcaggcagacgaagattcctgaccgttggatctgaatcgaacggccgagattcccgcaggtaaccccccccccctactcatcagctatatatacgcacactcgcagccgcgatctcgctggctaaacctagtcgcaggcgcgcagctaccttcctctgaaatggcagccatggcggaggcggcggccggcggcgaggtgcggcggcgaggggggtgctgcggcggcgggggaggcggcggggggttgttcccggaggagtcgttcgcgagctggggcgcgtacgggagggcgctgatggagacggggccgcggctggtggagcggccgacggcgaggtcggcggcggcggtggaggtgaacgaggtgagggggcggagcggcgcggagatgaagaggaacctgacgtggtgggacctcgcctggttcggcgtcggcgccgtcatcggcgccggcatcttcgtgctcacggggcaggaggccagggacgccgccggccccgccgtcgtgctctcctacgccgtctccggcgtctccgccatgctctccgtcttgtgctacaccgagttcgccatcgagatccccgtcgccggtcagtgatatgatcatctccgcctctgcatgcaatgacgtcaccttttctggatgattatgccttaattatacgacgttgattaatacactatgtaatatccgatttattattcatgtttaatctggtcaggaatacgtcctggtggtggtgaatattcaaacagaataaaggagattgatgaattaattagggcctttttagaacgtgatcgatactctctcacacatgcactgcttctgtaggccattaattaatcgaattaattctcatcaaactttctaattatcagattttttttttgtgttttatccttggagagataaggaaattatgataatactatatattttaaggcggcatgcatctgagtataaaaaagaatgctagatcacaagtaaacactgaaacatttttttatataaagaacaatttttttatgtgagaaactaaattaattatgttactccatccatctcaaaatataagcattttgggactttaacacaattttcgagataatattttgaccaacaatatctataaaaacaagggtgaatagctaatttagtccctcaagttttaccgaaggctcaatttagtccttcacgtttcattttgtaaatcatccttggacccacttaatatgccttatagctatttctagtcaatatttctattagaaaatgtcccttttgcccttaatttgtatacaactataaacccaagatgaataaacaacattacaaatgtacttttcattatttcaacatgtgcacatgaaacataagcaattgctatcgtatacacttgctagtacataatttatttttgttttatataatttactatgcattatctataaaaaaaatttaagcatgcaattttatcttatatatgtgaatgatgagggggtataagtgtcatttatcgagagaattgttggttattgataagtttgaactaaaataaaaacttgaaggactaatatggatagattgaaacatcagggactaaaccgagcctcagataatacttggaggaccaccttagctattcgccctaaaaataatatgttttagatgaaaatggttgcacagtatgatatttttttagtgataaatttagtaacatcaattttacatgattaatctttttttattattaatagttaaagttaaaaatatttgacttagcattatcctaataacgcttatattttggaaatggatggagtaatttattgacacacgatgtgtgtatattatatcactgtgtcacatacgtttgacaggtgggtcgttcgcttacctgcgagtggagctgggcgacttcgtggcgttcatcgccgccggcaacatcctcctcgagtactgcatcggcggcgcggcggtggcgcgcgcgtggacgtcctacttcgccaccctcctcaaccaccgccccaacgacttccgcatccacgccgcctccctcgccgccgactactcccgcctcgaccccatcgccgtcgccgtcatcgccgtcgtctgcgccctctccgtcctcagcaccaaggcctcctcccgcttcaactacgccctctccatcgcccacctcgccgtcctcgtcttcatcgtcaccgccggcctctcaaggtaggggtgcaagagggtttatccgtgaacccgtttatagacaaaaatagtgtaacccgtcgattgaactagcgggttaattatgaatttgatttataaatggatttataaattgatccacttatatatttagatgcggcaagccagaccgcgacgcgaaaacccataaattattatttatttaaacttgcgggtcggtccgtttgcacccctatctccagggccaggctctccaacctcaccgccgacttcgcccccttcggcgcccgcggcgtgttcgcggcgtcggcggtgctcttcttcgcgtacgtggggttcgacgccgtcagcaccatggcggaggagacccgggacccggcgagggacatccccgcggggctcgtcggcgccatggcggtcaccacggcggcgtactgcgccctcgccgccacgctctgcctcatgcagccctaccgcgagatcgaccccgacgcgcccttctccgtcgcgttctccgccgccggcatggggtgggcaaggtacgtggtggcgttcggcgcgctcaaggggatgaccaccgtgctgctcgtcagcgccgtcgggcaggcgaggtacctgacgcacatcgcgagggcgcacatggcgccgccgtgcctcgcccgggtgcacccgaggctggggacgccggtgaacgccacggtggccatgctcgccgcgacggcggccatcgcgctgttcaccgacctcggcgtcctcgccaacctcctctccatctccacgctcttcatcttcatgctcgtcgccgtcgcgctgctcgtccgccgctactacgccaccggcgagacggcgcgcggagaccggaacaggctcgccggctgcctcgccgtgatcgtggcgtcgtcggtcgcgacggcggcgtactgggggctgggcggcgacggcggcgggtgggcggcgtacgcggtggccgtgccggcgtggctcgcggcgacgctgttcctgcagctgagggtgccgatggcgaggacgccggagaagtggggggtgccgctggtgccatggctgccgtcggcgtccatcttcatcaacatcttcctcctcggctccatcgacggcaggtcgttcatgcggttcggggtctggacggcggcgctgctcgcctactacttcttcttcggcctgcacgcctcctacgacaccgccaaggcgctcgccgccgaggtcgccgccggcaaggtggaggaaggcggcagcaagccggcggtcggcggcgccgccggcaactgaaaaaaaagttactattatactattactatccactgaagttatctatgtgtagatagagaattagtaatatttgcattgtcattgttaattatcatcgggattgctaaaattatggcgctacatttttttactttcagttgttttttttcctcgtgtgattgtcatctctcctgtatgtaaatatgatctatcccattatcttttgcggttggttttatagtttaataatagtaatttatgtcatcatgtggcaaattgtggagtgatttatccttttcctttagtttatgttcataagtaatttcatccaaattaaatatcctggtctaaaagctgtgttcggcaatactatcacattgagtagaaagctcactcgttatctgcacgtacgcttcctaacttttaaatggtaaaattattttaaaaaacatattaattaattattcaaatttaaagtaattaatacttaattaataataagctaatgcctagcttatccagttttacatatcttctcctttctcctcttactctaacgtaggcacgtagcactgtagcagaagaattcgcattggtcacatttaggggggaatcgcgagacgaatcttctgagcctaattagtccatgattagttataagtgctatagtaacccatatatgctaatgacggattaattaggctcaaaatattcgactcgtgcttttcaggcgagttatgaaattagttttttcattcgtatccgaaaagccattccgatatacggtcaaatatccgatgtgacacctaaaaattctcttttcgtgaactaaacaggccataaatgaaaaggagaaatttgtgctattggaatttggacctgacgagatcacgagatgaagaaactggacttttgttgtgatagcctatttgaccacattttcctctgatgtgccgtagcgtggaccaaattttgttattgggcctccaggttaggttttgatcctgccggggcctcaatgatgggccatacagttcatgggctcgttataatgggccaagatgtttgtagacagatgctgagcttgaactgttcctttcttcttctttttattttttattttttaaaaacagcttgaactgtttcaggcttgtggtttgtttgatactctttttctggcagaagctttatttccaactagttgtttaccactttacccacgcgctttgcggctggttaaattgaagatagtcgcaataatattatgttgcagctttaataataataataataataataataataataataataataataataatattattattattattattattattattattattattattattattattattattattattattattattattattattattatgttgcaaatccttgcataccctactagtaacagataacatagaatgtgagatacttttagacaatagaaacgtattacatccccgacagcataccgccaataagtttatttgactgtaaatacaggaaatatgatgaccgggaacccttgtcattgcatgcaataaaattagcaagaaccaattcaaggaatataactagctcagtttctttttcataattcaggtcccatcgtattgtagaaatctaatttatatgtggaaatcgaggttaaccagactctcggtctggataagaaaaagacagtgttgggttaaatcctcgttccttttttcccccctaagagaaggcccttgccccctttttttttttaatatattgatagagaaggtcgttctcgttcttggaattctatggtggattgttgggtcacatagtgcgtagctactctgctggaagcttgtgagactctgtgttgcgtgtagttaatggtatggttttgtaaaattttagaaccgtgatactcatatatcaaaaaatttatgattttatacaacttagactataaatagatccaaatatttactaatctcagtttatttttcacacatcctactatcccacgcataccaataaaaaacaaaatacacatattttatccaaatcccgatacaaatatttcgcactttatgcactcccggtaatattttactttccaaacacggatgcaatgattgtggtaaaatctccctttgtcccacaataagttcaggcctggtttagtttccaattttttttccaaaaatatcctatcgaatttttggacacatgcatatagcattaatatatattaaaagaaactaatttcacagttgggggggggggaaaccgcgagacaaaccttttgagcctaattagtccatgattagcataaaatgctacagtaacctacatgtactaatgacggattaattaggctcaaaagattcgtctcgcggtttccaggcgagttatgaaattagtttttcattcatgtccaaaaaccccttttgatatccggccaaacatccgatgtgacatccaaaaaatttcttttcacgaactaaacaggcccttaatttatctccttacatttgtgccgacacaagttcatttttagagtaatcattgcatcagagtttataaaaatatggaatatattaagagtagataaagtgaaaaatagttacattgagatttgataattaaagtatgtattttatatagtctttttgattttgtattggtatgtgtgagatgtatgaaaaataaatttattttgagacggtggcagtactcgctccattccatattataagttgttttggtctttctatccctcgtgtggattaactataaatttagacacatatatgaagcacacacataaattaaattcatgcatgaatccattaaaaatccaaaacgtcttgtagtg

SEQ ID NO: 35876 - DNA, 2460 bp, Oryza sativa
acataaaatactattaatgttttattatctaataataatattattattattaatcataaaaaaaatcaaataaggcggatcgtcaaacgttggatatagaaacccacaactacacttagaatgaacggggagtataatttacttatattataatgatataaatatatttagtaatagtgaattatgggccattttgacggtttcaagtcatgaacagtagtagtgacgttaggcaggagagggtgaggtgtgcaagaggccgggagagacagacacctcggcagccacacacgcggatgcgcccgggcccaccactcccaacgcgtgggccacatccgggccatccaatccaccccagcccatccatccgacggcccagatcacgcgcgctcctccgctttccttttccgaaacgaacccaaaagaaataaaaacaaaaaaaaataattcctctcctcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggtcagtaagcccgccttctccctctcgctttctgttctgctctgctctgctccttttgcttttctggagggaggaagtttgcgaggagaattcccgtttccccctccgaatccgtgaacccacactcgtttccccacggcggcaagaatttcgggtagaattcgacaaacaatatctatccctgtgttgtgcggttcttgtttgcgttggtgaggtttggaaggtgggaggtcaaagggctaagcaatcatcagataatcctgtcttgatatatccggtattcgttaatgattttcacacgagtctgaaaaaaatcttcgcctaccaattgtcgctgtacttttcacacctacaatgagacattaatgttaatgcagtctgaataattttgtcgaaattatagataatggtggaggttatgtgtcactcatcactgtgttgcctcaagtctcaagacctagatatgcatgcacgatccctgcctttcttaaaggactattttatcagctttgttgtagtttgaatggaagttttttttgtgtttaggatcaaatgatgcggtttatgttggttcttaggatcactgaagcttcaattcaactttgttcattggcaggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggtatgtctgtttcatccaccaatgtttgccttgtatatttactcatgtttaaatagtggggtagtgtctggttataaattgtaatcacaacaatgattgctcaactgtaaattccattgggagtgtattgagcacgcatgacggttatggatttttccaagcaaacagtggcatttgtattagcagacagtggcatttacgtggacaattagtaaccaggtatagaaggcaatttgaatttattaaggtatattattattccagatgcagcctgtcacactgaatttatagctggtgggattatggaaatattagttgttccattaagttggcatacactctgcagtgtttagatcaattactacatgtaaaaaggacgtgctgaagtgttgatggaacatccatcgatgcttgctaagtgctggcagatataatttcagttattcccctttttaaaaatggcaatactttaagccttttcatttttgttttctttcctatgtaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatggtacattacatgtattttttcccttttttagttatgagcaagtagtataacttctgttctttcagtttgagccctagtctaaggatatttagccaactgatcatagtgaaatatgggagaaacatggcaggcttgtagaatcactatggagattcaagtttgaatttggatttggattcttgggctgataaccacctcttcatactaaaactaacagatatacagagagaaaaactcttgcatagtggaggaccaatttacttccttttgaggtgaccctcttatgaaaaccatgcatcacaccttgattgtcaaacaggtgcacatgacttccatgacagttataccatatcccatttatactgctatgccacgtttccttgatacgtt

SEQ ID NO: 35877 - DNA, 11938 bp, Oryza sativa
  unsure (1)..(11938): unsure at all n locations
agctgcatgtactttgcgtggggagggtaggccagtatctcatagccttttataacctgatccgtcgcatccggacaaaaaaaaacaattacgtaattctgggtctttgtatgctacttccactctctgttaaaatgtttttgtgatgttccttttttcagatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaaggtaaatcttattagcaccttttacgaaaccatataacatggaatattaattagttatccttttcctgatgcttcattatagttcgagttggtcagaagcacaagtgaacaacaacttgcttcaagtagtcgactaaattctccaatctacatatcccacttccatactaagatcaatctgctctactgtaaatcttatggtgaatatacatccaatcttttatcatgtctagcataccaagtttccaatgtcttctggctattgctcattngtaaacattaaggatctgggaattggataccacacaacaagaaatttgtgtcaaatatggatgtgggnntgatntgctctctatttccatgtaaatttgtaagttcaagctgtgcctttttcacttctttttgtaccaaaataatacaaactcttgttacttggatcactgcattggttctaatcttgacagagtttaaggttggcacctttctgtcagaagttaagttaggacttcacaaaattataccatctctgggtgttcttataggtgtttctcactatcaggaatgtacagttcttgcagctgtcaagttctttgtacctatgtttctgtatcttctaaagattttgattcgtctgcactgtgcagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaagcacctggtgtgaaacatggaaacagttttgtacagtacatgctagtgatcgacaaagaatggtgtcattgggtgttgtaggataatgctccatagagaatatatagacagggcaacagattttgcagcctttggttcggtctgctcagtttctttaccttcttgtacaatgagtagttttcgtcagttgtgctttgtcatggggatagctgaatttcttcagaagtcttgtagttttaaagagttcattagcttgccaattgtttgctttggattggattggtctcttactgcctttgcatcatcatctgcagtgcacagaataaaacattggctatgtgtatgttcatgacaataaaccttaaatgtaggacaagcagtgacttcatctggagcttatctcttctgcacacactccagatgccaaatgatattcccatctttctcttggaatatcatgtattcatgtgatcttaacagctgttatggcaatccatgatcttaggttatgtcttcgcctctttggcttgttgatatgatgcttgcattgcatacctgtaatgcatgttctccattgagttgcctgatgattatgtgagactaagaacatatctctgaacctgattttgataggcctattacaatccaggcatgtcttctccatcatgttgccattacatgagcatatgcttttctcgagaagatggaaattagcagccattaccaagaagaatatactttctcgagaacactgaaacatttaatttgtaccttttctcgcacgagcacatctcgcttttttgcttaaaagaccacacggataaaggataatactgaggaagaaaggataatctgaatctcgactttcttcaaaggttctgaacttactttgaatggtaagggttctgaacttaatgtgaacaattctgaacttctgaatctcaactttcttcaaaggttctgaacttctttgaatggtagggttctgaacttaatgtgaacaattctgaacttctgtttggcttctgggaagctgggcacaaaatttcctctcgtttttctagaaaatagtttctgaactttttctctgaaggatacagtagttctgaacttcttctttgactggttgagttctgaactttgtgtcataaatccagctaatctcaagcatgagctttctgaaaatctgaaccaaaactcgcatgcacaccctctctgtaattgaaaacttttgcagacattggtgacccacgtgattatcttaggcaacactctgtgattatgtcaggtgcttaccaaagtccagacacaacactgccaagtcaccatacttcttctcccttagcacacaagttactaacaaaagcatagatctcctcatccgaatccttaaacaaatcagctcacacataaacatggatatgagatagagagagagatgaacgaattaataatcaattgaggcagaaagcaaatgataatgcttgttaattgggaccctcttctgaagaattatgagtgaggcagagcaggcatgcagacaagaacccagagggtatttgcatatttgcagttgcagaattgccagaatccacacaggttctgtgtgtacgtaccgaacattaatcatgtattcctgcatgtagttatggaatgcaaatttaggtcaatcttataatcatttcttggctagattgatccatctattcagatttaaaaagggcacaaaaaaggaacttgataaagactagttttggatggctaattattcctcatgcattagtttgaatctgcctgcacatgaagcagttttggatggctaattattcttcatccattagcctgaatctgcctgcacatgaagcaatctttgtaacaatctgttcttcaaaatgcaactgaccaatcagaaattgggtgatcaagtgaagtgagcttcagtgttgttactgaatcaagatctagttcatgttaatcttttgatggaacagtgagtgggaggatcaagatgttgatgacaccccccctaaaaagaacacaaaaaggaggaggaggcatgcatgagctacctcctcagagaacagtgaaagggatgcttgacatgctttgcttgcactacaaagccaggccccattcctcctccatggacaagaatagtttttatttatactaccatgcatctctctacggtgggaagcatatttgttgttgtgaagttgtgcgtgcagagttcaaatcttggtgcccacaattaaaaagctatcgtgcatccgtaaccggtgcagaggctggaaattactttcattatctaaaaatgcgatctatatggttctcggtatgattctatcactttgatgtaatcggctgaaatcaataaagcttcattttatcttaaaaatgcaatgtgacttctaactggtgcattttgtttccattatctaactggtgcatctgtaaattgttgtgaaagaacaagccatgcaagaagaaattcaggagagaaggacatggagggatggcaaaagtgacatgagctcttatcatgccatggcagggggacagaaacacaacattggtgtaagacagacagacaggccctttaggcccatttgacctcccacacttacccaatatccatcagaatttttttcggttttagattttttttttttaatatttacagaaataatctatcgaccaaaaaaattgcagaaatagcccctgccgcccacctctggggcggcaagctgacgtggcaaacgggggaggaacgggtggtgacggcgggagggtttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctcttctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgttgatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaagaaacgtccgttacaggccaagtggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatctaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgaacgtgtagaagaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagtttggtgtgttaaggaaaaagatggttgtccctagagagtgcacgcgtataaggggaaatggaaggattattggacagtgtcagttgttaccaagcatacatgttttctacctggtgttcagaaataccataggaacattacatgtgcatttgttgcatctgagatgtatgcgcatgtcatcgataacctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtaaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcagctccatcgaccgccgttgctgaccctcctcaagctcttggacctctcccaacggataatccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgcccgtggactgccactagttggcatagtggagatcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccacaagagagtgaagcaggagtgtgttctcaaagccgatggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcaaagctccgaggcaaggctggaaggaggaggactcgtcacatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggattagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcatggacgtgcggtgagctactcacggttcacgactcctttgtcgagaggtacgaacagtattttactataagttagttgcactgtaatattttttataatgacatattaatttgttattgcaggctacataaggccggcctcctaccgatgtgtcggctggtggaggctgcggctggcgacgcggacccggccagacgatggactgtggacaggtccctcctagcagctttggtcgatcgatggaggccagagacgcacacttttcacttgccgtgcggtgaggtagcccctaccctacaggacgtatcatacttgttggggctaccgctcgcgggagacgctgttgggccagtgaccacggctgtggactggcaggacgatctgacggcacgtttcgcactagtacagcgcgcaccgcaccttccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctataggtggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgacgagaggtcgactaccctacgatgggtactctatggtgccgtcgtcaggtacgttgcatcgatcttatcgtattgttaagttaattgctaagttcattgtacatcacatcgatcgtctcgtattgcagcgccgatgggctcacgtccaagttaggcggtcgtatcctgagtttgttatggagttcgaccgccttctgccgactgacgtcgtgtgggagccctacagtgcagcggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctattcaccggtaagatcttgcactatgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcacaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgtgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagttctcacctgtcgtgcagacaacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcaacaccccgccttcctcggctaggccttctgttgtgcccctcacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccacttgttgccttccaccttcctcttcgacatcactgacttcgacttcgcttcaggctcgacagaggacgtcatcggcccctcacagctgggaggcgcaccgccgttgcagacgcaggaccaggcgcaggccactcctccgcaggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcactatacctttcggcgcatgcacgactactttctgccgcaccgatgcagcctcctttattcgcgtgtgatacgagtatttgcccaccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcaatcacatttagtactctcttccccacttgcttcattacaaatccgaccggctttcgtcaatggctagacgccgaggtgttgaggatccaaactggcgtagcgatccttgtgtatacctactaccaacttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcacatccgaaagtactgagcaatacttacagagaaaagcggcttatgaacgacaatgtcgtgaacaacagagcgattggcgggtgctaactacggcactccctccatgggaagcccgtccaagatgcaggtgtagtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaagcagatgtcaatacaaagaatggatagacaccagaagggttctaactccacctagccatgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccttcctagttcgaatctaatatcatctatgaaccgcaatgcaaatagttgtatcatgttcaaattgtactactatttcttcatgttacataattctccttgtt

SEQ ID NO: 35878 - DNA, 550 bp, Oryza sativa
gcagcccttatccaagacgatgcaaatggcaagaatttgggcgaggagctcaccggcgagagaggagcaacgttggcgatgcggagggagtcgtggcgaggtggtcgcgacggcggggcgggggcgagcaactggcggccggcaacaaaggcgcgggtgtttcgagcgaggcggagacgaaacgagaggggagggcgcgggctttataggcgaggaggagaggtcggtttggaggagggaaaccgacattggcggtcaagggagctcggctggtgttcacgggcggcagcggcggtttcgtgggcagtgagaaagcggcgacggcgtggatgcgttgggcggcgaaggtgatggatcgagcggcggaaatcgaaccgcgggagcgtgggctggcgtggtcaaggagagcgagttggcgcggtcggtcaagcggcgcggaggcagtgacaccggcagtggtcgggaaagggaaaaagaaggggaaaaaggggcttggtcccttgccataatgaggagagggagagtgaggaggaggaggagagggagagca

SEQ ID NO: 35879 - DNA, 542 bp, Oryza sativa
tgagtagcctatatagactactccctccgtttcaggttaccgtttcaggttataagacgttttgactttggccacagttgaactgtttcaagtttgactaagcttgtagataaaataataacattttcaaaccaagacaaatttattatgaaaatatattcaattattgatttaatgaaactaatttgatattataaatattattatatttgtctataaacttagtcaaatttaaagtagtttgactttgaccaaagttaaagcgttttataacctgaaactgaaactgagggagtagtgaataggttaaaattagtgcacttgacttttagagatgtactagcatagttgtgtatttgcgaacgtcttctgtgttaaaaaaaaatcgaacagagtaaagccgtaaaatatatccgaacatataaagtcgacaaatcacgctggagaaattcaaatcttgtcatttttaaagaagaacaatccaagtctcactcgtatagagcagactagcaatatagtcagccgctcctatgacgtaacga

SEQ ID NO: 35880 - DNA, 12612 bp, Oryza sativa
  unsure (1)..(12612): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaatcttcgagaaaaccacgatcaacgaaaatccggtaaccgcaactatacgcaaacaattaaaaacctacacaagacccaaaataaagatcctatttagactaaataatagtgccattagatagatctcaattttatggaattactggaagtggaacgagatcattcggagttacggatcaagagatatgaattttggcaggtcaattggttttctggacaaggaaatgatttatcggaatttttctggaatacgagaaatggtttatggaatttatagaataatattcccaagaatattattgacatttcaatggcatttgggaccaagggaatgaattattggaatccctggattaagaggaaggatttatggaatttggaataaagaattgatttatggaacaagggaaaaatgatttattgagttttctggattaaagaaatgatttattgaatttgtggaaaagaatactcccaagaatattctttaatctctcatagacatgtggggccaatcaaagggtgagggagaggagcaagttggggggggagcaaacatggactttagcttatgactgtggtctcagggtttaggggagggagtacatataaactttgcctgcttttaagaggccgaggaggggatgggccgatgggccaagctcataagcacgggagagagaggaggaggctgactaggtggctgacagggcaggcgtggacttggtcaagcccatgtggactgccatgcaagcgcgagagagagggaggcctggctcgcccagatcggacggctcacggcggccgaggggcaccggcgaacggcggcgaatcggagtgaggcgcggacaccggtggcgagaggaggagatggggaatcggctcaccggcacggattagagagaggagacacgacggcggccggcggtggcggcgaagctcgccggatgtccgacgtggatgcgcgagggaagggccaagaacgcgcggggtcgagcttagccgaaacgattcggcattgcgacgcacacgcgacggcacggagaccgatggttgccggacttgggctcgcggcggagctccgcggcggcggaagggggagagaggagtggagtggccaaggcgatgtcccagggaggcttctagggacacggggagggtgatggcgatgggattcgacgagcggggagccgacagcgacgcacgactgtctgcggcggcggcggaagcagagcatcggcaggggcgcgatttggaggacgaacgcacaaactaccatgtctcagtgctgtttaggagtcgctagaggatgcagacgagaggatttggaccaggagctcaccgacgagcgggaacggcgtcggcaaacggatggcgtcgcggcgagacagtcgcgacggcggggcggcacgacaccgagagggcgcggccggggaacaagaggggagtggtggcgcccggagctcctcgtcatgtgcccacgcacgcaccggttcctccggtgctcggcggcggacggcgacgatgagatcaggtcgagcggcgacaaggcggtgacggtggttcggcggcaatggcgcggtgggtacgaggcgagtgaaaacgagagaggaagggatttggggcggcttgggttttatagtggaggaatgtcggtttgggagggggaaccgacatagagcggtcgagcgctcggccggcggtcacgggcgatgcaagagcggcggacgccgaggatgcaaggagcggcgaaggcggtggatcgggcggctgaaatcgaaccacgggagcgcaggctggcgcggtcaaggtgggggcggcgagctggcgtgcggcgtcagcggtgctctgcctcagcgcgcagagtgacaagggtggagagagaggggtcgagcccgagggaaaaaaggaaaaggggagggtggaaaggaggggttcgaccatgctgctttggggagggagagaaggaggagggcgagctctggctccgtgttttggacgcgagcgcacaggggggggtggggacgacgcggcaacagggcacgggcggcgaccgagcggcatggcgcgcgcgcacggagcggctgggcgtggccgaatttcgaatggcggcggcgggaagtcagcgccggtgggggagcttctacgggagagagagagaaacggagagagagagagagagggagcgaggatgagaagagagtgggcgatctctctctcgagcgcggcgcacgcgcaacacacgtgcggagagaggggaggggaggaacggctgagagaggagatgggccgaggggagggggatcaggcccatccaaaattagaaggaggcaaaatagacttctgcagagagatgatttggaagggatttggatttggaatgaaatttcgaatatgattacttggactcggggaaacagggaggagtcaaggaatggattcaaggtggactcggtatttttggaatcgggacaagtgtttggcgaggattcaaaggaggcgattgaatttcggaatttgatttcggagacttgaattggaagaggaatttcgatgaggatgattttgatggcgacgagagggatcaaggacggatttaaactgagatccacggcacgacttagactcagcactcaaagaacgaaattttcgcaattaggattttgccgaattagtttttaacgcctcacgaaaagcggagcgttacaactgggtagtggtagttgcccaccacggcggtcgttggtgagaatcgcccacggtagcttccgcaacacctcctacgtgaccatggccatgactgtcaaagaaggagaggtgatgctgagccatctcaatttgaagtaaaggggaaagggatttgagggaaggcgttggagtgtcaacctttgtaaggacgacgctcgatctcctgaatttggcgctgcagctcgacctcagcgatgaggtagcacagcatgagctcgacaacgaggcggtccaacccatccctcttcctcgtccatccaatccttctctactaccacatatagtcacccctcctcttcggccaaccaccaccattgccgccttcctagacatgagttgacgagctcgagctcccaaattccctcgcctccattctctcctcctccgctacaccaatggattcccctccccgtcggccactcaccactgctgccacctcccacggaagggctagcaagcttgagctcgccagagccaccactgctgactcctcgtcaggacttgggagaaatggaggagaggagaggagaggggtcgggaaggaaccattttttttaattcttttttctaattggagtgcgacataagcaccttgtagacgccacgtcgagtgaagactggatcaatgcgtccaataggtgccacgtcaaccgaagttgttgtctatactactgagcgattcaatctgcaccagttagggactctctatttctaattctgtggttaagagatatgaatagaactcgtctcacagttgagatatctaaagtggaccttttccaattaaggtttaagaaaaaaaaacttatttgtaacgggtgtagtcccaaatttctaatggtttgtaaccagtgttacaggcgatgggttagtgcttcgagtccaaatctctaatagtttctcaactgttagagattaatatatatcaatcgagaatttttacgatgtttgcaagctacgtagagatgttgggaggtggagactattgattaatagatgggtaaggtactaaataaattaacggtttcgctattccacttacgattgatttttgagcttcagtatcgatttttcgttcgtaggttcttgcatcaagatttgtgtttaggtagatcttgcagttacagctcaacgctttcaagcttgacactatggtcgcggtttatttttataatagattggtcactgtcaattcatgaaataagtttttcaaaaggattaaattgtcaaaattttagaagcatataattctgagcccattctcactcacgcaccaactcccatacctcactaaaatcctattgcactgtcaattctttttaatattagtttgcatttaaatttttaaatcctaatggttagaagtgtgcgcctatgactctactacgagcacaccaacggtgcttatccccaaagcacaacttagatcatttttaaaaagaattatatctataattaaacaacacaagttattaaaaagagatgccataatgtcaattatagtaatatagctttcatgtgtccaattttgctgatggcaattgataaaaactttagatctctaaccccacaccaattataaagtgtggaataaaaagaatgacagtactctgatagttgtggttgtaggtgcatagctccatccattaaaggttcaaattcttgtcttcataaatataatggagggtaattataagttggtgcagagactaaaaattatattttctttgttatgaaaaaaaaaagagtttaggaaagaagcatacagctaattcggagcaatttgcactcaatatggatttgctgaaacactaaagtacagacttaccttcttcagaaaaaaacttaattaaacaattccactggcaaggttagctggttaggtaagagctggaatatctcagttactatcagtgggcgagctggtcgtacgagccggaggcaacagcgttggctgctgatttcttttcaccgctgcgttgctatcatcaagttgggctgtccaccagaccaccaccactcagcatcgcgtagccgattctgtctttgacctctgttattaatttaaattgttttttgctcccctctgaccagcacagcgtctagctacactggtttcaactttcaactcattcttttgtatacaaaaatacggcaaattttgtcatgatccgatcagagctcacgtacgtacgtacgcgcttgataacatcaccagaaattcagaattaattcagaaaggacgcacgcgtgcacagtttaggaatgtgcttcagttgcttgttcgtgtgcaagagtggacaacactatatatgttgccccgtacctttcgatcaagctgtttttaatatcccgatctggactgttgctggtgcagggcaacattttcttctatgaagatgtgacttggctgctgctgctaggggccggagaaccgagaatctgtggtttctgtactcgactggtgatttctttggcgatggttttctgtcaccaacagggagctaggtggagttttgtccttgagaggaccgctactcggtttttacatattacaaaatgttatatttttttcttaaaagaatgacaagatatttagtatattatacatctttacaaacatgtaacttcatattccatctatatgttatcttatcttaactactttaaaaaaatgataaatttccaaacatcacattgtttttcgtttgttcgtccgcttagtacgcgcgatccgattttcttagtgtactggaaaaaaatacccgtgcgttgcaacgggtgaaggctattttaatcatgttattgttatgctagaaaaatgcacgtgcttcgttatgggtaaaggaacagttaaatgctataaagtctagagttaacatgtatatagtaatgtttcaagatagataaattattcattaggctaatgataatcacgatggataaaaacacacactctctctcaacccttgtgtgacaaactgtgatatcattgcactggtaatggttaggtgaatgaaatttaacctcaatgatttatcgaagcaccttcatagttatcacaagtgcatatttgtgcttggacaattaatccgctctacgcgtgtaggatgtgaataatgtccctaacacatggtcccaatgattgtagcattggagaaacggacgtccgagcaatgcacctttacgtataagtaaataatgaatattttgggagttcattaattattttaaactacatttttatggcacttttataatcttttttcataattgataattgcaataacattgcattgatttataatcacaatgcaacagtatacagctatgctctaacctacaaaacctgaacagtgccagccgtaccatgccgttcctttttcttttgtagaaaacctcttagcgtatgattaattgagttttattattacaaaaattaagaaaaaatatctagtattttatatcaacttgtatatagaaagtttaaaaaacgcgctaacaaagaccgagatagaaggaaaggatgcatggtgtgaagtttcacaccatgcacatattcaattttcatgttttaaaaaaatatcggttggttcacgtgtttatactgatttttttatataatataattataagatttcagaatcactaaaagtctgttgaagaaagaggtgctgaacttttgatttttcatccatcggatgtgcatggtccgtgctagtggttgagagaaaaaaaaatacacgcaaatatgatttgagagagggaaggaaagtagacttattctagggcctaggtaaacatatatttatattgatttttgtgtacataatctaattatttttaattttcgaattaaaaactaattcattagaagataagatttcataataaataaaaatctgtatgatttgagagagggaaggaaagtagacttattctagggcctaggtaaacatatatttatattgatttttgtgtacataatttaattatttttaattttcgaattaaaaactaattcattataagataagatttcataataaataaaaatctgttgaaaaaagagaaaaaaaatcgaaggcaaatataatttgacatgagggaagcaaactgtgcaagtaataatagatgtacaaatgagagaaaaatgggagtcgaacccgtgtggccgaaatgaaaactttcatccctcaccaagtgggcagactactacatgtgagaagtgattacatggcaagtacatatcccgtatcaaacgtggctttggagtatgataaaaaaatgcccgatcggactgttaaccggattaaatccggatttagcgaagcgcgtggtaatgacggacgaaaaaaacacccggaaactttacatattttttaattactagcaaaaatgcccgtgcgttgcaacgggtgaaaaaattctaatgataatatacgtttttcataaataatcatgtcaatgacaatgtttgtattttaatgagcggcttgttttttacaaacggtgtttttttcttgcgcgattttctcaaaccattcagaaatgacgcatttctttctaaaagatttttctaacatgatctttttgcttttttatttacaatgaaaaccatatttttctccattttttgcttttcttttctcgtgtgttttttgcctttttttgccaattattttctcgcgtgtttttttgcttgtttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctaacagttttttccttgcatgttttatttttttaaaaaagttaccgatgatggaaataattttcctcgcgcgtttttttatttatttatggaagatggaaaacctttttagcgagtttttttcgctttttctgacttttttctcacgcgtttgtttgaaccgtttctattctctcgtgcattttttttaaaaaatagttagattatattagagatagagaagagatatatattgattagaaatttcgccctttccatttttttcctgtgtgcattttttattttatacgaacaagcgttttattttttacgaaccatttttttcgccactttcttatggaatcgaacaaacttttttagattttttttctgttttttttcgcctttataggaatccgactttttttcctgtttttaacggaatcgaatctagtatttttttttcacttttttttgccttttataggaatcagattttttttcgttcggatctacgcttttttttttgccacataggggaaacggaacttttgttgttgttgtttttcttttttttttcagctttcctttttctttttatgcacctttctgtttttggactctcttttattattatttttaacaaaaacggcctcaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttctgtttctgagagggaatcggataggagtccgacctttttttttaacttttttttttacagacgaaggaaacatcttttattattttttaagtagtacagacagagacagatatagagattttttttcgcttttttgacatggaatcagattattttttcgccctttttttgggatcagacatttacggttttttttctcgctcgtccgtttttttggggcggtttttttgtcgccctttttcacagaatcggacttttttttttgcccttttttattggacagttacggtttttttcgccggttttttgtcgccctttttttcacggaatcgaattatttttttcgccggacagttatggttttttttgcccggtttttttcctcgctcgcccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttcaaaggcggttaatttttttccgtgttgaatagaaataggacttttttttttgcatttttctgccctttttttaaattttatggtacgataggaataggaatcagatgattttttggggcgcttctttttttttttttgccttttttacgttttttttgccgcgtcggaatcggtctttttttgccgctttttttttctcgccgccctttttttcacccttcctattttttttcgcgctggccttttttttttttacagtcggactttttttacacggacgaaggaaacactttgtatttttaacagttccggtttttttcatccggtttttttcgacggttttttgtcgccatttttttcacagaatcgaattatttttttcgccggacagttatggttttttttggcccggtttttttcctcgctcgccctgttttggtttttttcctcgctcgcccggttttttttcgccggtttttttgacggacgatggaagcatctcttattttttaagtagtagagactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgcataattaaataaatttacaagtaaagcaagtgtgagaaataaaatgacatggttaaatttaatttttttttaaattctccatgattagttacgctctttgaaattatatttgaatttttcagagcttaattgttaattttattaatacaaacgtcatttaacaattatttacttggaaaaaagaaagaaaatacttccttttaggtttgcttcgaaatgaacacattcaataacttataattgtaatgcttctgaaaaaatgagcactaaaaagaaacttattctctttttttggcctgagggacctaaaatagacttatttccggcccttgccggtcggtccacggccttttgtgcacgcgcaagtgcacttcccatcccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagctgccgaaactctagcccatttccctccctcccatctcacatcgccgccctcccctccgcgcccccgagcggcggcgacggcgcccctcttcccgcgagcggcggcggcggcgccctcccccacaaccaacggcgcggcgccctctccccgaacaacggcggcgtggaggcggctgcggcccggcgggagcgggaggggcggcgggccggacctcgcctccgccagatctggcggcatggaagcggctgtggtccggcgagggcaggagaggcggcggcgtcgtctctttctctctctctctctgcatggtggggaggtgcggcagtggtggtggtggcggacgtcatggaacgccggtcgggcctcgcctccgccagatccgacggtgtggaggcagttgcagcccggcgggggtgggaggggcggcgggccggacctcgcctccgccagatttggcggcatggaggcggctgcggtccgacgggggcgggagaggtggcggcgtcgtctctttctctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtagtagtagattaggtatatatatatagaggtatagattttgtcatcgcgctcatgtacgtctagaagtctaggtccgtccggagtaggccatgagtccagctccgtccacaagcccaacctacgtcctggagtgcagatctgtctacgtcgtctcctactccgctctttttcacgggattttacagatatcacttgctaggcaaaatatacaaatatgggcgcatgcaagccaaacattacatatcggaacatacaaatagtagaaacacacaagaaaaaacatatcgcagcacaagacaaaacaaaccgcaaggctctttctttatgacgtcagtttaccttcgatcagtatcgatttcacgttatcattcaactgaactctaaatgcagttacaagtacattagatttatataagtcaagacattctattagatttataattacttagtgtccacacaagctagaattactgtttgcataaatcagtattaatagttaaaataacattatgggaagggttatgaaataactaatacaaatagaagaaaaataaatttaactacatattgtttatagtcaaatttgtttttcccctacttatatgtgttacatttaaacatacatgtttatggagtaatatatattaaattaatttatactattattttcttaaaagcatttttatatgacatgtaaaaatgaggaacagacttcccaccaaacactataattgttgcttactccctccgtccaaaagaaaattaatttaggactggatgtgatatattctaatacaataaatcagaataggatgtatcacatttaatattatgttggttttttatgggacgaacatagcagtagtttgtttagaaggacgagtagaacgatgcagaaaggaaaatgctcatctgcactgcactgcaggggtggcggcttcttgccttcttgttgtgtactactagcaggctagcagcagtagtactttgaccaggcagagacgacattatgaaactcatatgtcgtttgccgcgctatatgaagccagctcggcgtgcaccagttcgccgcggacaaggaggagccacggacaaggaggagctagctagtgaaataggtgtgttccgtgcatggcggccaccgcggcttccacgatgtccgcagcggcggcagtgactcgccggatcaacgctgccttcgcgtggacgccaccagcggtgacgtcgcggccggcgccgacgggcagaacgggcgccggtcgcccgtggccaagcgggtgaacgacggcggtggcggcaaggatgacgtgtggg

SEQ ID NO: 35881 - DNA, 6377 bp, Oryza sativa
cttcctgcaggcaacacactatactcgagctatgtattttttgtcctctcttttatcaaacttgcagcaactaggagtatgatagtgttggtgataaagaaaccgtgggcatagaaatcactactctctcaccaaaattctctaattctaggtagcaataatttggtacggagaaagtaaaatgctcagcttgcgctagtgtggtggtctggtggaggccgtatagtagcaatagtagcaaattgacttggtaggtagacatgtcattatttagggtgaagcttaaaattctaataattaactagttggtagttattttctaatttatattgttggattcatagaattttaaaaaataatgtttaaaagagattctgattttagaagaagcagtacagtagttgcaagaagctctcaaacagacccatgaaactcatgttgtttgcggcgctacataaaggcataaagcccccttggcgtgaaataatttgccatggacaaggaggggctagctaactaggtgcattgcatgcttggcggcggccaccacggcttccacgatgtccgcggcggcagcggtgacaagctggactaacggatgctggtcgcccgcggctacgcgggtgaacgacggcggcaaggacgatgtgtgggtggccgtcgacgaagcggacgtgtcgggggcccgcggcagcgacggcggcggccggccgccgctgttccagacgtacaaggtcaagggcagcatccttcatccttacaggttcttgatcctggcgcgactgatcgccatcgtcgccttcttcgcgtggcgcatacgtcacaagaaccgcgacggcgcgtggctgtggacaatgtccatggtcggcgacgtctggttcggcttctcgtgggtgctcaaccagctcccgaagctgagccccatcaagcgcgtcccggacctcgccgccctcgccgaccggcactccggcgacctacccggcgtcgacgtcttcgtcaccaccgtcgaccccgtcgacgagccgatactctacaccgtgaacaccatcctctccatcctcgccgccgactacccggtggacaggtacgcttgctacctgtccgacgacggcgggacgctggtccactacgaggccatggtggaggtcgccaagttcgccgagctgtgggtgcccttctgccggaagcactgcgtcgagccgaggtcgccggagaactacttcgcgatgaagacgcaggcgtacaaaggcggcgtccccggcgagctgatgagcgatcaccggcgtgtgcggcgagagtacgaggagttcaaggtcaggatcgactccctctcgagcaccattcgccagcgatcagatgtgtacaacgccaaacatgccggcgaaaatgcgacatggatggctgatggcacacattggcccggcacatggtttgagccggctgacaaccaccagagagggaaacatgctggaattgttcaggtatttgcgcactatacatgtttaatttctgtttccaatcttgtccgggcaaattgtatcagagtgaatggtttttgtgtgtttttgataggttttactgaaccatccaagctgtaaaccgaggcttggattggcggcgagtgctgagaatccggttgatttcagcggtgtcgacgtgcggctccccatgctggtgtacatctcgcgcgagaagcggcccggatacaaccaccagaagaaggccggcgccatgaacgtgatgctccgcgtgtccgcgctgctgtcgaacgcgccgttcgtcatcaacttcgacggcgaccactacgtcaacaactcgcaggcgttcagggcgccgatgtgcttcatgctcgacggccgcggccgcggcggcgagaacacggcgttcgtccagttcccgcagcggttcgacgacgttgacccgacggaccggtacgcgaaccataaccgcgtcttcttcgacggcaccatgctctccctcaacggcctccaggggccctcctacctcggcaccggcaccatgttccgccgcgtcgcgctctacggcgtggagccgccgcgctggggagcggcggcgagccagatcaaggctatggacatcgccaacaagttcggcagctcgacgtcgttcgtcggcacgatgctggacggcgccaaccaagaacggtcgatcacgccgctggcggtgctcgacgagtcggtcgccggcgacctcgccgccctgacggcgtgcgcgtatgaggacgggacgtcatgggggagagacgtcgggtgggtgtacaacatcgcgacggaggacgtggtgaccgggttccgcatgcaccggcaggggtggcgctccgtatacgcctcagtggagcccgccgcgttccgcggcacggcgccgatcaacctcaccgagcgcctctaccagatcctccggtggtcgggcggctcgctggagatgttcttctcccacagcaacgcgctcctcgccggccgccgcctccacccgctgcagcgcgtcgcctacctcaatatgtccacctacccgatcgtgaccgtgttcatcttcttctacaacctcttcccggtgatgtggctcatctccgagcagtattacatccagcggccgttcggcgagtacctcctctacctcgtcgccgtcatcgccatgatccacgtgatcggcatgttcgaggtgaagtgggctggcatcacgctgctcgactggtgccgcaacgagcagttctacatgatcggctccacgggggtgtacccgacggcggtgctgtacatggcgctcaagctcgtcaccgggaagggcatctacttccggctcacgtcgaagcagacgacggccagctccggcgacaagttcgccgacctgtacaccgtgcggtgggtgccgctgctgatcccgaccatcgtcatcattgtcgtgaacgtcgccgccgtcggggtggcggtcggcaaggcggcggcgtgggggccgctcaccgagccggggtggctcgccgtgctcgggatggtgttcaacgtgtggatcctggtgctcctctacccgttcgcgctcggggtcatgggtcaatgggggaagcggccggccgtgctgttcgtggcgatggcgatggccgtcgccgccgtggcggccatgtacgtcgccttcggtgcaccgtaccaagctgagttgtcaggtgttgctgcttctctcggtaaagtggcggcggcatcgctgactgggccatctgggtagggacggttcgggtttgaatttgatttgagtatttgatgattttcttgtgcaataatctggttgttacttctattatgttgttacgtcatgagagcggctgattatgctagtctgctctatccgtgtgagacttgaattgttcttcttgaaaaatgacaacatttgaatttctccggtgtgatatgttgactttatatgctcggatatcttttacgacatatattactttatttggattcttaacacgttgacttttttttcgctaaaaggcatttagcttagtggttgcagtgatctgagtagcaccccaagatcctgagttcaaatatccataagagcgaatttcaagtttggttgtttaccaatttaaaaagatgcatatatccgattggatacaaatgttgggtaaatattaccattctataaaaattgtactctctttttaaataatgtttaacattgttgattttttaacttacatacgaccattcatcgttttaaaaaacatttattacttatctttttatgatttgtctcatcactacaatactttaattatgacttctatttttcatatttgtatagttttctaaataagataaataatcaaaggtaacttaaaaaattaacggtgctaactatatagaaatatggagggagaacaacactttgcaagaaatcctaaaagccaagtgaactacttttagcttaaggttgtgtttagatccaaagtttggatccaaatttcagtccttttccatcacatcaacctgtcatacacacacaacttttcagtcacatcatctccaatttcaaccaaaatccaaacttcgtactgaactaaacacagcctaagttcaattctagcatatttgtagtctatgctactctgccactagggtgatattttaattgttcttttaaaaatatgaagacttgaatttgtccagtgtgcatatcttgacgctaaattctcggagaccttttacagtattactcattaaacgaaagacgttcacacatccaccaccatacatgcagatctaaaagtcaagtgcgctaattttagcttacgttcaattctaacatacttgctattctgtgctactcggccccttgggtgatacttgaatttttcttttactagaaaatatgcccatgcgttgtaacggatgaatactattttaatcttattattattattgttatacggtttaactagggtgaagtttgatgtgggaattcgctttgataaattttttttagaaaatcatgagctgcaattaggagtctgactttaatctcaagttagcgtacaagtttttttagagattttcttgtacgattcattttatatttccaaaaacaaacgaactctggtgacaaacgaaattttttagagattttcttgtacgactttaatctcaggtgaaggagagccaatgctgttttcttcagaactccggtgttctcccctgaaaccgtttgaacgcagagtgagcagggtgaaagctgtccctagtggtggtgtgtagttttgtgatttttcctctcgaagcttcacttcatttcctttctcatctactatacatatacattggtggaatgggccctattgggctgaaatacacacgcctacactcaacactccccctcaagatgggcgataaatatctatcatgcccatcttgctacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatgaaagtgcttgtcgacagcttcaattcagccaaaagatttttcaaccataacaattcactcaagctcatcgacattgacctgtattccgcctcagcagtcgagcgagacacaactgattgtttcttgctcctccaagataccaaattgccaccaataaatacacagtagcctgatgttgacctcctatcatcaagacaactgccccaatctgcatcacaatatccctccacatctaggtgtccattcttcttgaaccatatgcctttacctgggcttgccttcaaatatctcaaaattctatacacaacatccatgtgaccacttctaggatcatgcatgtatcggctcaccacactcacagcataagttatatcaggtcttgtgtgacacaaatatatcaaccttcccacaagtctttgatatctctttttattaactggatctccagattcagcacataacttatgattttgttcaattggtgtagaagctggccgacatccaagcatacctgtatcactgagcagatccaatacatactttcgctgcgaaagaactattcctctaggagatcttgcaatttcaatacccaaaaaatattttaattggcccagatccttgacctcaaactccttgcttagattttgtttcaacctagatatctccaagcaatcatctccagtgataatcatgtcatcaacatacacaacaagaatagttttaagacctctattatggcgatagaaaactgtgtggtctccattgcactgtttataacccataccacacattgcacgtctaaagcgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgctcatctttgctactggtgcaaaagtttcatcataatcaattccatatgtttgactatatcccttagccacaagccttgccttgtatctttccacatttccattaggattttgctttactgtataaacccatttacagttaaccactttcttccctttagggaatggtacaaggtcccatgttttgttcttttcaagagaatctagctcctctagcatagct

SEQ ID NO: 35882 - DNA, 8635 bp, Oryza sativa
ggcatcacggtgctggactggtgccgcaacgagcagttctacatgatcggctccacaggggtgtacccgcggcgggtgctgtacatggcgctcaagctcgtcaccgggaagggcatctacttcaggctcacgtcgaagcagacgacggccagctccggcgacaagttcgccgacctgtacaccgtgcggtgggtgccgctgctgataccgaccatcgtcatcattgtcgtgaacgtcgccgccgtcggggtggcggtcggcaaggcggcggcgtgggggccgctcaccgagccggggtggctcgccgtgctcgggatggtgttcaacgtgtggatcctggtgctcctctacccgttcgcgctcggggtcatgggtcaatgggggaagcggccggccgtgctgttcgtggcgatggcgatggccgtcgccgccgtggcggccatgtacgtcgccttcggtgcaccgtaccaagctgagttgtcaggtggtgctgcttctctcggaaaagcggcggcgtcgctgaccgggccatccgggtagggacagttcgatcgcgtttgatttgatttgaatatttgattattttcttggtgcaataattggttgttacttctgttatgtcgttacgtcataggagcggctgactatattgctagtctgctctatacgagtgagacttggattgttcttctttaaaaatgacaagatttgaatttctccagcgtgatttgtcgactttatatgttcggatatattttacggctttactctgttcgatttttttttaacacagaagacgttcgcaaatacacaactatgctagtacatctctaaaagtcaagtgcactaattttaacctattcactactccctcagtttcagtttcaggttataaaacgctttaactttggtcaaagtcaaactactttaaatttgactaagtttatagacaaatataataatatttataatatcaaattagtttcattaaatcaataattgaatatattttcataataaatttgtcttggtttgaaaatgttattattttatctacaagcttagtcaaacttgaaacagttcaactgtggccaaagtcaaaacgtcttataacctgaaacggtaacctgaaacggagggagtagtctatataggctactcagctacttgggtgatacttgaatttttgttttgaaattacgatgatttgaatttgttcgacatgacattttgactctaattaagttctcttaaataactttttattgaatttttgcatttaaagttttttaattatgcagaagatgagagcacatggacatattagtgttggtgaatagtaatatattggttgtaaaaagggcaaaagatctaatatatgagtgggaaacctcttacctcagaagctagattttagggtaattaaaaagactatttacgatcctacgagtatatgtaactatatatgcactaattttaactttgcacccaagtactacactaattttaactttacacccaacaaatggaggtcaagtataaatcttttatcatcttcagaaattagaactataatagttaatctaaggggttgtttggtttacttccgaagattgtcgcatctcatattagacaaatttgatcaagttagctcattatttaattcatggtcgcacttatgacaagatgccctttcattttttatgctgtcacgtgttatcaactaaaaaaagtgtccttttcttttgctagctaaagtggcttatttttgttagccataactcaggtgtaacatcctgtctctcccagccggcccacttacatctgatatcttttataggtcatagactgccctcccaacacaactccaggccaagcacgcttaacctctattggtatttaatacggacactgataaaatccgcaagcgtacggatataccgatgtagcactttccctacggagtattataagggtatcgaatccaagaaaacgtgtgtggtcaaatcttcctctggttcatccaaggataccaagcaaaagataggccaggatagagaggatttactagtgagaaacagtgtctagggaaagcttaactttaatcctaatgcaatacttcaggcactggcaacccgctgttcccagatgtcgctttactacgtacccagacagggaggacttaagtgatctgtaacgctccgcttttcgtgagtcgttaaaaactaactcggcaaaatcctaattgcgaaaattttcgttctttgtgtgagagtctaagttgtgccaaggatcccaatttaatcccgttgttccctctcatcgaaatcaaaatcctccccctcatccaaattcctcttccgattcgagtatctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgactcctccttgagtttcccttaatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccatcgccgagagaaggatctctctctctctccctctttctttctctctctcgttttctcgctccctctctgtttccctctcgcgccgacaccgcttcccgctgtcgcggcccaaaacctccaccgccttcgcccattcccgcgctcgcctcgcgaggtggccgaccggccggtcgccgccgacgccatgcgctgccgccttgcccccgctccatgccaaaccgaccgccgccgtcatcgtcgacgtcatccatggcccccgccactccacgccgcacccgtccaagagtgggagaagcagctgctctccctctcctcctcctcctcactctccctctcctcattatggcaagggaccaagcccctttttccccttctttttccctttcccgaccactgccggtgtcactgcctccgcgccgcttgaccgaccgcgccaactcgctctccttgaccacgccagcccacgctcccgcggttcgatttccgccgctcgatccatcaccttcgccgcccaacgcatccacgccgtcgccgctttctcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtctccgcctcgctcgaaacacccgcgcctttgttgccggccgccagttgctcgcccccgccccgccgtcgcgaccacctcgccacgactccctccgcatcgccaacgttgctcctctctcgccggtgagctcctcgcccaaattcttgccatttgcatcgtcttggataagccccgagccgttcggttgctcgctcgtccccctaaacgtgccgccccgccgttgctctgcttcgccgccgccgcgcccgactgtgcaccgccatgggccccctcgccaatccctcgcgccaccaccgtccttgagctccctaggacctccccaaaccattccctagcgccgtcgccgcccggcacggcctcgccgccattgccgcccgctcccaaagaccgtctctcgtcgccagccaatctcggtgccgctccgtccaatccgacgccggaaacggattccttgaaccccggagatgctcccacccctttgaatcgaaccctcgtcgtctcgtcatgttttccccttttgctctccagtgattgccgccgccgcaatccaccgtcgtcggctcctctcgcgtcgattcctctcgccgccacgctcccggggatccccatgacctccccctggctgccccaaggccgtcggccttctcctttgtctccggccgtgtcgccgcttccgccgctgcctaacgccgccgcgcgtgcgtcgccggtgaccatcgggtcccgcgtccccgcgtgcgcatcgcggtcgcgtaccgtttcggctaggcccgagtccgcgcccccttgtcccttccctcgcgtgaccacatccccgatccgacgagcttggtcgccgtcgccagccaccgtcgtacctctcctctcaaatccgtgccgttaaacggattccccctgacctcctctagctgccggcggtggccgctcgctccggttcgccgccgctcgccggaacgcctcgcgcgtcgtcggccgtgcgatcccgggcgcctccttctacttcttctcctcccctttggctcctgcccgcgtggccgaccacatggcagccacctcagccccgggcccgcttgactgggtcaagtcgcgcccagtcagcctcctccctccgtcttccctcccgtgcgcgcggtccacgacaagccgtgcggctgcacgtgggcccgccgccatcagtccacccggcgcgccgcgcccgaaccgcgcgcaaccgaaaccctagcgcccgcccccgcgtgcgcccttcccaccgtgaacctaaccaccgccatgtgggtcccgcgcggtggaccgcgcccaccccgtcgtgcctccctctctccccgcgcgccctaatgggctgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagatctatttaatggcactactaataggtctaaataggatctttcttttggtctcttgtttaggttttcgattgtttgtgtatagttgcggttatcggattttcgtcgatcgcgggttttctcgaagattcgtgaagcttcgagaagaccttgagcaaggcaagtcaccctttgatcaatcgcccctataattgaaaagtcattattattttgtttgcaacttgcattattagaatcacacacttaacttgcttggcctcggtttgcgtgccaaaccgacggatctacccagtagtcgcactaatttctgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtaaaaactcgcgatgcgggggttgtgcctatgtagcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcagacaaaccgggttcctggtaaggcaaggacgagaagcttgctcacttaccgatcaaggtggttggagtttgatttgtgaacgcctaaaatggcctatgtttatgtgaggatttgatccttcgatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcaaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctgggtagctagactctgggagtccgagaaaatgaaaaaggctctgggagccgagaagtaatgatctgacctgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctataaatatatatatatagttcctccgccctgaagagatggtgaagtgaagtgaagaattggggtttcgccctggttcccagccgtcgcctgtggtgttgggtgttagaccgttggttccgctgctgttgttgttggtgttcgcctcgtccgtgtcgtcggttgtattctcgggctgtctgagctgcaacctaagttaaggtaaataagtcctctatttattttaaggattgttatgattcatatttgtcaccgtgggtaccagcactatgtcctgggactggtaccgagatcgcggtttcgtaggaagcggttcgcgccgctttccctacgacacgctcctgtcaggtgccgttgtacggcggtatcagattggggtgtgacatgatctcgagagctgtcaccacctctacacctacctcaaacgtactgtgggatacgcagcaattactggataataattacctaaacaccacgtctaaggaatttctatctacttttgtgtttataactcaccaaagtaatcactatattttagttgattatagtgaacaataatcctgtatgttatttaggaactaactaagagataattctcacaagataaatctaaattactcaagaaaaatattatattgaattcagagtaataaacagaataaaagaaataggacaagattaccggcaactccggaattcttccgacctcttctactctactctcttcctattctagtagacaatattgtacaatagagcctcttataattcggctcaaacttggaagtgtgtgtgagagtgaatgaagtgaggtccttttatagggcagttatgacggttgtgagaaggggaaatgtccgaactgccccgcaaccgtcattgggagaacatctggaacgtccacgccaaaccctaggatcaacggcgatcagggggttcggccgaacctgggctgggccctcctggcctctatccatttctcggagttttgggttgattcactgatgttttgattaagttcacaactcatccttgtagggatacataattttcctcactttagtctagatttcctcccaacatcggggtttatcacctgcatacaaatatacaccaacacttgtggaatatgtgagattaagcaactattaatatgttggatgttttattatttgaactttatgtaaatgttggcggtatagaattgacatttaacagccgccaacaacctcagagttctttggaaatcggtttccaaaaaaagttgcaacttgttgatatgagtattctattaattctattagaccctggaccgggatgtcacatcaggttaatgacaataatgttagcataacatccaaacaaccccttaagagcaaggataataatgcagccagctacttacttatagcctatctatcacctcactcatatagtggttaactcttcactataaatatatggtccacatgtctgtctcacagattttcttggttcctgtgtctaagccggctgtaaacttacagcccgcttctcatctctctcctcttttctcctatccacctcagcattcagccttcttatagcccactattatacttgctctaagttgcttaaggcaaaggacggctttgattcgtcggcagtggatcagcttgccgcggtcctccattggcccaatctactccaggtgcacttgctttttctcgattttttttatttatagtaattattagtgacgtacttgaattaaataattagtaaatctttcttcgaatttgtaaaaataatgaactctgttgccaataacgttcagatttggacgcactttcgaagagcgtccaagaaaggacgctgttccggacgaggttctgactgatgcgcctcgactcctctccaacacaatgagtgaaacaggaaaagaaaagaatcaatcttgcgtgagcgtcgttctccggctgtctcagccatcatttgccgaggcacatgaagaggcgtcaccgcctactgcccatctcggcatctcctctggtacaatgtccttgcacggatagagcggaggcggtgccgtccggccggcgtgccgcgcgcacgccaccactgtccgcctcaaagctcaaaggcccacgctgccatccaccgggaaagggatactctgtgt

SEQ ID NO: 35883 - DNA, 19651 bp, Oryza sativa
ctcaactgcatgtgcagttaagtcagaggatctgcttcccttccactgggggttgctagcgcgcgtacgcgccagcaatttagctagcgcgcgcggcagctggccttctcccagtgtctttttttttcttcttaatgtttacacttttttttaaattttatgcgtgtttttcttcttcttttttgccgtttcttttcgatttttttaatctttcgcacacctctttacaaatatagaattgaaagtttttaattttgacttgaaagttttcaaattttgagttgaaagaatctttcaactcaaaatttgaaaactttcgaccggaatttgaaagatttgaaaactttcaacttgaatttgaaaactttctacctgaatttgaaaactttcgaccagaatttgaaaactttcgacctgaaatttgaaaacttttagctcaaaacttaaaaaactttcaactcaaatatgaaaacttccaaacttgaatttgaaagctttcaaatcaaatttcaaaaccgtcaccttgaaattttaactttcaaaatattttttaaaaaaactttcaactcaacttttgaaaatttcatcatatttctgaaacttttcaacttaactatttgtatattattttgatataataaaatctataattaaattaatctacacgcttagcactattattagtgctaatgactagtgggcccacgcgcttaacctcccatgcaagaagtggaaccgaaaatacagaaaacggaaaaaaaaaaggaacacgaggcgctacggactcggagtgcgcgcgagttgctaatctggcgcgtctgcgcggattagcaatctcgggggagagggctgcttctctctcggtttgcacgtgtgctgcacgtgaggaatgggagggccgagtgaagaggatgggccgagcaagagagaaacggcccaacgaccaagagggacgcaaaatagacttttccaaaagatttgatttggaggtattggattcggatttggatttagaattgaattcaaatgtgatgttcgaactcacggacggagaggtaaaggaaaggatccaaggagaaagtcatcattcaaaaacggaacgatgggagatgacgatagagcaatagatagatggatggatagggcgatagataggtcgatcgatagacatggatggatttaaggtagggatttaatattttcttgtaatcggggacaagtatttggcgaggattcaaaggaatagattgaatgtcggagttgtctttggaatgggaatttcgaggagacaatttttgatttcgacgagagggatcaaggagatttaaactgagatccacgacatgacttagactcgcccacaaagaatgaaaattttcgcaattaggattttattaattaggttttttaacgtctcgcgaaaaatgaggcgttacacttttcaaactggtattaatccattaacactaactgtggacccatagaatttactaggaataaattgggcctaacccatttagttctaacaataatccccacctaatttcagagctcacagaaatgttctcagtatttcggcgtagactgtgaagttgaactttcacctagaaaaaggagttacacctgaccacaactgaacaatggactattccttgaattgtcggtcttgtgcagttaggctttactcaatttcttaattgatactagactgtcattagcatctcctttgtgtggtgtgtataagttgtactccaggccttttcatgagtatctagagatcacctaaatctcatagactttggctagcagtcggactcatataggtgtgttccttctaagatgttctgtaggctaacatatcttgtttaagaaaagccactcaggtcacataagggaatgcaccaacccaccatacaaataaggagataagtacatcatagaaatgagctttgggtctctcctcctagctaccaaatagcttgtttcaccatcctaattcacaggatctctaatcataaaggacggattatcactattgtgtaactcaagtggatccaagcccatctcactcgatgcactgtctatcacattacgcgatagacccttagtgaactgatttgccagatttttagtagtctgaacatagtacaatgctatcactccggagtttttcagcttcctgacagactatattagtattctctttatatgtctggatgacttcatgttgtccttctattaacgccaaaatatggtatgtttttttactgcattcaggtaagggaaagagcgaaagggcctgtagcctagtggttacaagagcctcagtagcacccgaggtcctgggttcgactccccatgggagcgaattttccaggatttaatggcgttgtgctttcagtggtagacgacgtacccgtcgacagcgaggcgcctgtggtgacttcgtcaatctctccaggatttgccggcccagtcttcgaagatgctcataggggtgagtgcacgtgcgttgtgagtgtctgtgttgtactgtgtaattctcaaaaaaaaatgtaaggaaagaagtcgatcaactaatgtaaacctatgcagaagagaccaatctccggaaggaatcgtgaagatcatagtgtggcaatttaattctacctattaattggacataatttagtaattttctgttatcttcaaaaagttttgtttagtgtctgatcttgacttatatcttttatttttatctttagaaaacttatattgtgtccgatcaagactagtatcaacccggaggtataaatatgtacaaccaaagttgttttaatcaatcttcataaatcaatacaattattttcaacgcatcaccaccctttttatcccggcgagttcttagttaatttcgaggggggatacatcggttaagttcgatctccgacgagaagtgagctccgtcatcttcgctttcattggcgttgctaggactttctcggttaggtccgatgctctattcgggctaaagcaagcgttgcctatcttatatgtcgtctctaattttttatgcattgttgcttaaagttacatactcacatcagattagtttggactttattggttcagtccgatattctaatcaagttaatgacttttattataaatttgttatatccatctctttaaatataacattttttttaaaaaaagtgggcaaaagctttgcctcgtatatattgatagagaagaggtactaatatatataataatataatatctttttttaaagaacccaacaaagctggttttatattatagaaggaagagaataaccatacaggagcaggaatgacattcctagaacaaaaatgtctcccacaagtaactactccctccgtcccataataatataagaagttttaaagttggacacggttattaaaaaattaggtaaaagtgaatggtggaggattgtgattggatgagcagtagaggtaggtgggaaaagtgaatggtggagggttgtgattggttgagaagagaatgttagtggagaagttgttatattttgggacaaatcctaagaactaaaagttgttatattttgggatgaagggagtagaaattaaaacaagcctattctcgcgacattatacactgcactcccttagcacccgccaactcccacaattggagttcatccataatcttgcttgtaagtaccggtggtgtagattcgatgttcctgaagatgcgattgtttctttctatccaaaccacccaaagcgtggtcggtgccaccaattgagtagggtgtcatcattgctcgtgttcaagaatcgatttggtctgatctggtggcctatctcctgccaaaccctctgtatgaagaggcactcctttgtatgaagaggcactccttgaagaggtgctgcacagtttccagatttctaaaacacagttggcaaaaatagttatttagccagcctcggcattgtaatcgatcccccgtccatattctgttcttgctctttggccagaacttttgcttggcagacgcccaagttttctatatgagaatagcggactctgatcttgttttcccctgaactgcatggtgtatgcagaccttgccgtatagaggccgttggccgaccatctccattggatttatcctcattcctcagtcccttcttggaacacaactcctgcaatgtccagcacttcccaaacataaatgtattcctgaagcaattgtataatataatatctgagtggaaagaagtctaagcatataaaaaacctagaacaaacaagttaactataaatagacaagtagacaactataaaaatattgtagaaacagaaagcggttcgcagagttatatgttatatatatatatatatatatataagtacagacttctcgctttacttatgctaattactccgtaaccttcttcaggaaaacttaaacaactccactggcaactgacaaggttaggtaagaccgtaagagatggaatatctcagttactatcagtgggcgagctggtcgtacgagccggaggctgcgttggtacaattgggctgtgtacaccagtcagcttcgcgtatccggtgctctctttgacctcgccttttaaaaaaataaaaattgttttttgttcccctctgaccagcacagcagcaagctagtacactggtttcaactttcagctcgtcttttcacaaaaaaaaatactgtaattaaattttgtaaagatccgatcaagctcacgcgtacgtacacgcgcttgatagcatcatcagaaattcagaatctattatatctataaagtaatataaagtaatagaaaaagaagcctccacgttcgctctcacggtctagaaattctcacattaattaaaaaataagaaaaaaggaaaaatagaactaagattaggattaggattagttaaaaactaaagaaaggcaaaaaaaactaaaaaaaactaagatacttgaatcggacaacagtcaaaaactaaaaaaaggaaaacggaatcatactaatatgctttcgtaggatacaggaaacggacaaggtttctttcgatttagaaaacgtatcagacactaattttgaaaaccgtgtgagacactaaaaaaagacagactaaaaaaccatcatcgtcagattcatgcaatctgaattgtacacaaattacatgccatggtaatatataaatagtacgctagaaatcttctctccacaatccaccgcaacaaaaaaaaaaggaaaaaaagattaagtacaaaatagtgatgaaactctgtacgaatccgacttttagcgatgaaaaaaattgtgagataaaagcaagtgtttcaggaaaatagcaactaactgatgctctaaaataccatagagctgaaacgatatcaaaacaagaaggcaaactcaatctattatcttaataaagaaatagaaataaaaaaggagccaccactctcatagactaaaaattttcacatgaattagagagaaataaaaattctaatatatgaaaaaagagcctagatggaaagtaatagaaaaagaagctaccatgtttgctctcacggcttagaaattcccacgttaatcgaagaaaaataaaaagtagagtccatataggaatactatttaaaaatagctgaaattcagaattaaaaataaggaatattgaaagagtagacaagagtccatacaagcctacaatttagaattaattaaaattcggaattaaaaaaaatagaaaaactaaaattagaagttagagtccatatagaaatacaatttagaattaataaaattcaaaattaaaaaaagtaagattgggagaagtgtcatagtctatatatgaatacaatttataaataactgaaattcaaaattaacaaataagaaatcttgaaaaaaaagtccagcatctatataggaatacaatttagaaataactaaaattaaaaaaatattgagaaaagaagtctagagtcaatataggaatacggtttactaataattgaaattcaaaataaaaaaaaatattgaaagaagagtttagagttcatatagaaatacaatttataaataactaaaattcagagctaagaaaaaatgaatattggaagagtagtccagaatccatataggaatataatttatgaacaaagaaaattcaaaatttaaaataaggaatgttaaaatatgattcttgagtccatatagaaatataatttataaataactatcacatatatacaatacaataaaaatatcacacatttgttagttcaaccaagaatttaaaattatgttgtcaataataaaatatgaaaatatttaaactattgtatgagaaaaaaaatctaacaatgctagccgtgcaatctgcgcgggccgccatgctagttgtcgttaatgttacaagctgccatgtgaccataaggtccacacgtaaatattatttttagatattgcattatattctaatccattaactatgctataaacttgtatttttttttgtgttttcttttatctcttacagtatttgttgcaatgtaggggccttagctagttttttttaagtaagtagatcaatatgggatatgatattttacatacttgcaagtttaaactgaacttatataagaaaaaacaaaaataacaaaatatattgattctaaatagaacgtgcaatttttagtcaaatctattacttttatttcttattgtatagactaaatttgaactggtgtgtttgtggaataatatgtcacatattgatctatcttatttatttttctaaaaaaaaagtttaatgtttttttaaatgatatgcactaaacgagacgagggacacgtccctctatgaacaatagtccatctccactcgacaaaatttgtcgtcagaacaagattataagggcaacctcaatgttgggttgctgaatgagcagatagctttagctatatctatctctacaatggttatggccttggatgagaaacaagccgggtcccactgggtcccatcaaagaagaaacataccaccaattcgcaatcatatgctgataggctccattagatatcattttttaatctcttaagttcaactgtaaggttagagctgtttttaagcatttaatgtcttatgtccatgtccacaatgtatatagctgaaaaaaagtcttaaggctcactcttatggtcacattgtggatgccctaaacagaaactaaaatgcaataactctgtctttagatattggaaaaggaataaattctcgcttcatgcgtacgttacgtacctgaacaatcccagcgtgttgccctttccggtgattctccgccggctcaaaccatgtgccgggccaatgcgtcccatcagccatccatgtcgcgttttcaccgtcatctttgccatccttcgctctgttgtacgcgtcagatcgcttgcgaatggtgctgaacagcgagtcgatcctgaccttgaactcctcgtactctcgccgcacgcggcggcgatcgctcatcagctcgccggcgacgccgcccctgtacgcctgcgtcttcatcgcgaagtagctctccggcgccctcggctcgacgcagtgcttccggcagaagggcacccacagctcagcgaacttggcgacctccaccatggcctcgtagtggaccagcgtcccgccgtcgtcggacaggtagcaggcgtacctgtccaccgggtagtcggcggcgaggatggagaggatggagttcacggtgtagaggatcggctcgtcgacggggtcgacggtggtgacgaagacgtcgacgccggggagctcgccgccgccggaggtgccgtgctgctgccggtcggcgagggcggcgaggtccgcgacgcgcttgatggggttcagcttcgggagctgttgagcgcccacgaaaagccgaaccagacgtcgccggccatggacattgtccacagccacgcgccgtcgcggttcttgtggcgtacgcgccacgcgaagaagcgacgatggcgatcagtcgaactaggatcaagaacctgttcgtatattagagaacagcataagggcaaccaaaatgaatgctgtaaattaatcacactttattgattcgcaattaatttgtctaagtttgattataagtttataagagtagttagtagtatttgacatcagtgtgggcccaggcggtcagacctgtaaggatgcaggatgctgcccttgaccttgtacgtccggaacagcgtcggccgaacgccatcgccgccgctgggccccgacacgtccgcctcgtcgacggccacccacacgtcatccttgccgccgccgtcgttcacccgcttggccgccggcgagcacggtgccgccgccgccgccacgtagacgccggccgcgccattgccgttggtgacctcgacgcggaggccgcccgcgttgatccggcgagtcacggccgccgcggacatcgtggaggccgtagccaactccatgcacgcaaacgcacctagctaactacgtaagctccgtggcgaactggtgaacacatcgtggtggcttatatagcgcggcgaaacgacatgagtttaattaaatcatcgtctcaccctgcctggtcaaaatactgctgctacctacgtggtacaagagaagccgccactgtcacagtgcagcaagctgatgagcatttttcctctctgcagcgtatgtaattttcgttcctctctttcgatcaaactcggcaacgatcgtcgtgttggcgatcaaaaaccaccggcacaaggtcaccagtcgggcgcagaaactacagattctcggttctcctctagcagccaagtcagctgatcgtgtgacatcttcagaaacaaggaaaaataaaacgtgtacatctgcaccagcaacagtagagacctactccatctaatttatattacaagacatttttagttttctttaatttgattatattgtggaataaacgtagtagcaacatctataacatctttcattaaatctaacattaaatatattttgatacatttttataaaaaaaatacttcaacatttttctataaactctgctttgacttaaaaaaaatcaaaacattttataatacaataaggaaggagtacctaacaaaataaattaatatgcaatatatcattctctacaaacatataagttcaaatttaaattcaacatgttataacaaattaaactctaagtaatatatttgtagtcaaatttgtctctttttttttacaatttatactagttgaatttaaatttaatatatgcttgttgaatgcttcctccgttcaaaaactattagagatttagatggatgtggcagtacatcctagtagtacgaatctgaccactcaaaatataagagatttaggatggacggggtacattctaatatttcgaattcggacaggaacctggccagattccaaagtcgtaatgctagaatgtgtctcatccatcctaaatctcttatattttaggtgaccagattcgtactattaagatgtgtcacatccattcaaaatccattatatcttgagatagagaaaggaatatatttcatataaatcattcttgtcgttctttttttaaaaaagttataatcaccttagtttatgtgtaataaacgagtgatcattcacttgatgattaactcaggtgattaaaaaagatagagataggctgcagcttccacgtcaaaatcataaaaacagctggaacgaaaggtacgggagaacatagtgttgtccacttggacacgaacaaaaaaccgaaccgagtacgtactcaagttgttactaattactactagtatatatatcgaaacaagtgcatggattatgcccaaaattgtgcacgcatgtgttggcctttctgagttctgaactcctgatgatgttatcaagcgcgtacgtacgaacgtacgtacgtaagctcaaattttcaaaaaaaatattgccgggttttgtatgagaagacagagttaaaacatgtgtacgtacctagctgccgtgctggtcagaggggaggaaaaataaaagggagagaggtcaaggagagcatcgatcgagtatatatgagacagtgatcaagtggtggacagccaaacttgatggggatagcaacggtgaaatgaaatcagcagctgacgagctcgcccactgatactctaataactttttttcgaggggaagatactctaataactgagatgttccatttgagttatttattagtttatttatgtttctttggaaagaaccagcggagttgtttaagtttttctgaggaagggttagcacaaaagaaaagagagaagtctgtactttagtccgtaatttctgaccaaatcatgcccgttgaatatagtgtttcagcaaatccatattaactaagtgcaatttgctccgaatcagttcgtgtgcttcctaaacctgcctaaactcacacacatactctcgttctttttatttaacactttataattggtgtccttagacatctaatttttttaacagttcatcagattctttaccagcagaattggacacatgaaagctacaccacttgatttgtcattattgcacagttcttgtaacttgtttaattagagttagtaataggtatttctaaatagcggtctaaattctgttctggagaactagaaaggtgaaaaaaaaatcaaaaccgaatagcatagacagatatattggattttacttttgtctgctttgaaccaacaattcaaattcctttctaaggaaaaaaaacaaacataatcagagttagatgcttgtcgaatggtaaagcatttttcagtgttgagcggtccaccgtattcatttagatccactccaagtgtgatctttgtaaaacttaccagagaagttacattgaagagggtgacatatctttgcatgttctactgattaccaatatcctaaaatcgatgcaaaccacgaattaaatttaaaaatatattgtttatttataattttcttataaacattcgggatacaaatttttttacaaaagtataccatcgtcgctggatgaaagcgcgaaaacgatacggtatcgctgatccactatgcgagaatgacgtggggtgacgatgcgccacggtttcgtattggttagccgcgagagcgtacggtctcgcacattgcttgtgcgagaccgcacggcatggctgcgacagggccaataattaatgtttaatcacattgattagcgactaattaatccctaatcatcattaattaatcactaattatggtaatcaatcactagttaaacgaaaccattggacaacacattcggtatcgctgtttcattatgcgacattgtttcggtctcgctctttcctttcgcgagactgttcggtctcgctcttttcatctgcgagaccgtgcggtctcgcaccattgctgtgcgataccgtccgtatcgtcatacccacatcattttcgcacaacgatcgtgtgagatcggacgtatatttctgccaaaacaattgtatcccgaatatttttgttaaaaaaataaatgaacagtatatttttaaatttctttctgcaaaccacctgcttttatatttactcatgtggtttttctatatgttcaatatgaaaaagatataggacatgaatatataaagacagttgatggtacatatgaaagttctcatataagggaagtccaaagaagtaaaattgaacagactcagagttagatgcttgttgaatggtagcatgcatctacagtggtagcattttttcagtgttaaacctcacggtccaccgtattcatatagatatagcccaagtgtggtctttttaaagttcaccaagaaagttatattaaagaggttgacgcatccttgccaattataccgattaccaacatcctaagatgtaaaccactcgcttttctatttactcaagtgatttttctatatgttcaatatgaagaatatatatgacatgaatatgtaaagacagttggtaatacatatgaaagttctcatataaggtaagtccaaaaatatttgacacaattggattagttcaagaacaatattatttattacaaaagttaaacaatacaatcttttatctatgcacctagaatggaataatgtttgctagtaagatatgggtagcaacatatacaagggcaacaattacaaagataattggcaacaaaacaacaagaatgattgacctctttgcccatctccccatgattgctagtgcaaatgggtaaaggagaaacataacccacatgttgaataggagtcccattgcagcatgtctcttctgtgctatcgtccatactcccatatatactgccgtctttccaatagctacaccaatggcaccgatattagcaactaaaactaccattgttgggattaacatgggaacccatctcatctcatataagtcagcaaatttatcgttggtgtcagcggttgtttgctttgaagtgactctaaaatgtatacccttctttgtgagaagattgaccaccatatgaagcacagctgttgggtaagcactcgttgagccgatcatgaagaactgctcattgcgccaataatctaaccatgtgatccctgcccactttatctcgagccatccgatcatatgaatcatcaaaatgatcacgagaaggtacaccacatacctagtgaatggcctctgaatatatacttcatcggggataagccacatcacagggctgatagcatagagtaaaataaagagtgatgtcaccgggtagattgtcatattgaggtatgagacacgctggagaggttggagccgacgacctccaataagtgggttattgtgggagaagaacatctctagggatccaccagaccaacgtacaatttggtgaagacgttctgttagatttataggtgcagtgccacagaatgcatcatgctccatggtgcaatacatggatcgccaaccttgcccatggatgcgaaaacccgtgactatatcttctgtggctatgtcatatatgtatccaacacccttgccccaatcggtttctttgtcgaatgaagctgacacaaccatctccagctcattgacaaatatgtcattgaccggtgatggtgtagcaaatcggtcttggtttagggcttctaacactgactctaataagagtatggagttaccaaacttgctagcttcaggtgtgatgttgtcttgtctccaatgaggaggatcaataccatagagagctaagcgacggaacatgcaaccagtaccaaggtatgaaggtccttggagaccatttagggcaagcattgtgccatcaaagaatacacgattatgattgccatatcggtcttttgggtcaacattgtcaaagcgttgtgggaactgaacaaaggcagtattatcaccttctctttggtcaagcatgaaacaaattgctgcacggaaggcttgagaattgttgatgtagtgatcacaatcaaagttgatgatgaattgtgcattggagagtagagcagaggcacgaagttgcgcatttaatgcacccgccttcttattatgatcataatttgggttctttccacgagacacatagacaagcatcgggatgcgcacatcagtggcattaaaattaagattgttgcccgtgctatccttcaggctaagattgtggccacggatgggatggtccaacacaacctgttcaaattgacaaatatgtaggtcatgttaatggaaaatttatggtgaatccacttaacaaggtaattgcggattgcacaatatgatattatccccttagtaatacattagaaaaaaaattaaggtggagttatgtaccttaacaattccagcatggtgtcctttcctgtgattttctattggctcaatccacgtgcctggccattgggtcccattagccatccaagtcgcatttggtgctccttgatcagttttcatactattgtaaacatctgatcgtttacgaatagtctcaggaagtgcttccaatcgcaccttgaactcatcatactcaagatgcacaatcctagagtcattcttgaactcctctggtgcacttccagtatacgatggtgcctcaagctcaaagtagctctctggggatctaggctcaatgcaatgcttccggcaaaatggaacccatagagtagcaaatttggctgtctcaaccaatgcttcatataggatcaatgctccactatcatcagagagatagcaggctgacctatcaacagggtagtcagccgcaagaatagagagaacacaattcatggtgtatagaaccggttcgtcgattggatcagcggtggtgacgaaaacatcgatgccgggaagtctgtagcttccgtcggcgagatcacagtactgccttagggcagtaaggtcaggtatggttttgaccggattgaactttgggagttggttaagtagccatgaaaaaccaaaccaaacatcaccggcgactgacattgtccagaaccacattatgtcagaattattgtgcctgatccgccatccgaagaagaggagaacggcaatcaagcgtgcaaagatcagagccctgtaagagattaaaaaaaacatgatccgactgtagttaatttctattgaaacgaaggctgaattttatttattatcttaaaaacaattatttctagaaatgcaagtaaatgcacatgcccaggtgaccagaaagggtaaatattcttgatccaattataagctgcaaagacattattggaaacatgaggccgtactgtgggttactacgagtcaacggattagcactgaaagaaatccgggagcagaatatatatcactcacgatccatccaaatgatcaacgtgctcattgacttgcatatatatatacttcattctaccaactagaaaacgcatacattcccggcttaactaatttttagatactcccccgtttcacaatgtaagtcattctaccattttccacatttatattgatgttaataaatctaagcatatatatctatctagattcattaacatcaagataaatgtgggaaatactaaaataacttatacagaggaagtaacaaaagtatagcgtccagattctgtatctagcaagctcagtactaataataatctttatgcataaaaagattttcattgcaatgtcgctgatttttcgatcgtacactcgatcggatgtacgtacctgtacgggtgcaggagggagcccttgaccctgtacgacctgaacagcagcggccggcggccgtcctcgccgccgcactccttcgccgcgcgccgctcccccttatcggcggcggcccagtgcttccccttggcgccgccgccgccgccgccggccgccttcctctccgcgccgccgatgctgctcgtgcggctcactagcagcgggtcgatgaggctgctgcagccattgctatcctcaccaccgccggcgaccgacgccggcgaagccatgacgagcactctatagagctcactggcaagcttaagccagtgcaagtgtgctgccctactggtacttgaagctgaagagagtgtgcagatgcaccatgtatatatagtactgtactagtgactgatcgttgggttgaatgaatatttgcgtgcatccagatctgcgtgcgccgcaactatcgtctatcgattgatcggtcgcctcgcctcaccaaacgtgttactccctccatatattaatttatatgtatgacgccgttaatttttcaatcaatgtttgaccatttattttatttaaaaaatttatataaatatgaaaatatttatgtcatgtttaaagaatatttgatgacgaattaagtcataataaaataaataataattatataattttttttgaataagataaattattaaacgttgaaaaaaagtcaacggtgtcatgcattagtacgttgcttcgtctgagcactaaacaaaccactggtgaacaaaacgtgcagcagaatgcataagcatgttgcgtccatgtgcctgcaggctgacccaaaaaacgcacttgtctgcagtgctttgcatgcatgctctgtactgtcttacgtcttgtcaggctaattaataaatatcgccatatggttactttggttaagctgcattgctaatcagctgtattaactgtgccactgtaatatataagctcaggttatttgtgaaagtcaacttttgccgccttaattacggcctggtgttactcagtcgtcgtcgagcatgtgggtgcaacgatcagatcgatggagatggatctacctatgcaagttgcagttaagcagaagtagcttaattagatcaccgtgcatgcatgagagagagatcgatccagtgcgaggggacgatcagaaatctggcagcatagattttaatttgtttggttctctcgtgtttttgttaaacaaatcagaaatccagtatgattctctcttggcagatctgcagagagtactgattttggtgcatataagttagtttatacatcaatgtgttgcatgttgtgtgttgattttttttttttactcatagagatctggtgatgccggttgtatatactactggaatccaaattgatctcacagaactgtggggagataaaataaatggccagatctatatattgatcgaaataagagttcacacactgctcggagaagcatctttgtggtgaattgatctatgtactactactccctccgttttatgtttactactcgctccatttaataatgtaagtcattttaacattttcacattcatattgatgttcattaacatcaatataaatgtagaaaatactagaatgacttacattataaaacggaggaagtactactcaattcgtctcaaaatatagcaacctagaattaaatgagatacatcctaatacaacgaatccggacaacacctaagactagacgagacacctcctagtactacaaatctgaataacatatatgatcggacgtgagacacattaaattactatgaatctggataggctctgtccaaattgagtatatccagattcacagtattaggatctgttttgttcgattttaagttgctatattttggaacgtatgtagtaaattagaagacatatcctagtatgcaaatctagatatattctatccaaattgatcatgtctaaattcacagtactacgatgtatttcgtctagttctaggtggttgtatttaggaactgaggtagtaaatcatatgggttttgttaaaccttttaaagtttgaaaccaagtttgtaaaaaattagcagtattttgatatacgaaacaagcacactataaaaatatatttaatagttgatttcaatgaaacttatggttggtgttgtacatattgctgcgttttccaataaacttagtaaaagttgaagtctgagactattataatatggaatagaggggtagtattcaaatgctatatattgttcataattgagggtgtatatgcaagaacattttggaaagattttatatgcacaacgtcatggatattaattatcttggactatatctcttgaacatgtgtgatcgatgtgtaagtgtcacaattgtggtagcatataaattaatgtgacggtacgtctttcgtagatgtcacttcgtgtacttttttttctatgtttaatgtaaatagttaagatagtttgaaaaaaattgattgtatacgaatatagtaatatctaccactccatcaaaaatctcaaattcaacatatacattaggaggaaaaaaaaccgggtatgaatagtacaactactatttatatgctgaatttgttttttaatctcactgtgtgagttgagtttgaaccttatattggttaatctttagacaattcgaaaccatttacgaacttgagatttacaatagcagacaaggcattatactaggggtgtgttcggcacccaattttctcaacccatctccctcgttttccgcgcgcacgtttttcaaactattaaacggtgtattttttacaaaaagtttctatacaaaagttgcttaaaaaatcatattaatctatttttttaaaaaatagtaaatacttaattaatcacgtgcttatggactgctccgtttttcgtgttactgtttcgagttgggaaccagcatatgcgaacacaccctagtatgtgttcacaatggcagtactgcagtttgccaggcatgtgtacatgcatgtttgaaatttatgcaccacattaccagctacagtcatctaaaaaagaaatagatctgtagatgcaggagtactgttagaactgtgtattaaatcagctatgatcagtagaccgtctagtctgatttactaattacaagtccaaacgaatcttaattcctgttcttctgacctcttaattattataccaacatgctcatcaaaactcgagagtccgactgatcagatgcaaagattaacctcaaggtgaatgtcaaaaagaacaaaatcatacatgtagattgctatcagtacatgtcaaatcaaagagtgtgtacttaatttttaatacagtattaatgggtggatcttagagtgttaacggtaattacctggtacaccaatctagtccatctctgacaagctaacatgtaggcggccgggttaggaaactgagggagatctagttaattcagaggcgacgatgcgtgtgcatcacatgtgttttagccgtccatgtgacaatgcatcaagctggaataatcgattggctgatacagctaatacaagccaagaagtcgatggtttctagtgttagtctttctttttaaaattttgagatgagttttggtcattttgcttggcgttaattccctaatcacgtgatcttggagagacgagttagagcaggtacaatagcaggctataagccggctataatcatatatcgagaagaaagcgggctacagatttgtagccggctgtaatacggacttcaagatgttatgtgtgtatgagatgtgggaccgggtattaatggtgtagtatatttttatagttaactattgtatgaatgagctattagattggctatagatgttttggagccagaagttgtctatactattgaccttgctcttaggcgtactaatgaaggcattaactaaagttcttactagtaatataaactcgcacttcatgattttggtacacgtgagatacggcccaacacgctccccgaatcccgctccggcccattcctggtaatccccgttccggcccaaaagaaggtgctatatttagttgggccgtactcacgacatctttttagggccgaggaagatttccttgtccgcactcactccgcacgtcgtcgtcttcctctcgccgctccaaccccaggacccccaggtacgcgcggcgcgccttctcttcccctccgctagctcctctcgaactggttgcgccgctgctttccccatttggttgacctccgcgcggcggctgaccagcctccaacgcgtcatgccggggttgttttttttttttttggtgggggtgggggt

SEQ ID NO: 35884 - DNA, 26520 bp, Oryza sativa
gggggttgggggtggcttttcgttatgtttgttagctcactagccgtgtgattggatcattggaaatctgtaatagcagtgtggttagcatatattttctgggggattttgtgccggagtccgccattcggctgttggttgcgcgtcaatggggaaatcagtacattggctagtactccggaaaatttggcattgaagagagttttgcgaattggttctggacttcccacgggaactacaagtgatttcatcatgatatagagtagtaccaggatggccggatgggatggttaactctaccatgaagttgccaactgctagtaaatttaggtggtgttttcagacagtgaggagttgggggggattcggagatccactaactcataaaaaaactcgaccggcgggggaatgaccgtccccgtggcttttcattaataagaacaggcctcaaccaaactggatgagaaaaggcatgaaccctgcaccccccccctccccccaacaccccacacgcggactcgccccctatggattggtccttaacctgtactttgaggctcctttcttgtacacaaggcccgctctccataggtcgattcataacatgtgtttttacgagaggccagcgagtaacattttttttaagtaggcctaaaattcgctctcgaggaaagtcgaacccaggatctagaggtgctacttgagcattgtgaccgctagactacatgccctttcacaggcccacttgctcatgctagaagagtcgttgaacgccttcctccttggtttgtgtcttggttctactgtcttgctaaaatcccagtgatttcactgcttcaatgaactattaaaggaaaattagaagttcgaataacagaatggtgaattggtttaaatcaaggtttgagatttcggatttgtgagtgggtcccagcagaaaatgtctctggccaaaaattccaagtttgtatttatttagcgaaaagttgttcaatttgaaaaaaaaaatctgaaaatttcgtttaacagttgcttgcattccatttaatttttcattgttatgtgattttgcaacatccatacaagagtacttagactcaacaccttacagaacggctcacttcaccagtaacttaggctcacaaccatgcacccacagcattaaggatacttgcaacaaaagctcataaaagagacacaaagcattaaaagttcgagtaacagaatggtcaattggtttgcctcaatttttgaaatttcggatttaccagttggtcccagcagaaaatgtctctggcccaaaattgcaagtctatttatttagcgaaaagttgttcagtttgaaaaaaaaaatctgaaaatttgtttttgcggttgcttgcattccgtttatttttttcgttctgaaatgtaaaaaccctggtttactagacatagatgaacgtgatagttactaaccattactccagtatacagtcactaaattattcagataacactattaccatgcattatactagacattctatgagtagctggcaggatcatattcttccacaaggttttgtagaaatgccggtattgggggcaacacgacatctcgagtgccctgcaagatatgaactatctgctgcattgttggtctatgagcctcgttgtcctgaatgcaccaacatgcaaccttgcatgctctctccagctcttgaacattcgtgtcatgcattctatgatcaaatacttcagaaatgtcaccattgcttatcctgactgcagcccagacaggaaagtactttatagttttactctccatcaattctgtgttccttttgcctgaaattatctcaaacaacatcattccatagctgtagacatctgcttttgacgtgatgggaagacctgcgatccattccggtgcaagatatcctattgttcctctcatagttgttagtgcccgactaaaattccgatccataagcttagcaagaccgaaatctgccacttttgggctgaagtccgcatcaacaagtacattttctggttttatatcacaatgtatgatgcattcatggcattcctcatggagataatgtaatccttttgcaacacctagaataacttggaatcttgtgtaccagtccaacaccttcacattattaaaaaggtgacaatctagagaaccatttgttggcaacttttttgacaagtcgacgagcacgatcgcaacacctaaacgccttgcggtgatatggagtcgccaaccacctcgatctagccaaagggccaaattaagatgggtttcggagaaaaacaactaaggccctctttgtttaggcttataagccaacttataagtcgaaaagtctaagccaaaacaaacaagcagctttttcatttggcttttttaagccataagccactctaacactattaagccaaaagctaggttggagaagctttttttggcttatatgagatagatgtatgactctaccattaaacttaggacattaaatccactggcttataaatcatataagccaataagctgacttaaaagtctaggccaataagcctaagcctaaacaaagagggcctaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacagcgcaaaccgacaaagatggactaaactagggtaaaatagaaaacatagtaaaagaacgattcaagtaaattgtattcgggggttttacaatgaaccggcggccttgtcccttaaatagggggttggtcttgccctctacaggcccttctccacgtccaactcgggatagaaactaaaggaaacacgaaacatgccttcccgagcaaggaaacctgagacccgacgaaaacagactcggactcggaccctgccggtctgaccgcctacatacctgcggtcagaccggccctactagccggtcagaccgcccacacacctgtagtctgaccgccctgtgaaggaaacctgtcactttccaaactttggcaatcttcccctatttcgtccataggtgccaaatttgggtgtaaacacatgcccccctgcctttttggtgaacatacgtgaacctaaaagcatagaacatgttatctcagggcgataatccaattactggccataggacttcctaagcatcttgccaaatgctcgggaagcatttcttcaagtatttcccattaattgatatctgaaaacaccatcttgaagtgtcttcatctccttcaaagtcttcaaacgctcgtcgatgacatcttcaaaaattgcttcccatcaaggtcttataatcttcaaccgacaagtcgtcttgcttgaaataccgaagagagccaagatttacctcaactggcaaaacggcaatttcaacaatgttttattactcgactcggcttatccattaacctgagtgtaagaactcaacaacttaatatcataagattcggcaatacttctcacttccttggacataaaagaagctcctttaacgtttgaggaataccgaatctatgaacaatatgcttcaaaatagagtcaattacctccgtacaagtaatattctcgagcggcacggcttcggcccacttagtaagtaatccattgcaactagcacgaaccaatgctcttttgatgacgaagaataaatttgaccaatgaaatccaaagcccaacctcggaacggccatagtttaatgataggattcaacacaacggtaggcgctagttgaacattgccaatccgttaacaagcttcactccctctatagcatttgaaacaatcatcaattattttcggccaatgaaaccccactctcctaagcaaccaatttatcttacgggccgattgatgaatttcacaaatcccttcatgtactactctcctagcaacttcagattgatcattatctaagtaatactccatctatttttcggtgatataatatttgaacgcttgccgccgaatcttccgatcaaccttaagtgtaggatctttcaaatatctaatcaaaggaattctccaagctatttctaactcatgggcacaaatgttcgaattcacaattaatttggccttttaatcaattgtaacgtgccccccagcctcctgtctgggatcggtcagaccggccacgcaatgccggtcagaccaccctgtctgcccggtcagaccggctatgcagagccggtcagaccgccggtaccaccggtcagaccggccgtgcaatgccggtcagaccgcccttggtctatgactttgccaatttcgtccaaacttttaaaatcaagcatcggcctttagtatataatttttcttcacataatagccagatgcttggtgtatcaaattattggaccaaaattcctcctctctagacatatgaaaaactataccatccaactaacatgtctagatgaatactaattcaaatggcttttgaaacaataatcatcatggcatcaaaacacttagccaattgaataatgaatcaccaaagtcatatgcctcacacacatgaattccaataaactacaaatgtaagtaatcggcttgagcatgtatgcaaaatattaataatgccaatgtttctaaagaaaacaactctagaataaatcatcacattgaccattgacattagccgaattactaataagcaaaactttcatggtgcaataattataaaatctatatcttatatggtgatccataaaaacacatacaatttggctttaaataaatatcaaagactcgtgaaccaaatcatacttaaaacaaattatatgccaacctaccaattccactacttagaactggcatttgcaacatgtatgtataatatcaatttgataagcaaacaacacacatgtgctagatagtaagcaatgttctaacatggcataggcatataatataatgttaaacacaaaaaaacccataccttgccttagcatccgacaaacggcggctcaaagatgtgatgttgtatccatcgccgttcatctctcttgatttcttcataagcatattaatgtcttgccccccgagcaaaatcggctttcttgattgcacgatttcaaaggcaagacgaacaccgcaccaacatccatagcatcatgtgaaggagacttatctctaatgaccgatgattcttctctcatcatattggatttatcactactttgggaaatcaccgatctcttaccttttacttctttaggtctccacactcgcttaggtgtcgttcgaggctctaaattattacatgttttgttctccacatcttcggcctccttttctttttgacctatggcccgaagacgctgaagcctcctcttttgagagcgagataagccggaaggtatccacttcagctgtggttgttttccaggagccaaatgatgattcttcatatttttggtcgaagtggaagctcctgtgttgctctcaattttctcactcttctctaatgccccccggtcagaccggcctctaggcccggtcagaccggctacaaaccgtcgatcagaccggccaggaaggtcggtcagaccggccgttgtctggcggttagaccggctagctgttttggtcaagccgccgatgttgacagtaacggcgtcggcttcagtcttctccgcttgtatagttttcggcgcatctccagtaggtacatgaacatcttaagattcctcattgatagcaacgacctccggagctttggcttctttcctcacccacaccttcacctttttcacctttgatccaccggaccgattcttttgtgggaaacggtcttgtcttgagttagatgaatgacttgatgttgacctaggtgattccttccactcttggtaatacggcataggtggttgatgcatccaaggcatgtaatacataaaaggataaccatatagtgacattggatatggataccatggcatcacaaccggaggtttgtatggagttggtatagttgatggctccgattgctttggtatttgaccaaatctcttcctacaagatgatcttggtctttttgaatcactagtttgattatcaagtcgttgaccggctaatcctttattgtacttagccataagcatctcaaaagtgagcttcggctttttggtcctttggaaactagatgactcatcctttgcatctttatgatcttcggccttcgcatttttgatcctattcttgggccgaggatccccaataataacacgtctccctttctttttgtcaacatcaataggactaacagagagaggatcactaacaactccggtcttaggcatagatgtaaccgaaataatttcacaagtgaccgatgaatcatcaaccggtcttttctccatcaagtttgcatctttaaaataatcatgaaactcatgcttcatttgtgaccatgtagaaattgaactaggagcaagcaaactataccatgtagatgcaaagtttgacaaagaaagagaaaacaactttaacttacgcaaatcatcgctaccggccttaccgcattgatcaataaagcggtcgatatgctccattgtagtcatagcattctcacctgtgaatttcgtgaagttgggcacctcaaatccttgcgggtatggaactgaatctacatgttcaggatacggcctttgatatatatgcatggctactttggattctatttcactactatcccgcaagacattgtcatcatcttttccaacatctacatgaccgatttgtgactcggtcttaggtgacaatgctatttcactttcgcttgtaatacaatccgaaccgtcatttagttcggctatatcttcaatgatgctattctctaagctagcaatacaatccgaaccaccacttggttcggctattccatcgttgtctaaactagtaacacaatccgaaccaacacttggttcagctataatggttgttgcattattttccaagctagcaagacaatctgaaccaacatttggttcggctataatcgttatggcatcattgcacaaatcattaacacaatccgaaccatcgcttggttcggctatacatgatattgcattatcatctaaactagcatttaagctattgtcatccactcggctttcctgagccggagcttcatgcaacacatgatcaacatcaagaaatatctggccattcaacctctctttaatagaatcaagcaatccatcatatgcaatgtcggccaaatctttgtcagttattttcaagctataacatcggtttttaacatctctaaacctttcaatataatcagcaacagattcattgtatttgtgcctaaccgatgttaaatcagacaacctaagctcagtctcactagtgtggaaataatcatgaaatttttgttctaattgagcccaggaaaaaatagaatttaccggtaaagaagtaaaccatgtaaaagcagtaccggacaaagataaagaaaacaagcgcaatttaaaagtatcactattagcctctccacattgcgctaaaaattgacctacatgctcccatgtggtcctactatcctcaccactaaatttggtaaatttgggaactctataaccacgaggatatggcacattatcataataattaggatacggcttttggtaaaccttagcacgattcctagtttcaatcccaaatttatccctaataatctcactaattatctcctccatattatcaggcctatgttgaattggtggtggatttggtggcctaataggttgtgtttgtggcgcaatatgattatattggccttgcctagtatcgtgagaatatcctctagcaacatcattataagtattaggaacatgcgggggaacttggggattagttgtagcagtagatacaggaggatcaaatgttctaagatgatacaaataactagcattagtcattggatctatcccctgaatcggtatgattgtgccggtctgaccggtccagggctcggtttgaccgacatccagaggcgcggtcagaccggcctgagtcccggtctgactgccggggtaatatccagtcggaccggccgtttggccggtcggaccgacggtgaaatcgcggtctgaccggccatcaggttcggtcggaccggctatatgcgctgctccatcggttccactacttgtttgatctataggagcttgactagcagtggtagaggctttatttttaaacatgtaatcggccataagagggccgaatttaaatcttaaaaactcatcaaatttaccctcaaaagttgcatctaacttatctttaaaaacagtcatggatgaatctattgtagatgctacttcttgttggatagattgtgttaccttcggtgaaactgcaacttgaggtagcggcacgtttcctttcatgacgtcttgatcggtcttgatgtattgtgtagcaatattgttgaaccgttcccgctcgtcatagttaatgaagaaattccttgattaaatccggccatatagctcatagccgaaatatttgaccgaataaattaatacacggtcttggaattttttctctcgcgatgagcaatgtgtgcactaattaattccaccaaaatcaacagataaactttgctttgtctctctgtagatcggctctggtatagcctgatctttttgatctatgcacgtatacagtaataaaaggaaacaatgctcctgctgcttgtctctcggcagatcggctctagtagcctgatcttttcctctgttgccatgtgaaacaaaaggaaaggaggttgccgagtcagctactgctccctgatgatgatcttcagtacacacggcaagtgttcagatggattcggtgacgaccaaataacctcgccgccgattagattaatccggcgatactagattaatttcggccgtttagccgaaacttggatttgacgaaacggtagctactagattaaacgaaattcggccgtgatatggccgattagatcgttccccagtggagtcgccaaaaatcgtgttggcaacttttttgacaagtcgacaagcacgatcgcaacacctaaacgccttgcggtgatatggagtcgccaaccacctcgatctagccaaaggccaaattaagatgggtttcggagaaaaacaactaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacagcgcaaaccgacaaagatggactaaactagggtaaaatagaaaacatagtaaaagaacgattcaagtaagttgtattcgggggttttacaatgaaccggcggccttgtcccttaaatagggggttggtcttgccctctacaggcccttctccacgtccaactcaggatagaaactaaaggaaacatgaaacatgccttcccgagcaaggaaacccgagacccgacgaaaacagacttggactcggaccctgcctgtcagaccgcccatatacctgcggtcagaccggtcctactagctggtcagaccgcccacacacctgtggtctgaccggccctgtgaaggaaatctgtcactttccaaactttggcaatcttcccctatttcgtccataggtgctaaatttgggtgtaaacaccatttaccataaatttatataccagaagcctttcagctcctcaagcaaaacccctcgaggcaaaccagatttgtgtggtgaattcgtcctaaggccctcacctcagtttgaaattgcttctcgcgttgcctcattccttgaagcttctttacagctatcatttgagagtttgggagtgatcctttgtacactgaaccaaaactaccttgccccaacttatctgagaaattctttgtgcagtgctgtaaaaaagagtaactgtataggatgagagaatcatcattggagaaagccttttgagttgcattcctttttcgaaacgtccaaattattgcaccaaaagcacatagtgcaacaaaggtacttcccagcactgcaattagcctcatatgatgtgtcttatgttcattgtattgaacttgaagatcagatgctgcaagacgtacataaatatcaatagcatcaacattaccagcagacaattgtttaagatcccggagctcactattccaaacaatgcattcatgttgatgtgcatatgcagtacaaatgcagttgttcaggcatatggatctgcactcctcctcgctttgaacattcaattgcattggattgcctggaactttgatgttggcaatcttgagaaatgcatgcttctcttgttggccattatgtttattagagtcaacacaagagatatctgttttcctaacacaaccttgattccatgctccaagatcccagctcctcgaggaaactggcctgaaacctggcaggcaatagcatttctcatcaaaacctgttttgcagactccaaaaggcccacagactgaataaacagcacacagagctgcaggtagagaccattgtactatccattcctctgatttgttggaccatgtatggcattggagttgaccgttaacggtaagaactattcttgtgattatggatacatcctttgtggtgtatataaacttgagctggtgactattattaatgaaaacataattgtattcagtatttagtggcattccagggatcgatgtgaatgcttgtcctgtccagttcccagactgccaataaactttagattgattccagagagagacatattggttcaatctaattagatctacatggttggagaaaggacctggtgcaggatcttctggatctttccaagaaacacgatcctggtattcaccggtgatcttattgatcccaaatctctgcccactcagtattgtgtctgttgggtgatcaaagctttgccagattacatcagaagagttaccttgatccctcagaataaggtttccattgtcaagaagaactgcaactattgactttcttggtttattccaagtaccatttgatgaccattttggttctccaaacttgttaaggaggactaaatttccatcctctgatatcttgagctctggagatgtagcacttgtgacaggattgtctcggttggccacccagataacagccttctttgatgtggttctgaaccatataccaacataaaggtttccagtattacctggagagaagaatcccagctcaaaatttccttcttttgagacaacagttgtactaccagaaagagattggactcttgagattgtatcagtcaaagcagaagtacttgtgtaaagatggaagattgataatatgagaaaagaaaaggaagaacatatcttccacttgctgggaggggccatcctttttgcatggaaatttggatgtgtggtattcttctagttaatgcaaatgccacaaggtagagagttatttcttccctctattgtcatccttctcatttgacttgtcttccaaaataatattctttttatgttgttagtctagtttcctgtgaattgacggatgctattgtgccatctggaacaagcacaaccatgtgtgagcacttgataagagttagacacgacttgttcacaaataagtccagacacagaatgtgaaacggacatcctcttttttttgactaaagaacggacaccctctttcaaactctgaattcttctcctagttgcttctgttttactgctgttctggtgattcaaaccaaataatgtcttcttttaagcatcatatatagcgatataactcacctttagtaagttatatatcatatttgtcctagtagtaatatgttcttcaattgcaacgctgttttggccattgaagcatcagatgtttttggtggttcatcttgttattcaagtgtaaaagccagaagcatgataaacctgtgcatccccaggagcatagatggtttatttggcaatcactttttttttcttttcatgtaattgcataaaatctgctgtgcatcatgctgtagtttcgatttcagttttacatctttcttaatattgtttttcatgtgattatgcatctgtagtcatcagtcagtacaccggcacaggctagtatttttattgtgattttggaacatcattatttatatttatgaatattttaatttgatatattgagaaaactctatctaaacaacaagaaaattccttgccagcacttttttaaatcttctgagaatacagtacacttatatttttcctctttgccaacgaagttattactttgggtgtggatacttttgtaatttgttgcagcatgatgcttatatttagtatggaagtttagtttttaaactctggaaattaaaacctaataaatcttttttttcatggttacttacagcctaagaacatttttaagacaagattagtatgtaagctagctacatattcctctaggtatgctttagttgtatgccttaattcatactgattgggcagatagtgtaaatcaacttgattagaacatgggaatcgaaaataaatctaattattctgtgtatatttatatgttcagaccttgtatacatagagttactatgaactgaactttgatttgtttttccaggccatgtgcgcccaggaaacagattcatggatgccttctggttcttatcttcatattgtgtgcaatgcatggaacgcatgcttctgagttttgactattactttaaaaactactactactctgatacttattatctattgcatgtagggtgtagatgaaaacattaaatcaaatttgacggtcatggtttcttttttaaagattaatgtgtcatgtttagccatttttttattattgtgtgaatttatttattttagaatttttaagattaatgtgagggcttcttattagtataaacaaagcttcagccgggattcttctactggcctgccaaaaaactattttgtaaatttacaggataacaatggtgtaattactcagatgatggcatttggcccttaagaatttgaaaaatatttaaccagtgcagatgttaaagaaaatatagctactccctccgtcctaaaatataagcattttttgaaccttgacatggtctccgagatactactttgaccaacaatatctataaaaataagatgttttaaataaaaagagttgcatattatgattgtttgtttaataataaatctagtaacatcaattttatatgattgctcttttttaattttttttttgctattagtggtcaaagttaaaaatgtttgacttgtcactgtgctaaaaatgcttatattttgggacggagggagtatttattctcaagtagctcaagattaccaaatttaatctattcagattgttatgtgcaagcagatcataacacctgaattgaagcacatgttgggactctatcaaatgttaacatgtgcagtcaggcctcctcataggttaaacataaaaattctaatacatggtggatggctcaatgtgttagttcgtgatagctcaattatgtgctattaatatacagaaggcatggaactacagaactacagaaaagcatagcatatgtacaacatgagtcactcatattactctcaaatacgtaaatgtctttccctaatcaaattcaggattttctgatttatgtgctctgaaattgtgaaccacctgaagtagaactctttgtctgcgaagaagctgtgctattatgcatctgcgaagtttgacttgatgaaacatctgagaaaaaatttatgacatcagggctttcatcaagaaccttcagtgaccttggaacaggaggcatgttgacatcaaggaatccctctaaaatttggacgacctgacccattgtaggtctgccattttcatcatcttggatacaccagcaggcaaccttgcaagcttttgtgagctcatcagcactggcatctccattcaacctggggtctaacaaggtctgcacatcaccttcctggagtttgtttacagccaaagttgggaagaaagaggactttccctcctcccctagatcagcattccttctgcctgatatgagttcgaagagcatcatgccatagctgaagacatctgccttaggagtaatcggcacaccactgatccactcaggcgcaaggtaaccccttgtccctctcattgttgtcaaaacacggctgaaatcccgccctaagagctttgctagaccaaagtcagacactttgggtacaaatgactcatccaaaagtatgttatctggcttaacatcacagtgtattatgcaatccctacatttttcatgcaggtaatttaggccccttgctgttccaagtgcaatttgataccttatggcccagttcagtgccgttgtctcaccatggaacagctgcaattccagggagccctttggcatgtactcatagacaagcagtcttcttgatccttcagagcagaaaccaagtaggcgaaccagattgacatgttggatggtcccgatggtgcttacctcagcacggaattgcttctccccctggctcagtccatcaagcctcttcactgcaatggctgttgaatctgggagcttccctttaaatactgtgccaaaggcacctccacccagcttctctgagaagttgctggtgacatgctgcagatcactgtaccggaaggcaatcagtgcgccccctgtagtcttggatatgcgaagagtcctgtctcggcggcatttctggaatacgatgaacaacacaattgcaaggattatcaaagctgcagcaactccacctacaactgcaccaatgatcattttcttgctctttttagagtctggaagttcagacgctgcaagcctgaggaagagtgtgcctcctccattcccattgtattggtcttggaggttaatcaagtccccatgccaaacaaagcagccactactattgtaagtgtaagcattacaggagcaattattcaggcaagcaacctgacaggcctgagaactagcggccactgcactctgagcattatcaggtagcctcacactaaccatggaatagaacttatcaggctgagtctgtgcagagcttgagttggtctggcactacaacggtacgtttctcttgcacccaccagtaaaatcctggaggtcccaatcactctgaaacttctggctgaaccccttgatgcagttgcagaacggcaggacattgaggttgcaacttccatatgcgccgcagagcccgtacacctcacactgcgtccgtggctgggaccagaacaagatccaattctccgaggctggtacccatgtccactgcttgatctgcccattcacatcaatggtgaaccgcgagatgatcgagtcatccttcatggagtatatgaagtagctctccgagacattgttaatgaaccggaagttgtagttgtagccggccgtcatctcgggcacaagactgaagatattaccgttccaagggccgctggtccagtaagtgatggagtcgttccactggatgaagtactgcgttgtgccgttgggatccagctcaagggagaacagcccaggggacgggtttgcattgttcctccatggcacaagccgctggctcacaccagtggtcttgttcagccccagcttgccgcccggaagccaggtgtttgtcggatgatctatgctcctccagtagactatggatgaattggtggcatccatgaggtcgaggctaccgccgtcctggatgacggcaacggtggagttggaggccacacttacgttggtcgaccacagctgcctgttcttggattgatcaaggaggacaagattgccatcgctgccgatggacaaggatgcggtggtcgggtcagacaccggcacgtcgctgttggccgtccacaccgtcgtctgcaacggtatgttgttgtaccatatagctatgtagtagttgccggtgccggaggcggtgttgttaccttgtggcggggtgtagaatccaagggcgaacctgccgcccttggagacgatcttctgcgtcccggacagcggcgtggtggagttgatggtgtccactgcggtgcagagaaagatttggctgaagaggaggaggaagaagacaggagccatggatggatcttggcagagcagccagggctgagaacctgggacgaatggaagctgagcttggcctttggagtaatttgattatggtggttggaacctgagaggaaggtaagcttggtcttataactcatatggacagcaaggctccacttcacgagatattgcagaatgaacgctctttgacctggcacagtagagggttctgtggaaaaggtacatacccgaagacctggtgtttgtttatagaagaataatcaatatgaaatgtaatattctgtttaaagttgtggtgaattattaaatggtgggttttattttgtttttttgcaggaggggtgcagaaaattggttctacagttttgcttgcgaaatagtactgttcctagtattaattaattttgctgcctgttcaactaatcaacttgtgttctaggattgaagatattcgtgtcccctcttagtaatttattagtattcacatttgtgaacagagacgccaacatctgctatgatgctatcctcttagtaatttattctgttgcgaaataaatttaaaaactaagaatagtgtgaagtcaaagaaaggtgttttggacttgtggcttgctggtggcagcaaaagctccgggggctctgcgttgacttggccttagtttaacgtggccggtcgttcagagaaactcttttaagacttgctagtattatattttgctgaggtttcaaaattctctgtgctaataatttcaaactttgatcaggaccagaccatctccctttgaagatgaccaaaatcttgaagttggctgccctgttttctctcatgtgggtttctagagaccgggtaagaaatgttgctgcaagaaaattagctggtcatgttgatcggcgaatagcactgtcagtgttagaattgcctgctgatctgttgaaatgttgagtgttaccaagactaacagtatttataattttggttcatggatatctgttctttccgtaaataactttcgtgtttctcattgcgatcaatatagaaaaagcttctgctgaacagctggtgtgaacgttgtcttcctacacgtctgtctgctgttttttcttcccgtcagatttttgttctgctttgtttttgtcatattctagtttttgtacacatctattccttcctgattgcaaatttatcaaattagttggtcagtccacattttgaagggctaatctggtatgatataaatcctatgtttcagaaaattgggtgatataaatcccaaatctgggttaaacactcgttgccatgtttttttataatactgttgttgccatgtttgagaacaggatttgttgtcgaacttagtggcccaagcttgacgatgacttgaccaatgaccagtttccttccttagttcctgtgtcgaagcatgtctcagcatgttaaatgctcactcattcatttatgaccagttctctgatatgatgctgatatggaccgagagcattgaagtggcattgatggagagcagatggatgaacactgatcaccatagtgtggaggggagagggccacagacgcaacaaggagatacaatcatacagataatggtgattgaatctcatgaagacgaagacaaagacgaagataaagattaagtgtttcacgcaaaataaggtggtaataacgtgtgattaattaagtttgaattattacaaacttgaaaaatagattaatcttatattttaaaacaacttttatataaaaagttttcacacgaaacacaccgtttagcagtttaaaaaacatgtcatttttatccaaaagtttatccaatatttgttggagaaaagaacatggcaatattaatcttataatactagtagttggatttttcatcaacacgcgaaaaagggagtacatgagaggtggtgcggtgccttgccagttgccatgccactggcaaattgcaaattgtaaggacgcattcatgtgtgtcactgccggtgtccatgtgcatcgcacaaggagagtggcctgaagaatttcttgttgattgttgaacatgttgatctgtcctgcagtaaaaaagatggtccaggtctgagttaggacgagtttgctcaaaactcgcaccatattgaccgttggcttttttaagaaacggcattgatatctgatctgtatgaacaaatagcaagacttgcatggccataacccatccaacatgatagatttgaaaaatacaatggttttttttcattcttaaattgccccggcaaaaatgccaaaatggtaaaaaaaatcatattgtaatgttttttttgcatctctagagtagacagatagagaggaccagataaggtaggagactacatgtagtatacatagtgttgatcaacgacctgcatttagttcttccataatatagtcataaggttttcgggtacatgggccaagggccaaggaacgtggtatgcttcttacgagagatttttataaggttgggataaaaatatccccatattcctgtgattggaatgatttcttcaatcgaggaatactaccttcgactatttcttgatatgctcacctttcttcttaaattattgacactaaactccttagattttctttgaaccaacctgtttacttctatttttattttaccctccatcgagcacaactcttcatctttcctagtcccgtctcaccacaacccaaatcctagtgccttcctctagtcccccttcctcttcctcaccagcaagctattggtaaagaggggaaagagacccacccatccagtagatctagttgcttaggttttcagccaaataaagttaccatctttccttgccgtcgtcgtcaacaacggtagccatctacctccgtggtttcttccatgagggtatgattggctataaatttcatgttcatgatgacattctttagaatcgaatcctccggctctctttgtttcaccggtggtccatttgccactggtgaggagcttgtgagggttgtggttatattgatggatggtggcctgagagcatatttggttcaagctcggggcaaggccttgccgttgtttatttagcagttctatagatccgttgttcgagatgaaaaattatttaaaagccaatgtgtaattcgtattcatccaaatttctcttggttctctgtgtattctctcttccaatgatatctctgagagtccataaatatatttttccaaggccattattgcgcccatggcgacgacgggtgcaagttagtactgagtaccttaccaggtattggatgaaatgctatactcgcaattatctaagaaagaagactcagaaataatcatattatggttttgttagttatgcttcagcaacgcttcttaagtaaactggttgtctatgaggtaaacatattatattatattctctctgtcccataatataagacgcggtcaaaattgacacggtctccaaagctaatctttaacttatattttctcatatacaataagaagatttgtagcaacaaaattataaccatatgaaagtaaatttaaatttcaatataataatataatttttaacaaataaaatttattccatattataagtgttggttaaatgttttaaagtttaaatcttgaaatacgcgcgccttatattatggtatggagggagtaggaaatattccccgattgctcagcaggcttgttgacaggtacgagacacacctcttctcaaactcgttaactggttttatactcaaatcaattaacagtgacatgaacagcacaaaaatctcaagtcttgtcttgtgttgcaccatggcagatcattatgtctacttgattgataaattggtcgatattgcactctgccgaggagttgaggatctggatctgacaacaaaactagaccaaatatatcaaagatctgacatagcttggtacaaatttcctttatccttgttcaccaatggcaagggattatctctgttgaaactcaaacttggccaatgcacccttagtattcccactggttttgatggattcaaatgcacatttctgatgacatgattcagacacttcttgaaaattgcccaaaattgaagagctttcacctgaaccatttttggggtatttggagctcagggacatgatgatatgtcattgctttcatatcaaatgtatcgagcttgttgctcccaagttgcagaagtccagatatgcagggcgatgcataacaatggtgtttgcctcaatcccgtccattgagcatgcctggctggattttcatgatcacgagtatgctggctcttttgagtacttcatccgtcctaaaatataataatctagaaccggataagatattttctaacactatgaatttagacattttctgctgtgttattagctcaatgaaactttgtttgagggttttggtgtaactattggctttctgttatggaaatgctatcacgtcagaattagggaaaacggcactccgtttcgtactatttttctgtttttgagaaacaatgtttaccctctagttgtaacttggatgattgcatctcgagtggacctaggggtgaaagcagtacataaatttacgagatttccggttgactttttcagtttgcaccgaccgtttcagtctgtatcggtaactaacggtggtggaaatgaaaacggtaatatcttccgaaaatggtagcggaaatgggatggaggtttttccaaccgttttgtcggtaaccatatttgtacgataatttccgtcaaaatttcgaaagtttcctaggagctcagctagcctaacccatcagaagcccatgaaagaagaaagcctggtaggcttgcagcccataaaaaaagagaagtgactaggtaaaatggtattaaccctatgatgtggcatgtggattttgctgaactttggtctccttaacttatcgatgttgaagtattgttgaactttgtttatattggtcatcaaacttattatcataccattaatcatcatgtaacagtgttatgtggagtgtgatgatgtaagaataaagttaaaaagtcatcttcgtgcatagttaaatgtgtgctatgccatactctgctgattctgttgacttccgaccaatatcggtatattctgttccgacggtcccgttttcaatataccgatatcattacagttttcgggtctaccgtgccgattccgttttctataaaaaaaaatgaaaatgaaaatggtataggttttcctgaccgttttcatccctaagtggacctatccttttgtcaattatttttttcctgtggtgttttttttcctgggtacacttttttcttgtcgtttttaattttcgacttccaagttctaaccctgtactgttaggtttgcttgtaactttcgtatttacgcgtttaactatagtgttttatttccatagattttgtttcatttaaggccccattttaattaagatgtaaatttttactcggttttcgttagtacaatttttaaactactaaccgatgtatttcgcgtgaaaactttttatatagaaattacttttaaaaatcaaatatttttttaatatgtaataattaaaactcaattaaccacgtactcatagctttatttcgttttacatgttctaactttaccgacatcttatattaattagaaacaaacaccaccttatttcagtgacatggttggtggttaccagagtccagactccagaatggatggcgaagtgataggaagctcggacaaagtcatgagaactgacaattaatttaccgttaaaaaaaaatgtcgtcagcttattcagctcgcgggtcaaccgtgccatatctgcaccaatccaagaacaagaagacgcctcaaacattggagctataaaaaaaaatgctaacctcgcgtcacaacttgtgggggtgggttagtacgacgttgtcgtcatctattatctactccggcttagccggcgcgagtcacctcgccaacactgcatccatgcacctgaacctcatcgccaccgtccatgtctccaccaacggccgccgatcttcgccggtctccatgcgccagcgcccctccggtccatgtgcttttcgtcacacgcgacgcctaaaaagaaaatgttatctccgtttttaagagaagaaacatgttttatcattcgtttttatttaaatttttttctacataattattatttataaacatttaaagatggttttatatcttacgtattggtttaaatgttttaaataagacgtataattaaacgtgtgtaaagccagcaacatcatgtattatatgtaaaatggaagagtataaacggagtcgcaactcgcaaggccggcaaggcaagcaaaagctgctgacacagcactcctatctgctcaaccacttgcttggcttcctctgctccggcgaccgggcggccggccggccggcggcgagaggtagcgccaggtgatccatccatccatccatccatctcctccccccttcttgtgatcaaccgttaatcagccgccatggcccatgggtttgagttgatgatcgatggagctagcttcccagattcttgcagacttttgtgttctcgcctctgcctccttaacatagatgatggctgggcagtggtatcaagtagctcaagtttgtgatgaattctgtgtgagatgctgaaatgattatagcaagttctagctatgcagaaattgtattgactctccatatttatgggaaattttttgctgtggcatgcacgttgactttttcgtcatgtactgtactgcatgaacttgatgtccttgcacaaagaaaacgcctctttgaaatatgctagctgggttatgttgattttgttttttaaaaaaattatgcctagttgaattgggatcttgagagatgtattcaccttctgctttcaggggcacagggctgcaattggaacctgaacttgaaagcaagttgtgcaagaggacagaaaagaatcagtctgaatatggctgcctcaaagcttcaggccttttggaaccatcctgctggccccaaaacaagtcagtggcaaccctgtttgccttaattttagtgtaaaatggcaattgatattcccatagacatgattagggaacagaagctagcttacacatgtcattacacagtgagaactacttcccagcttgtcaattattaacagatgacatgattagggaacaggctgatgctgatggttccagcttacagttcagaatagtatgtgaaatcagacagcctggtttgatcacaagccagtttacaaaatactaaattactgaaaccgtcagaacataaaaacaacagtgtttaagactccctccttcagatagctgatgtgcttcattcttcaattgtctgatgatccatttggtttctaatttctagtagtagccaagttccatcttctcctcttcttctgatctgatggatgtctattggatgaaacatttaacatattcaatcactgtcatctgaactgttgaggcttccatctgatctttgttgcagttcatttctgggccccaacattcaaatggggtatcagtattgccaatgttgctgactttgccaaacctcctgaaatgatatcctaccctcagcaagttggtaggtttagttgtcagttaatcttattcctgacatcagtttatcatcaattcatgtataatgttgttgtgcttactctgatgtatgatgtatgatgtatgatgtgcagttgtggcttgcagtggagtaatttgggcacggtggggcatggtcatcacacctgtaagcccctgatatttagccatacatacaatcgtttctcgttattatggaaaaatatttggaattttggattgtatatctcatttgaatgcagtctaaacagcaacttttttgcgcaatgtctagtacgattctctagtgtaggttagtgcggtgtactgtaaaggagtaactgttttgaaactgaatcaagccaaagacctgttttatgactgttgtacttggatagactgattcagatatctgttttatgactgttgtattgttgcagataaactggaacctctccagcgtgaatgctgcaatggccgtgacaggcgtgtgccagctttcccgtaagataaggtctgttactgcaaaaccaatcctcagcttgctgatttataattccagatgtgatttctgataaattagcaactttcgtgttgatctcttacgattcgatatgtgatttctgacaagttaacaactttcgtgttgatctcttcttttacaggcacgattacttctctgatgagaagagtgctactgcgtcgctggaaggatgataggaagaagaagaaattgttgtcatggaatggaacactaatttcattatcagtcgaccagcacagtgttcactgtgaatgtgtccgcttccatgataacaaattaacaatcccatgtgtgtgtatgatcattatgaattgggctatgggtatgaaatgtttttataccctttggtatacagatagtaagcgagtctgaacttaactgaaacggacttggtttgagttcagctcgaagtacactcgaattaaacttaactcgaacggccttaactgaaacgagagagctcccttcctctgtgccatacaatatgtttgcaatttcggtttgaaattcccgaaatttcatttcggacttccggcacgaaactatttcgcctgaaattatattttctttctgaatttggtcaaattttattcaagttcggctaaaatttcttcaaatttcaaaaaaaaaaaactattcaaccgagaaaaaaagctcctggaagaaggaccaacagggagaggcacaaaagcggtgaaccagagcacgtaacttactccacaaatacctaaccaatgttccattcttcctctcatcttgattttataacttttagacctaacaaacattattcattaaccaacgctgcgtgttgctttgccctctgaaactactggaacggcaaatagcagcaattgcctccttcttcttcttttttttccccctcctaacaacacggggaaaatgcaaacgctttgcccggaaaactcatcataactgatagcggagagctgcgaatatatgccatcgcgttagctttttccaccggagttgtttttttctgactcctctcgcggcgaaagacgatgccatctgatttcagtcgctgcaggccttcctgccaagtagtagcttttgttgcgtttttcctatcaaacggcagtaaattaagtaaaaggctggtaattattaattaacgtgaggcggcaagactttgttgtgcaaaagcaaagcggcagaatgttaactttgggtaagtttcgaagtaaaatcgtgggggcatcgatctacagggagctggaataaaagaccatggaaatgatggaaaagttggaaggcagcagcacatgatcagatgatctgtttgaaattgagaagaaggtgttcccgaatttccacccatgatctgtgtacagtacgtatgcgcaagttccgttaatttctcacgcatcagttacagcctcatcttttcgcctatacctatatacttatcaaccaaaagttaaattttcaatcttaaatttagacttgattttgagattttttttcatcgaagtttatttttcagcttttacttttatatcgctaagaacacgtatataaaagctttattcataaattatttttcgtttgcatatatgtcgtttggcttattccatcgataagccaaatgatggatgaggctcaaaatgatccacttagatggatgagactcctctcacataaagttagagggacatggctactgacatatgggcccatgaaggtgggccccatatgtcagggactcatgtccctctgactttatgttagaggagcttgctcccacttagatagctagtttggtaaataggaaaacatgcaatccatgaaatacagatagatactccctttagactccagtcataaatattttaacgtttaaaataagatttgatatatgaaactttaatagtcaatagtttctcaagtgctgagcaaaatggtatatgcaagggcggatctaggaaaaattaata

SEQ ID NO: 35885 - DNA, 23963 bp, Oryza sativa
  unsure (1)..(23963): unsure at all n locations
gattgtctaattctcagttgcatgaaaataaaattaatccaattttggactgctcatattgtagcgagatttgtgcatgaacagtaaaaattatctctttcaccccgcttcattcttctattgtaacacacaatctcctctcgttctctccgtatcacaagcaccaagccaccgccgctccaatccctagcgcgttgcttcaaccacctatccacttcggatctaacgcccccactgctaaaaccttgcgtagcacaagcaccaagccaccgccactctaatccctagcgtgttgcttcaaccacctatccactttggatataacgcccccactgctaaaaccttgcctgccgctcccctccaaccccactactccggtggagggtccaccacctcgtcacatgactatgtccgccactggtcttactaacaccctgcaactatccctctaagtttgagaaaaccctcttcttcccctccctcaaggctccctcctacatcaaccacaaccctaaactttaattcatatatctttcacccgagttggagtgtcgctagcaccgcagaagacagacatcgtcaccattgtcgttaagttacctctccttgtccctcctccctaccgtaaagaagattgttaggttgaagatgactgaaatccctagcaattttcagtgacatgagatatatcaatccccttacaaattttcctcaacgttactacatatttatgacgggattcctgcgattcatggcactgtgaatctgtgatggcaacgctgttccaagacatgaaactcgcgtgccaaatactgagcataataattaaagctagagcgtctgtcaatcgggtctgaccggcgcctctttattatattattccattattgttaacctccaaaagccgcggaatcgatcatgttttgcaattttgcaaaccgagtaaggccacgtacgcgttccggtctacttaaccagatcccgccaagtcaaccaaaccacaagtactacgtccccaccacaccacgtacgtacgcgacagcgcgcgaaacagcatccgtccgtctcgcggtcgcgccgtttcgcctgtcctgtggctcgctcgcggcctcactcccaatctccgactcgattcccactcccactcgcgacgtatataaattcccccacgcgcccgcgctcttcgacccatacaccggcacacgccgggccatttttttgaaccaacgcgacacgacgcgacaccggcagcagctagccgcggtgatcgctacgacgatgaggttcgcgtgcttcagcgccgcggccgtggccgacgaggcggaggccggggctcgccaccaccaccaccggagcggcggcggtggcggccggcggcatcgggggacgtcgtcgtcgctgcggagcaagttgtttggcggtaggacgacgaaggcgggcagcaagaagtactcttcggcggcggcgctggacgatgtctacgacgcggcggagtggtcgtcgtcgtcggtgccgtggtcctcgacgtcggcgctgtcgctggactcggcgcgctcgtcgtcgtcgtcgtcgtcgacgaacgacgacggcgccttgctcccgctcccggtccttgtcgtcgctgtcggacgcgctgtctccgcctgctgcgaggcgcgcgccggagaggagggggaggacgccgcggccggcggtgggcgtggccgcggtgatcgtgtgcctcgtgatggtgatgctctgcggcagggtcggagccacggcgctcgtctcggcggcgttctaccttttcccgcggcggtggcggccggtgggtgccatcgaggcggcggagagcgcggcggcgtcaccggagcatgactggccgtcgtcggcgacggatcaggagacgacgacgaagaggaaggtggttaaggaggggttcttggcgcggaactgcaagaagtgatccatcctttttttttcctctcctttttttttgaagagaaagaacactaatttccttcaaattttttacctcgagagttgttgtaattatagaattccagacacaaatcaaataatcaatcatcaaagtatcaaactgatcaaacataattgccttgtagtgcgatgtatttttgcccaagggaaagatttggagatataataatatcttagcttgtctcagtgacgcaaagtttccttcttgagtttaccacagtgagagatagagaggtcaagaaagcaactgatggtcttctcgatttttttattttttttaaaaaaaaagaggaacaaagaaaaaaagcaacgcatgcatcgtgcatgcacatttccattgcgggcgccaacaaattccttcatgcgtacgtgctgtatccatggttagctaattaagctagtggatcgagatggaactttatccaactttgcaataatgcaagaacctaaatagtctatattactcctatatgtaagagtaactttggggcagcttacaaatgattggcactttaaatcattattgtattcatcttgtatgttatatagtctgtatgtcgacagaggtcacagttgtaaaccattttcattattaaaaagagtccaaatcacccctttgaactattgagtgagtacaaattaccctcatggacccgaaaactagatatctttaaccctcgactattaataccggacaaagaaccccctacccccaagcattgttctgaagcggttttgacctgagattgcacacatggcgtcagcgtggcaatccaatcagctaaaaaatagaaaggaaatccatggacgcacttgtcatctctctccctctatatatcccctcccctgccttctctcccctggtctctctctctctctctctctctctctctctctctctctctctctctcggggaggcatacccggaggtgggggagccgggaggcattcgcggcagccggggagctgggaggcatccgctagcttgagctcctccgcctctgccgctcgagttacgccccgccctgtcgttgtgcaaaggcgcgtgcgtccgatgctcgcctctgccatcgagatcctatcctccccgctactagagctttgccgcccccaaccgcctccgccatcaagatcttcctccctcccactcgagcttcatcgccctatcgctgtgccccatcaagatcctctggtggtcgccgcccacaaccgtctttgccatcgagctcgtccaccccgcctctcgacgctccgacgctctgctgctgtcgttgcctccgcccccaccctcgcccgccgcctactcggctcgccctcctccgccgcctctctgttgatagagagagatggaggtgaggggatggagaagagagaggaagtgatgagagggagaagagaggatgagagactgacaggtcgagcccaccaatttaaaagaaattgtagaccagattactatgtacgatcaaaactattatggatcgagtcagtgggataattcatctggttttaatagttaggggtgaaagatatctggtttttggtatgaatggggtaattcgtactcactcaatagttcaggagggtaattcagacttttccctaaaaaatatagttcgtgtttgccttgtgatatctttttttttttgcaaagatatatataatggattattcgaaatgataggtagtccctaatcatggtaaaatcatgttgaaagaaaaaagaaaggcaacttatttttgtgtgtgtgtgtggaaaaagaaaagggcatatgttctcccctttgttcatttgtccagacaatattgaacgggaggctttttattataaatataaataaacagacccctttaaatcttgctacctttttctagaggaaaataataaatcttgctattttcacaagttggtttgttaatttaatcatgtacttatgttattgtggcgcgcaccgaatgatgtgatgttgattgtatgctctatgattttggaacatgttgtatttcggctaccagcctagtggtaggagtatcaatatattcttgaaagtaaattgttgagttaaatcgttagcttgttgatttaacagctaccgccaaaatttcaattttaaaagttagattttgagttttattcatcgtagtttattttctagcattagtttttaaatcgctagaaaaatatcgatgtaaaatttttatccaaatattattttgttgcttcgttcatttttttcacaagccgaggagagaacgatgagaggttcgtttgctgataatacataactccgatagtccgatctatacattttcttgttatatctgaataagatgggactacacacctcttataaaaataaacgtgaaatttgcctcgctgtaacggtacaagactagatttggcacaggtgtttcatatttatggctaattactttttcagcagtaaatgatgtattcgtcgacggcgagacgtatgtggtgattttgttaacctcaaaatttaccgatccagttttcgaagatattgtgtgcatgtatatgtttattggggtgagtgtacatgcacgcgcttatatgagctttcatgtttgtactatatatgtttaaaaaacaaggcaattaaacaatatatatatatatatatatatatatatatgtatttatgtctaatttggatttaaattggcaccggcagacgccagtccaaagcagggttagatgtgggttctcatgaacctagtacgtacgtagcttcatgccttcatacacaaagaaaataatagtatacacactgagtccttgttgatagctatgaggttttggaaagtggccatctccattttcatagctgaaaagctgctttattgcttgggcaatgataccaggaggcagcattatagctgttataaccgtagcttcgttactaagaaatggagcagaggttggattgcattgttaaaccctaaaagccatggccctcgaagtattaaactaaagccgttgttttctgagcttcagcatccatccatccatgtgattatttatagattgccaaagttagaatatacctgatgagcatgatcaaccgtaaagatggatcagcctcgtggaatgcatgccgtacagctaactagcatgatcgtttacttatgggttgagatgttccaaacatgcatgattctcacgtgatcaatagtcacaaatatacctaagcatcttgcaggtttgtcaagcatgtcctatctcaaaaatgaaaggtagtcaactaattcagcttggttggatctacagctgtattcagatgcaatatatacctggactaattagactcaagtcgtggttttgcccatgatgcggaacaagcaacattaatttcttcatctgaatcgcatctcttcatgaattgtagagaattctagcggaattggtggcatgcatgttttgtgtaacatttgttctaaaacttagggcatctttttaacgcaggaattttacgaaatttacacatgagtgattcaaattcctataaaattccacaggtcttaacaattttttgaatttactgctatgaaagaaagcaaaagtgagactaattaacattaggctgatcatgagaaagtgctactagttaaataggatgattgataattcacatcaggaagcaaaggtgactttagaaccaaaggtacaatcaagccgtggacacacgacaagcacacacatatgcagccgttcgagtgcgagcacaagacaagcacatcccacgcatgattgattgtttggtaaagggtgaaaccctagtgcaaaggcctagagtgaggtgtcctccaatccttatcccagacagagaattatagtaactcaaaagctcatcccacatggaggagaaaggcaaaaaaaaaataaaataaaaagatcttgcattggcttaggagccttaggaggcagcagggccctgcattattgcagctttgttttgcaacctttatttagtagccttaataatccttttgctggttgtactaatagtctagtgcatctgctagtcttattgagtcttgagtgatgacaaagtccaggacatgctgggaactccagcaggtgtactgtggatggaaatcataagtcagattagttatagtgcaattgtacttgtttctgacagccgaatgcagaagtttgaatcccctcagaaattttcggcatttaaatgtttgctttttcccccccttttgtttatgtattttatgttagaaaactaattataacttgaagaaaataagagtaacaatatgtttaaccaagaggttaattagcaattttttagctgaaacatcactcaagacagtaaaaccaacatcaattgaggattgagcacgttctgtttccattcatgagaaggacctaacaacagttgatgacatttcatttgattcatgtcaatttgtccctgaaagttggaagttgaaacactatgtaacagccagaaaaatttacacttggattcatcataagccttgagcatcatgatataatatagataccgacttgagactaaataaaaccaaatacacgatgagaactatcacctaagtttacaacaacccagttgcacttgcacctatcacccacatatggttgctgccagcgccaatacaaattttcaggcttgatacaacaaacaggcctgtaattgcagtacagattattttcttgccggacagtccaccaattctcttgagaattttcaccatttcaattcgaatttgtgcaaaagggtatatgcaatacaactgccaactgctattatcctactgctctggtagatctgatgggacgagtggttcatgctcattagcaccatttgatgttctgtccatgccacacacctcaggagattttataggcacaaaagaggacttgtgtagagcagcaaaagccttatttccttcaccgttgcttcctaaacaaatggtatcaccccgcccatgccagacaccgcactggacattatttatctccaacgtccgagcctcctgttcattcaatgctagaaactgttagatcaataggtcaaaaaaacaagtaacgcatgttgaactgggacttcagaggggtttcaagatatataacctggcatagcgtacagcaaggacaaatgagatggagaacacagtcatctagactgctatcagtgccctgtatcaggaaaaaaaaagtcaaggaaaagaaacgaaggtgcacaatcagcttaatcacaaaaaaagacagtcaatgagatggctggattttctccaaactttgtgcttggcaattcctaaattgaagtgctcatatttatatctacccgtatgttgacaacataactatggcaggtattccaaagtccaaactatcaagaccagcaggatttagttttcatttgtttgagttaagcattcatagccatactgtgtgatgcaaatgaaaagaagagacaaccaactgcattaagcagttaagcactaatactaggctgcacaataacaacctgtttcaatgctttaaatgaaaaatggtaatgccaagaaatacgtaccctgatattgaactgcttcctgattcttcttcggaagtaaccagtatagattgctatcaagagaacagagctaagtcccatatacaaatatatattatgccttgtgacagaaaaggcgattaggctaaccagaatagccactaaagaaattaagtaaaccatggcctgaaacaattttaatcttctgtcagatttatgaacaaaggataatttcaagaaaattgatgcacatatgtaatatagagtgatgcaataaattccaataacattttttacataagaactgagatagcaatttatatttagtatttcaagactgaaatggctattaaatgagtaaaatattggcaagtccaacgtgcagtctgattcacagtaccatataatataagtaaagaacatctcactagaacttatcctatacagaatgaatcacaatttgaaataaaaaaagcatgatgcttatcaggctgactaggtttaagacatgccacagacatacataattgtgtaagcaaatgtagcacacattgacaagtcaaacatgtcctgcattaacaactcaaggataggactatggaaaggacgactttgctgataagggcccgcatttcaagaaactgtcagtggtataacaagagaaattacaacataaacctatggcttgtagattacatgtaaactaaagaaagaagcaagaaggtaaaaatacagaaatgcacagttcaaaatacacaagtacacaacaaacatttttttctcagccctaataggcaatacatcagtgatgaaaaaatctattcggtgtaataatattcaccagtggtaatggtacattctaaaattgactcaaagcatgttccaaataggaggttttcctagttcctatcaatagcaatagcaagtaacctcaggtggttttacatgtttacctcgagagcagtttttgaccagaatcttttcaaagaaaaagtacaggtagaaatggacgaatatggacatatgatggtgagagtgttatccttacctgaaggaagcaagatccaagattggctctccgcatgttcttgccgaacctgtagcatgggcagctgcagatggtcgcaagcaaacgacttcaaaaacatcgctcacgcaaagtttaatggtaaatatttaaatgtacagcataaaagaaaaaatgaaatattttgcagaaattagatcagaaccacagaataggcaggatgcctcatttttggggaatgttccctgacaatttatcatcccaaatatgcctgattccgagtttccaactacagatgtgcctaagattttttttttcaacagagttaaaattcaccaaactgtgacgctggtttctaattcaaattaatcgaaactgaaactagagagaaaaagtaagacttcaagcaaaaaatttcctccttcatctccatgaaccttacaactccaacgggaaaagcccaccaaattagagacaaggaatcggatttgaagctctgtcaaatttgaatagtgcgatttccagcaccgggctccccttccttcttttttttttatgcattccgaacaaaggcagcgacctttctttcccaaatccgcacaaaaatcagtcaatcgacatgaaaaattcccgctaaaacactaaatcccaagcttccccgtcgcgcccagcaaaaaccagattccaatcaaacaacagattcacgaaaacgaggaggaaaatagtcacagctccacctaccacgcggcctcgagcgcgattcgcctgtcctccaagcaatccagcaccacgtccccttcccacatgctgtgcacccctcctccttcttcttcggcttctncaccaccgggcttcaccgtggcccgccgcggcgcggccgaatacttcctcctttccgccgccagcgccaccgaggcgcacagcatgtcgaagtccagcaccgccatcacctcctccttcttcccctcgctctcctgccggctcttcgcccgcgtcgacgccttcttcttctcccgcgccgccgcggccattctctctccctctctctctctctctctctcctttctctctctaaagccgcttccgtttcgtatttgcctcgggtttttaacgcttagagcgcctccgattaggaggagaagcgaagggagggaagggaagagatataacacaattcgattaattaattaattgattgattaataattaatcacgggtgcgcgttagaattttttaactaactgattacatgacaggtgggccataggaaagcgtggttcgcgcgaggctgccactgcggggcccacgagacagtgagataaggtggggaatacgtgggtacgcgtaggtcgggctgccttagcaatcggtggttaaaccgggtaattagtactagtagtaattatgaataattaacacgagggggatcgctaataataatggcgcgtgattgggtggtttattagtggttggatcgggcggccaagcccacccgccagggccagactggtggtgggccatgtgggcccacgtggcagtgggagtaggtggcggcgttcctatccatcggctcgccggcgctccggggcaccaaacgtgtacctgagaatttgcgtcatgaaaggcacgtttgttttttttaagttcagccgacatgttttgcttgcgtatcctgaacaagaagttagttcttctgccaaatcaaccggaaatgaatgttcttctatcttggaggtatctttgtttcgtggttttttgcatgttcatgtgattaatagtatgcgtattagatttttcaccgaaaaagctgttttggtctgtagattactaaaactacaagggctgtgtttagttactttctaactttcaaaatttcttcacatcaaatatttgaacacatgcataaagcattaaatgtggacgaaaaaaccaattacatagtttgcatgtaaattgcgagaagaatcttttgagcctaattacgtcatgatttaacaatgtggtgctacagtaaatatttactaatgacagattaatttggtttaaaaaattcgtctcgcagtttacaggcggaatctgtaattttttttgttattagtatatgtttaatactttaaatgtgtgtccgtatacgtcaaaaaaaatttggaggaggaactaaacacggccaaaggatgttgctttgcagcttgccttgttaattattagttttattcttagaaggtccattatgccnttcaaatcttgncgttggattgttggttcaaacccccctccccccccccccaaccccgaaaagaaaaaaaaagatgactttaatttgatactgcatcattgaagtctaatgtatggttcagagcgatacaagttcctgtctgtatgatcgacccgtaaaaagtgagatatgatttgccacgatctttaaaattttttagggttatgctttcaaagttgaaattcggccattaataactcatagtgcaatatattactataattaaaaccatgattatttgaaaatttcacccaaaaaaaatcttcctatatgttgcctaccaagctattgatacaaaacatagaggtgtgttgcatgctggaagacacttggggcttatatattcagacagggcatattacgtaccgtgattagaggaagtacaataacagattataaaagtaagctataaacacatattgagaagataacagatttgtagcgaactacagtacagactctaaaacacaatgtgtgtatgataggtggaacaatatattaataatgtaatatatgtttataggaaactattgtataaattgactattaaattaactttagatgatttaaagctaatagttagctatactattaaaattgctcttactccaattttattatggaagtaatgactcaagcataagggcagtcacaaccctccacctaggatggtgtctatagcattaactatattgccatataggacttttagcttatgtggtactatattaattaagagagagagagtgaatagaggaagaaactggggccctgtttggaagattagcccagggctaattttaagagctaatgtttagtcatgaattggtaggctaaacattagtctagggtggtatgtttggatccatgggctaattcaaggctaaaaggtggagagagagaggagagagaaggagagaaagagctgctttttgatggtccccgcacaaaattagccccattagcaccccttggaggggctaatgttttgaggggggctaattcacattagcttaaaattagcccacctgtttggattcttgagagctaatttgaggctaaaaggtgagggctaaacattagcccatgaaatcaaacagggcctgggtctcatgcaagacacaacttcaacacgagaacctatgcactgaacactatcaagttttgtattgggagataatagtgtcttcataatagatgaagaataaatatgattggtagagaagagaaatgatgtatttattaatggcccactttaagaaaccataagttgtaaagtgtagtttctattatgatgtcttattgacatgacaccatagacactttttatggatactatggattgtgactgctctgagcctcttggctcttgcacaccgcaaaacgcgcaacgagaggtgcacgtaattaatcaatcagctttaaaaccaagagaaagtagcacacccaacgcaacgcttctcccatttattttattttttcactccatggtgttgcttgctttcgcacggtatataatggtcggcaagcgagagcacgagtgggcgagcgcgatgcgatacgggtgaagcaaagcaaaggaaagcaaagggatgtcgtgcgcgtgccgcacgccacgaacggaaaattatgggggcggaaagcgacgccatccggtggatcctagccgtgagcgcgaagtgcctcgcttcgctgtgggcctgtggcctgtgcgcaccatccgtagtgcagcggcaagtgggcctcgcgcactttgggttgcggcttccgctttgagccttacacgtgcacggatacgcatcacgcgagcgagctggcgcaaagccgagagccgatcgatcggttgcaaacaggttgggaaaccacctcggccggggttaccatgtcccggtaatataagtaaatttaccacgtggtaactgtggcaaaccatttaccgtacaaagcgtaataacacgcagttactagcggtttaggaaactctacacttgcaacagcccaaaagagttgcaacttgcaacctgacagcttgtattttgctggtactttcgttgtacgtagcaggcttcaccattccgataaaaaccggttgaatttcgcggaaaaccgatgtttcgatatggctcaaaagtagaagccatatgaaatttcgacatggcttgaaacttgaaagtagaagccgtcttaaatttgttcgaaaaatactggctttccactggatttcgtgaaaatcatcataccgtcagagcctggaacggaaagttatctcggaatcgcaaaccctggtgtgtagtataggtgagaaatgctcggtcccaagttaagggtaatactccctttttctcgttataagtcattttttactattttactagttaaacattttaagtttataaagaaatgcagtgacattttcaataaaaataaatatatttaacgtcatgtttaatgaaactaatttgattacctatgttgttaaatatttttaaaaaactgattaaatcttaaaaagtttgactatgaaaaaaacagaacgacttatgatacagaattgagggagtatatgataagcctacgtctcataataaaccaacttagaatatgaagatgaaggaagcagtttggaacacactatttcaataatatttttagggattttaaggattaaataattttatatataaaccggaaaaaccgggtgtttcgacttccaagcacttgttttgagtgatagatgtgaaattaaacgtgtgccaaaggatgtaggagtaggtgtgtatttgtagttgtctaaagagaaaaatggagagcgttattgggccgagttaactgtaaagcccgatgttccttaaagggctggcccaggtgggcgaaattaacaaaaatccatatctggtggcgagcgtccgcgcgctcgcgcgcacggcggggatccagtcagccgatggtttccgccgcggcgtgcgtggtgctgttttcgcatggggctcgaaaatgctagttcgcgggcgctcgcgtgtccgcaagtgggcactcgcatgcgcgactgttggtgcacgcattgctccgccttctgctcaacccgactagatacaaggagaagaagaagcggggaaatagaagggaggaagaacaaggagaagtggagttgataagtgggctccaccatattttcatttttactgctgtcccttacatgtgggacccacttctatttttaatttctttgatgactaggctgacagcacttttggaccaagacaattacaacattagcaaaaacgcttctcaaaccgctaaaagagttaatttgcaccggtctttaaagttacgagaggcattatactcgattttgcggttgagacaagcaattcaaactagggacggcaatgggtcaggtcgggcacgagtagagcaaaatcatgcccgactcggcacccgaccttgcccgcccgaaccctgcccaacaggattaatgggcaaaactccgtgcccatacccatgcccgacaggcacgggtatgcccggtggatatccattgggtatgccttccgccttccgcctcccgtcgccggttcgccgccctcgatcgtcgtcattgtcgcctgctgccgccggctcgtcgccctcggtcgctgtcaccggctcgtcattgtcgccctgagccgccgtcgccggctcaccgccctcgtcatcgaggccctaagctgtcaccgccgccatcgtggccctgaggagccgccgccgccgtcgccctgcgaggttacgacgccatctcgcgccgccgctccctgccgtcgcctgcccgcgccgccactgcgctgtctcttgcttgggtcgccgctgtcgttgctaatccgtgccgtcatcgctagcctgcgccgccgccgccgccatagggattagaataggagaggggagtggggaataccggaataggagaggggattggaataggttagggtttctattagttgagtatatatatgtccatagttagtgggccaatgggccaaataaatggatataaggaataagagataggccaaaattaggtcatatatatgtatgagtcgggtatgcactatccgcgcacaacaaacaatacccaattattgcccacgatgttctcgggtttcggacgggcgtgcccacctacaaaatattacacccatgtccataccaatcgggttgggtatccgtggatatctggactcgcgggcaaaattgccatctctaattcaaacaagggcaagatatgtgtgaaccaaatagactttttttttacttggtcagtgactcagtcccatggagcaaaggttagctttgagtcaagagtgtgttcggatgccccttttctcaacccctctgcctcgttttctgcgcgtacatttttcaaaccgctaaacaatgcgtttttggtttttttgcgaaaaaattctatacgaaagttgtttaaaaaaatcaaattaattctttttttaaaaaaattagctaatacttaattaatcacgcgctaataaacctctctatttttcgtgcgttactgttccggttgggatatgagatagcgaacacaaagcctttttactccacaaaccaaaccaaccaccctccctgggactgggatccataagtcctaaaccgaatttcctattgcgcgcgtctgcgccagcgaacgaagtcgcgcgcggttccggcccagcccactacacgattgcgcagtgtcgcagtgcaggaaggtcagtaggtggggacacgcacacgttcacatgcgcagataagattggattagcgtaatcaggttttgactaatcacgatctgaattatggtgaccattctttttttcttttcgcataaaggttgttttctttttattactacaaatttcaaaaacttatacataatatttaaattttcaaataaaatttaaaaccttctaaaaaaagtcatatccaaaatttaaaacttttaacttgaaagttgaaaattttcaacttaaaatttaaatgctttcttctcaaaatttgaaactctccactcaaaattggaaaacttccaacataaaattcaaaattttcatctcaaaatcaaaaactttcatattgaaattcaaaactttcaactcaaattttaaaaacttttaactcaaaattcaaagttttcatctcaaaatttaaatactttcaacttaaatttgaaaactttcaagtcaatatttaaaaaattttaaattagattttgaaaactttcaaatcaattttgaaaactttcaaattagattttgaaaactttcgactcgaatttttattgttgtattgtgaaattactgtagcgtgtgattaaatctaattaccgtgattaacgctaatctccgtgattaacgatgggatcgcgacagggttcgttctgcagctgaacacgtggaagtgcgcgcgagtaactgaaccggcgcgtacgcgcgaattagtaatccccgtcctaaacctccttcccccggctggcggctgcaccgatggccggcgacgaaatggcctcgccgtcgccgccggtggcggcgctcaccaacgacctcatcgcggagatcttcctccgcctacccaccccggaggacctcgtccgcgccttcgcggcatgcgtctccttccgccgtctcgtcaccaccgacctgatctttcttctgcgcttacgatccctccacgccccgcccttcgtcggcttcctcgaccacaggggctttcacccggagctccctccccacccctgcgctcccgtcgacagggcggtggccgacgccgcggactatggcctcttcttcctcccctccccagccggcagctggatggtccgcgacgtccgcggcggccgcgtcctcgtcgaccgagataccaaggccgagaccggaggcagcgagaagccgttggtcttcacggagatcgccgtgtgcgaccccctgcgccggcgattcctcctccttcccccgatccccgacgacctcgccgcttcggtggaccgccctgtccgcgtccacctggaccgctggtgcgagcccttcctcgctccccacatcgaagaggaggaggacgatacctcattcaaggtgatctggatggcgcagtgcaaggccaagattatcgccttcgtcttcaattcgagcaccggtcaatggctagccggtgcctccccgagcaccaccgatctgttcaatggcgccggtctgtcgccgccgccgtcgtcgtcgtcaccgagcctagtgttttcgtcaccgggtcgagtgttctccagccgccgatacgcgtgcggctgcttctgctgggggattttgaggaccatgttgctggtgctcgacacacgactgatgaaattctccattgctgaacccccaccagtctgccttgggggaccgaccgccattgttgaggcaggggaaggcatgactgggatctttgctctccgggggagcgttggtggcacgtttgatctccactacagcatttggggaaaagaaggggcgactcgtcgcgagcagatggagaagataatcccactggatcatggctaccggtattacattagaggtgcgatggagaagcacttgctgttagccaggtcgcgaggggaaggcgaagaagatacaccagaggagccagatttggaatgcttttcactggatgtcaagaccttgcagcttgagccggtgtgtgttctgaagtactacagtttacgtactgacatatataccaacttcccgccttcgttgtcgccagaaataatatgagatggtaaatttcctgttgtatcctgattatgtctttatttttcggcatagttatctcgtggcttatgatatatatctgcgtggatgatgcttgatttattattgcaatatctgctccttgtttaaacagttatcatagcgattatagtatgaaacatttgtgtggtatggggaaaatatataaaggaaaggacattagagagatttgcttgtttgttgcgcaattatattgtacaagaccgattaagataatggggcaaatgaaggagatgatcctgctacgaactgcttagtgcttatcgtggaattcaagtagccctaagttatcatttctcttccttttagttgctttgattaggagttcgatatacttatggctgatttattttgcccttcaacatgaagctactaattttgtatgacctgtgtttggtggttatttaataattataatattcagcttttttgtctagtactctagctaggtgttccaacttatatattgcaaaccacaatgacaaacacatagctaggtgttccaacttctatatattgcaaaccacaataatgaacacgtagtggtgagtgtttgtcgtgacatgtttcaattaagttgagaatgtgagatttgatataatcaattggtaagggctaaaatgagttctgaaggtgggtttttcattcattttatagatttattttgaattactaataactatctcagctatctaacataacatgttttttcctcccctgatcaatttatgaagtgttacatgtagcctattaatagtagtttgttcctttctggttcataagtcttgaatatgtgcaatctggtctgaaaggtcttattcaatatctaatttcttgggttatttgtgtcagattcagtgttcacggtgaaagaaacactagtggagaaaccatctttgcccggtcgaccaaaaaccacaatagtctcggatgcactaaaaaccaatactaaagatggtttttagtcccggtttataagtagaacgggaactacgtgatctttagtcccggttggtaacaccaaccgggactaaagatgatctttaatcccggttcacatgctgtcaggtgttgtcaggcccctccaggatctttagtcccggttggtgttaccaaccgggattaaagatcaaaacgcactatataatccctgttacttatccttttttctcatgcactcttttttcatccacacccactcctctctccctccatctataatcttatctcttccctttctccttatctcttttccgtcttatcccttcccaactgccctttcccaactcgatccagtgtgcgcagcagaagggggtggctggcccggccagcgaaggtcagcgcggcggcacggcacgaaggcccgcgggctgtcggcgccgaggtaggccgcatccggatcagccggccggcggctttgcttagtttttttttctttttttttcaaagaatttgtgatccatgtgtagattgagatgaagaatctgtggttcattgtatggattgagatgtataatttttttttgaatctcatggtatggatctaagatgtacatgatttgtgtatgatttgtatatttgggacgtttctttgatttgggatgtataatctgtagtgtatatgattgatttgtgtatttgggatggtacgcatcccacctaatacccgggactaaagatgggagtgggcaatagtttttttttatttacttactatttaatctctaatttagtcccacaccaactgggactaaagatcgatctttagtctcgggtatttgaaccgggactaaagatagggatctttagtcccggattcatagtcccggtataaaaaccgggactataggagggttacgaaccgggactaaaaacaatttctccactagtgaaacattgcagttcttcgagctatagtgcttagcgtgagccgtgagattggtgaatgaattgagatggtatgccagattttcatattctcattgttatattgaactgcaaagcaatatcgtattcttttggtagaatgatagctgctgtggagtttccagttttagggcccctttgaatcacagggttaaaaaaatggaggaataggaaaaacacaggattctgataggaattgaagtgtaaaacagaggattgcaaaacacaggaatggtcgtttgattggagcgcaggaaaaacacaggaatcggatgagagatagactcaaaggaaatttttcaagaggttggagctcttgctatatttcctccaaaatccacatgcaatgtgccattccataggaatttcatgggatttggaaagcttcaatcctttgaatcaaatggacaaatagaaaaattttctataggatttgaatcatatgaaaatcctacataaatcctttgattcaaaggggcccttattgcatatctgctatggttattgaaactttgtatagctttgatatttatgtgtacaagatatttaagctaataattgcatactcccttcgttccaaaataactcaacctataattggatgataggatttgacctatcctggaacaacaattctggacaagcccttccgagctaggttatatcctactctaggtgtgtgttatggttctaagttactccattttggaacagatggagtatctgttatggttattgttatggttattgaaactttgtatgacttggatatttatgtgcacaagatattaagcaaacaattgtgcaaggtctgtactgtttcagcagtttgaaattactcggctgtatgcaccgatgacgctagtcatcttcgacattcacatatcgcctctaccattttttttaagtattctgatgtttgtctacttacttggcttgaatcgggatgagttcttaagtattctgatgtttgtctacttggcttgaatcgggatgagttcttaaaatctactctctccgttccataaaagaactaacttctaactactccatcctttcaatattactagaaaaatgtccgtgcattgcaacgggtgaatgctattttaattttattattgttatacggtttagttatgttaaaattcactataagaatttgcttagattttttttaaaaatacatgaattgtaattcggagtccgactttcatcttaagttagcatgtggagttttttaaaagagattttcttatacgacttcttttgtagttccaaaagcaaacgagcttaaaatccaactcaaacacagatatgtatttccaaaagcgaacaatcttaaaaacgtgggcttcggagcggtggggagctggcttcggagcggtggggaagtcggcagcggcggcgagagcgcgagcgatgggagcggaggggtgcggcggctgggcgggctcgaagccgccgaggtggacgaacccgaggaggagaggcgggtggtagacggagcggtagcagcggaggaagtggcggccggcgatgagtcggcggaaggagacgtaggcggaggaggcgcgggcgaggtccgcgggagagccgatacagaagaagatctcctccaagagctcgtcagtgagggcgggaagctgacgcggccatgaaattaataggatgccacgtcctcatcctagatggaacaatcacatcatctcacgggtgaatccattcatcgatagtatggttttgtgaaactaaactaacaaaatatatgtacttaagtgccaagtgtcaaaatatgtgtggttttctgcatcttaaaccatagaacatgtagttttgtgaaatttactcttttaaatatgtagttctatgataactttaatattaaatctatagttttataatacataatattaaatatgtatttttaataatgttttgtgttatgatatattcgagtaggcaaaatctaattcgcgcgcgctctctgttttgccttatcgcgcgacacgctcatcagccgtctgatcccacaagcactggtgcgtccatacatggcctggtgattcatggacgtggcatcatcccgaggagtccaaattggaagcccatacgatgctctacgctacgcaggcttcaaaaataattttctcttaaactaatcacccgatctacgattcgattataccgttgtgttcgtaagaattgaatctttataacaagatcttacatgattatattttaatgaaaaattaaaaattacttttataatatatctaaattacttttagatttcactaaattacttcttagacccataaaagtaaattcaataaagcttaaaagtaatttacatatattataggagtaacttagaaaaaaaagaaagcaactttatcacgacaaagcaactttctaatttcagaaaagggctcatcattacttaaactgtcgttctcttttctcaacagaatagcgaaaaactggcagtgtgtactacaacagggtgtgtttgggaggatctccggcacgtaaaacaaagcatacattagtacattattaaattactccctccgtttttcaatagatgacgccgttgactttttctcacatgtttgaccattcgtcttattcaaaaattttatgcaaatgtataagatataaatcacacttaaagtactatgagtgataaaacaactcataacaaataaattataattacgtaaattttttgaatgagacgaatggccaaacatgtgagaaaaagtcaacagcgttatctattaaaaaacggaggtagtattagcttaaaaaactttaaaaatgaactaatatgtttttaaaataactttcttatagattttttttaacaaagtgcattgtttagttgtttaaaaagtgtgcagtgaaaaaagaaggatgtgaagttcgtaaagtagacttaggtggtatttggatccagggacttaactttaatctatgtatttagacactaatttagagtattaaatatagactacttacaaaactaattacataaacgaaagctaatttatgagacaaattttttaagcctaattaatccataattagagaatgtttactgtagcatcacataggctaatcatggattaattagacttaatagattcgtcttgcgaattagtctaagattatggatgggttttattaatagtttacgtttaatatttataattagtgtccaaacatccgatgtgatagggacttaaaagttttagtcccatctaaacagggtcttaagaacacaaccctgatctgctactagtacacagcaagagggttatccatataaaaaaaatatcagcacactagcttatgtggtcatatgaaaagggaacaaactaccacaaatatgaacatttaaccaggaaatggaagtaaatatgcttattggatgacccttatcgtgtttaatcaaatttgtattagttttttttttgcggggaaatttgtattagttggctgttggatgggaagaatagatgatttgctcaatgccaatgagataattgatggatcatttgtgattgggtgatgcacaaaataagttagcagggataccgtgctaattaaggcatgtatatagcttaacaacatcacaggctacaattcggtgtggcaaagtcagtatagaaacagaatggcagcattccaacattaagagatactaacacaaataatgaaataagggctcgatagtgtgatgttgattgatgggcatgatggccgattttaactatcgctggaagaaaccctcgcgcgcgcgttcaaaccccttaaacggctgaaaccaaattaaaccgtctaaaccgggggtatccctgggtttgatcggtttgctgcgggaacccggcccaaactgcgtatgaataggctgaataaaaagggctaaacatagactatattaaagagggattgttgatgcagttgcagtagtacgttccttagaatgaaaggtcaaaaaagacattgtaaacctctagtaatcccctcataacacaaattaattttcatagttcttgcaaaaagatatggccaggaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35886 - DNA, 3413 bp, Oryza sativa
ttagtgtctgatacgttttctaaatcgaaagaaccttgtccgtttcctgtatcctacgaaagcatattagtatgattccgttttcctttttttagtttttgactgttgtccgattcaagtatcttagttttttttagttttttttgcctttctttagtttttaactaatcctaatcctaatcttagttctatttttccttttttcttattttttaattaatgtgagaatttctagaccgtgagagcgaacgtggaggcttctttttctattactttatagatataatagattttagacaccatcactaatatcttttaatgcagtataaatataattttttttaactttgaggcaacatgcacaacctagacattccctccgagaatataatagactttccccaaagtgagtggttttctttgtgtttttgacaggttttactgaaccatcccaccagtaagccacggtttggagtggcggcgagtgttgacaacccgttggacttcagcggcgtggacgtgcggctccccatgctggtgtacatctcgcgcgagaagcgccccgggtacaaccaccagaagaaggccggcgccatgaacgcgctgctccgcgtgtccgcgctgctgtcgaacgcgcccttcatcatcaacttcgactgcgaccactacgtcaacaactcgcaggcgttccgtgcgccgatgtgcttcatgctcgaccggcgcggcggcggcgacgacgtggcgttcgtccagttcccgcagcggttcgacgacgtcgacccgacggaccggtacgcgaaccacaaccgcgtcttcttcgacggcaccacgctctccctcaacggcctccagggcccctcctacctcggcaccggcaccatgttccgccgcgccgcgctctacggcctggagccgccgcggtggggggcggcggggagccagatcaaggccatggacaatgccaacaagttcggcgcctcgtcgacgctagtcagctcgatgctggacggcgccaaccaagaacggtcgatcacgccgcccgtggcgatcgacgggtcggtcgcccgtgacctcgccgccgtgacggcgtgcggctacgacctcgggacgtcgtgggggagagacgccgggtgggtgtacgacatcgcgacggaggacgtggcgaccgggttccgcatgcaccagcagggatggcgctccgtgtacacctccatggagcccgccgcgttccgcggcacggcgccgatcaacctcaccgagcgcctctaccagatcctaaggtggtcgggcggctcgctcgagatgttcttctcccacagcaacgcgctcctcgccggccgccgcctccacccgctgcagcgcatcgcctacctcaacatgtcgacctacccgatcgtcaccgtgttcatcttcttctacaacctcttcccggtgatgtggctcatctccgagcagtactacatccagcagccattcggcgagtacctcctctacctcgtcgccatcatcgccatgatccacgtgatcggcatgttcgaggtgaagtggtcgggcatcacggtgctggactggtgccgcaacgagcagttctacatgatcggctccacgggggtgtacccgacggcggtgctgtacatggcgctcaagctcttcaccgggaagggcatccacttcaggctcacgtcgaagcagacgacggccagctccggcgacaagttcgccgacctgtacaccgtgcggtgggtgcctctgctgatcccgaccatcgtcgtcctggcggaacgtcggcgccgtcggggtggcggtcggcaaggcagcggcgtgggggttgctcaccgagcaggggcggttcgcggtgctcgggatggtgttcaacgtgtggatcctggcgctcctctacccgttcgcgctggggatcatggggcagcgggggaagcggccggcggtgctgttcgtggccacggtgatggccgtcgccgccgtggcgatcatgtacgccgccttcggtgcgccgtaccaagctgggttgtcaggtgtcccggcttctctcggtaaagcggcgtcgctgaccgggccatctgggtagggacgacatgagtccggatttgaatttgatgaatgatctcgcgggggtaataatccgggtgttcagatatatctcgttacgtcatgagggcggcagctgattatgtgctagtctactctgatcgagtgagacttgaattattttttaaaatgtgaagacttgaattattttattttattttatttgttcagtgtgatatgttggcattaaattcatggagaactttttttttctctgtgttgttttttcttaaagagtactcctatatactgctataaatatagatgacacaacattacaagtttaattaattaagtttaagtaccattttagtgtgttatatacactactagtcacatgcccatgcattgtaacgaatctaaaggaaaaccgatgaatgggtatgggttcacaatttttaagtcatttttaatactttttcaattcgagtaaaattttgtaatagaacttctttgtttcattatttaaaaattcaatacttttaacataaattttgaaacttttaacttaaaatttagaactttcaaattgaaattttaaaaacactaacccaaattagaaacttttcggctcaaaatttgaactattataaacacgtaataggaaaaaaaactttaaaatgttccatatatgttgggcctacaagtctgcagggccatggaaaggcctggagcagaggcatagatgcgtcaaataaattttccataggagtaagtctattttgcctttctcatctctggttgttgattgaatcacttccctcaatcacaaaaccgggtaaaatgactcccccatctttaaaaaccggtgcaaatcagcttctttggtggtttggaaggtgtttttttgctcatgtagcatattgaccatggttgactagctaagtcagcgggtgggatccacatgtcataaaaatctcatatacttttgcccctctcccttccccctctctcttgctaggcggcaaacgatggcggccagcatcgtggggccctagctcgtagccgctgaagggctagcgcggggtgaagacggcatcaagggctaagtgggagggtagggatgaggagcaggtcacccttgacgtgggaggatggaggtggaaggatggggaggagatcgctttggcatcgacagcggaagagagagaaggcggctcgagtagtggggagtggagtggggggtaggagcgacagtataggaggagcgttgaggaaaggaggagggagggtggcagaatatagtgggaggaagtagtgaaccgacgggtccaggcggagtagtggtcacggcaaagacatgcgcc

SEQ ID NO: 35887 - DNA, 1476 bp, Oryza sativa
  unsure (1)..(1476): unsure at all n locations
ccctccccccccccccgccctctttgcccccacctctcgatgttgtctacttgccatcctccttctgcgtcggcatcgatgaatttgtggagagcatattgacttctgcaccgccatgccatcgcgctgcccactgccgcgtcctcctttgcatcaccgcttgtcgctgtctctcagtcgcccgtaggtaagagagacggaggaaaggtgaagagaaaggtatgggaggaaagtagagagaaggatgacatgtggaaactactgatttttccgtagaggcttacctgtgagtctatgataacataaagcaatctaggccatgcatttgtgaaggctatactgaagcgcttctcaataaggccttattataaggtggtggcccattattcgttcaaaatattagtaatcagttcgaagccaatgacagcaccggccggaataaccagccaaaatatgctaaatttgaattgaagattcatagttctatttttatgaggaaagtttcaaagccccacagcttggccgatttcattggatgccagaaacacaactacacaagtgacaagaccaacgattactgcttgcagcggaatgagctgtagctagctgcagcaagtacaaccgagcaaggccataatttaaattggaataagatttggatatgattcgtatcctttaatcacaatactagatatctcgacccctcaactattaaaaccgatgcaatttgactctctcagtgtttttggaggacggtttcgctgacgtggcatctacgtggccgtgttgacttggtttgtggcattgacatgacacttaggtgtcattagagttaaaaacatatatgtgggacccatttgtcattcacacacaaaaaattgtggacccactgacacgtgggacccacacgtcatccactcctcgctccttcttccttctcgctccctcccttctctctcttctctctccccccttcgaccccatcaccgcctgccactgagtgcgaggaagagggcgaggagtcgtggcggtgaggggcgctcatggcagtggaggacctgctggctgctatcgctgctccggtcctcgccgttgtcggagtcggcaccgctcgcgttgacggagaatcccgaggaggcgacgagcacatgccgaggcttggacccagctttgtcagcgggataaaggggggactcgacgaaggcggtggagctctcctcctgctccttcaacaccatctcgtgcagcttccccctcggtgtgccagcaggagggggtatccgccaccgtgtaccctgccgccgcgcagttaattttatgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35888 - DNA, 7599 bp, Oryza sativa
agaaaaaagaatctccatgttagttctcacggcctagaaattctcctattaatcaaagaccaagaaaaatagagtccatacaagtatataatttagaactaatgaaaattcgaaattagaaaaaaaaataaaattaaaagttgaggttagagtcatatagaaatacaatttataaataactaaaatttgggattaaaaataaagaattttagaagaaaagtatagtgtccatatagaaatacaattaaaaagtaaaagaaattcagaattaaaaaaataaatattagaagaaaagtatagagtgtatataggaatttggaattaattaaaatctagaataaaaataataaaattaaaaatagagtttagtgtccatatagttaaaattagtacacttgtggacgtatggtacatagatcatgtgttctcatcttgatctgcataataaaaaaagtttatatgcataaattcgctaaaaagatctttgagaacttaaagtcaaaatgtcatgcagaacaaattcaagtcttcacatttttctctactattataaaagttgaagaagtttttgccggtattttggtacgtctcatccgtgtttgagttggttttttagttcgttagcttttgaaaatataattccgtgtatgagtcaaattttaagttcgtttgtttttttttgaggggaagagcaaagatatattactcaaccagaggagtccttacagagaatctgagatattatgctacaagtattttctaaccaaaaatcagagatgtgatcaccacgagctttacaagctaaaacatggatggcttgattctgggatctctgtatcttctttatggtgactcctctctcatcttccagcaaacatttaatctcgctgacaatatgcgagaagacagatcgatcttggtcttttgaaagcgccaaattaaccactgtcaagcaatctgtctctatgacgatggggagaatcgtccactggagtgccaatccaagtccttcgacacaggcaagaagttcagattctagcgcctcctggcatctgttcaaaaacctgcaagaggagaaaattacctctcctgaactgttgcgcagaaccattcctactcctcctgtttcctcctgtggatggaaggatccatcgatattcagtttcatccaccccgctggtggtttctcccacgacacggggacatccttgacagagcagcaaggggcaggagcccgcttagcaataccaacagccagtttccctttcttcaaatttgcaccaggattctgcttgatttggacaattgttgacatatagctttccaggaaccgccttgacgcccacacgggggcagccggcttcccatgagttatatcattacgaacctgccaatttcgccaaaggatcatgagaatcatagggtgctcctcagctggaactctccccaaccagtccaagaaccagtaagaaccccctctgatcgaattaatgtcagatacaagatttcctgccttggccatttccatccaaagattcctggcatgactgcatcgacatagagcatgtccagtatcctctctttctctatcacagatggtgtaggaatcactcatctccagtttccttttctttttattctccatcgttgccaaactgtctgtggctactctccaggagaagatcttaaccttgtgtggaacttcacatttccagattaaatcccaagaattctttgcacaaattgaagaggatgaagagctctcatccttggatgccagcctcactgcaaggtgataggcgcttctcaccgagaaccggccgttcttgtcggggttccaggatatgaagtcctccgtttccctatagggtagtctgatttttaaaatttcctctgcatcaacattccaaaagtattgagagaccttatctacatcccaagcaacattctcatcaattagctctgaaacccatttcagacgacaatgtcgtttgactgtaattggtcttctagtaaactccctcggcaaccaaggatctctccaaattttcattgatttcccgtttcctatcctccaaattaatccttgtttcagaagtaccaaaccatattccactcctttccatccaggagaggcattaccgccaaaaacagtatcaatgagggaaccattcggataatacttcgctttcaacacccgagcacagagactatcgggagattcaatcaaccgccatgcttgcctagctagcaaggcttggttgaaccatctaatatccctgaaacccatgccaccactctgtttcgacttcattagcacatcccatgccttccaatgagtttttcgccgtccatcctgagatccccaccagaattgacgagtgagtttgttcaaatcctcacacacagactctggcagtttgaagattcccatgacatacactggtatcacttggaggactgctttgatcattatttctttgccgccagaggacaggaatgtttccccccactgaataattcttttccatatcttctcttgaagactttggaatttccctctcttcatcctaccttcgggagtagggaaccccaagtacctttcttcaaattcgtctttctcaatgtgaagaatactcttaattgcttcctgtattcctggtggagaagcctcactaaacataatagaacatttcgctgggtttattagctgtccagtcccagctgcataagcactgagaacctcacttaccgcaatcgcctgttgttgttcagccttgaaaaataacaaggtatcatctgcaaagagcaaatgagatataccaggagcgcgtcgacatatctgaataggagagatggacccctgtgcaactctttctctcaacaacatagacaaaccatcagctatgaatagaaacaagaatggcgactgaggatctccttgacgaagacccctggagggtgcaaaggagctaaggagagttccgttaaatttgacagagtatctcaccgaggtaacacatgccataatccagttaacccaacggtgagcgaaacccaacttgttcaatgccatttccagataccgccaatccacacgatcgtaagctttcgataagtctagcttgtaggcacacattgctctattctgtcttctgttagtttgaatggtgtggaagcattcaaaagccagcaaggcattatctgtaattaggcgacctggcacgaatgcactttgctcacaggaaactagctcatcaagtatagtcctcaaccggttgaccaaacatttcgataccaccttgtacataacattgcataaacttataggtctgaaatcctttagctccatgggttaatcaatcttcgggataagaactatcgttgtgtcgtttaccccatcaggcatagtgcttgtctgaaagaacttgctaacagcatgtacaatatcctgtttaacagcaccccaattcctctgataaaaccgagcaggaaagccgtcagggcccggtgccttcaggggaccaatttgaactatttttcttagccctccaaactgcccggctgtgaaagaatcgagtattacgatcaccttccttcaaccaactaattctggagcgttggagccacaacatttcttccttgtataacaattcattcatatggtctgaagcttgccgaacaactgaactatcagctccattctctaacagagccgccagtctttttcttgccttttctgactccctgcctatattcttaaccttcctgttactccaagaacgcagtgaagccatcacccgatctagagctttgttaactttccccaggtcgcccttatcccctgcatcagaccaagcatctgccacaacctcagggaaatcagcttccctttcccacaatatctcatagtgcaagcacttgttacgtacagtgctagtatccttcatcttacagtttaacaaaagaggtgaatggtcagagcagggagaaaccaaatgaacaacatgtgcctcagagaaaatatccctccaactatcatctacaatcactctgtccaatctcaccttcacattgttccagccttccctacggttatcataagtatggggtagccctttgaaacccaggtcactcagaccacagatctgcaagacatcccgaaaagccttcatctgattctcatttctcggtgttttcgaaaagtgttcgaattgccataaggcttcattaaaatcgcctatgaccatccacggaaagtttgacgattgtcgaagggcattcaaagacgaccacatatggtgccgattctccacccgaggttcgccatacacaaaagtaacatgccaaacaggatcaatcggagacaaacgaacatacgcatcaatatatcttgcattcacatctttaatatcaacaatgacagattcgtgccagaacaaagccaaaccaccactcataccttcactactaacaccagtaaaacctctaagacccaaccttttactgaggcggcttaccttctcaactcgctgccttgtttcacacaagaagactaactgggaactagtgtccttgactaaggtacacagttcacgaactgtcgaggggttccctatcccccgacagttccaagccaagcaactcattgtccctggcgggaccctgccgtaggtctcgccagtgaaccagcagccccagcgctggtagcttccaagccagtcacctcccctgttgctccaccatccttcctgagtctctttagcgaccgtcctatggactcaatgtccttcttgctttgagctgtgctctcctctagctgtttgtactccaacaaagcttgctgaacaatgcctgtcttctttgtatctgacaaactgcctgttttcctcttgctcggactgcttgtttcatccatagagccttcatccaacgagtcctgataagcgctcagatccctgacagccggtatcatctcatttgaagggattggcaacagctccccccctctttcagccataatcaaatctctagagagccccttatcagtatttatgggtttatgctgggaactattcatgtccgacacgcgtatctggttggcctgttctgctagttgggcatccacaccttcatccccttttctctctcttgactcaaagccatcaaaagtatcaattcttaccggtggttctgtcgggtgcagcagatccctcttttcccctatcgaggatgagctcgcagagcccgcttctctgaaaataatcttccttggcacacctgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgttgtgaccagaggggttctgcggcgacgtcgacggctgaggcggagcggcgacgtcggacagcggaggcggagcggcagtgtcgacggcggaggcggcgacggctgctgcagaggttctcaacgcgagcagcgtgaaggaggagcagggcgcacgctcgctggttgagctgcgcaaggatttggtgcagcacaagctgtagggagcacagcggctgagagacgcgcagctgttggctgtaggatcaacagagaaggatttggtgctattggctattgttgtccgttccagtggtggtgactttggtggtgctgttgctggtgctgctgctacttgagaaggtgaggatttggaggtgaagcggaagcttggtttgctgttgctgttgttctgatttggggaagaaactgagtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaagaagaaaacaacagtgcttggcaactttattaatctcgcacatcctatcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggtgttaggcataatgggttgtggtatctgggatagaagagggacggacaaagcactatgtagtgctttgttagctagcacaagtgaagaggaggctaaattgattctaaaacattgtcaattgggacatatgtcctttgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgtttactcatgtatacgatgaatgtaccaaagtttctatggagtgaggcagtcatgacagtaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggctcatcaggtattgaagaagacacacaatcaagaagcatgaaatttgtggttggctcaatcccatatcctgttag

SEQ ID NO: 35889 - DNA, 413 bp, Oryza sativa
tattcttcaaacccaaacagtatataaaacattctaacatttctgataccataaatcgcaaggacaaacatcacaacgattgatacagttatcgttaccaatagactaccacattgaaaagtatcccggtcagatgtcaatcgtcgcaaaaaggatcagtttctgcaaccaaggatggcggcattgtccagccggttgaaactcgtaaaccatttccttgacccttcgtgtccagttaagaaatttagctgccccagatactactaaatgctttcttatgcacaataattctctgatctatagcctgtataaatacacgggaacattgcttgtacaatttcgcaatttgaacagatgaaaaaaaaaaaagaactctcgaatcagtaactgccttcgaatggcaattgatcatt

SEQ ID NO: 35890 - DNA, 560 bp, Oryza sativa
  unsure (1)..(560): unsure at all n locations
tttaaataattctattgcataaaacatatgaaatcaattacagatttcaaatcgtgtgatttaacattcaggcatgaaaaaaatgattatatgaagaggctctaggaagttaacttaagatgagaatcaagtgtgcattagtcatgtagtcatgttgtggtacatggaaaggaaactaaaaatacttacccaaggtaaataagcagcagtaaaggtgaacaaacccaagaagctcatatgaatgaagggattgtgcttgctccatacataaacctgcaggtccatacgagaggaattactaaaactcaacttctaagtatgcacccaagaagactattttcagagcccagaaaatccctaagatttgtcctgcacccctacgatggtgtagaaaaccaaaaaccaagtataatgcttgtactaatctcgtaccatcataaatgtcaatgaattgctcaagaacaggattnnnnnnnnnnnnnnnnnnnnnnnnnnnnnnnnnnnnnnnnnnnnnnnnnnnnnnnnnnnnnnnnnnnnnnnnnnnnnnnnnnnngggctgc

SEQ ID NO: 35891 - DNA, 664 bp, Oryza sativa
ccttgccgaccgccaccccgacggcgcgacgttcccggccaggacgacgatggtcgggatcagcagaggcacccaccgcacggtgtacaggtcggcgaacttgtcgccggagctggctgtcgtctgcttcgacgtgagcctgaagtagatgcccttcccggtgaagagcttgagcgccatgtacagcaccgccgtcgggtacacccccgtggatccgatcatgtagaactgctcgttgcggcaccagtccagcaccgtgatgcccgaccacttcacctcgaacatgccgatcacgtggatcatggcgatgatggcgacgaggtagaggaggtactcgccgaatggctgctggatgtagtactgctcggagatgagccacatcaccgggaagaggttgtagaagaagatgaacacggtgacgatcgggtaggtcgacatgttgaggtaggcgatgcgctgcagcgggtggaggcggcggccggcgaggagcgcgttgctgtgggagaagaacatctcgagcgagccgcccgaccaccttaggatctggtagaggcgctcggtgaggttgatcggcgccgtgccgcggaacgcggcgggctccatggaggtgtacacggagcgccatccctgctggtgcatgcggaacccggtcgccacggggctg

SEQ ID NO: 35892 - DNA, 563 bp, Oryza sativa
tcaccatataagatatagattttataattattgcaccatgaaagttttgcttattagtaattcggctaatgtcaatgggcaatgtgatgatttattctagagttgttttctttagaaacattggcattattaatattttgcatacatgctcaagccgattacttacatttgtagtttattggaattcatgtgtgtgaggcatatgactttggtgattcattattcaattggctaagtgttttgatgccatgatgattattgtttcaaaagccatttgaattagtattcatctagacatgttagttggatgttatagtttttcatatgtctagagaggaggaattttggtccaataatttgatacaccaagcatctggctattatgtgaagaaaaattatatactaaaggccgatgcttgattttaaaagtttggacgaaattggcaaagtcatagaccaagggcggtctgaccggcattgcacggcccgtctgaccggtggtaccggcggtctgaccggctctgcataccggtctgaccgggcagacagggtggtctgaccgg

SEQ ID NO: 35893 - DNA, 524 bp, Oryza sativa
ggagccacatggttcacaagatcttgtgagttgggtgaaaaggatggcattttcctttgattccttcagatggaatcaaatggggagaagagtttgattaatcgcaccgagggagatggcagcagggcaggagtagttgattacttgattgcagtgtcatcaactcattatgatcaatatactatttagttaagccagatccagcctcttttgtagtacagggtaggaccaagattgttatggattaagaattaatgaggctacaagtacatccaagtcgcccttgataagatgacagcatctctaaacaagtactagtactactctagtcttagtttgcttagaaccaggtctttccaggctatgtaaatgaaaatatgcgtaccactgttctcaaactatttttttaataaaactctctacatcaatatttgcttagacaatttgttcatgatatatatatatatatatatatatatatatatatatatatatatatatatatatatatatatatatataaa

SEQ ID NO: 35894 - DNA, 25847 bp, Oryza sativa
  unsure (1)..(25847): unsure at all n locations
nnnnnnnnnnnnnnnnnnnnnnnnnnnnnnnnnnnnnnnnnnnatcccaatgaaagaataatgtgacgtgattttagctaccgagaggaatagtgttcctgcaccacgatcactttggtaattggctgctgagagtaccttcctttggacctttctaagacataaaaatttgcaattgctgtcaggattcaggagattattctcaggggaatatatcacagaacattagtacataaatggtatagactgcttcagataataatgcatagatccttctgtatattcgaacaaaatgtgagcattattgaggaatttccaccggtaggaataatgggaacattaggttccagaaacggccaagttctcgtgaagatcatgaagcgctcatggcgacacatacatttcacaaatcttttggcactaatctgcagatggtatattggtattatccactgttcttgcagataacttcagaagatttttcttgcttgcaacaccttcatccattcatccatggtgaggtcgttctcgtttgatcaaagataccttatgccatcaagagatccttatcacgataattatgccattttatgtacaaacgcacatacactccatgactccatgcattgggggaccttttactgccgttggattctcgaggaatagcatcctcggatatggttcatcactttatcaatattagagcacacgattcttgatacgcctattctcgagaatagattcataaagagaattattgtttagtacatgcccataataatacattttctaaatatattacaagtgcgggcattcatatatacgcgagcgctcttacccttgaatacatctttccatatccttatgagcacctttgaagattgggtttatcgaacaaacaaacatgtcaacgttagttcatggatgatacaagggtcttcgatcttagcttggcaacatccgaatacaatttctacctatgtaaaatttacatgaagctttctaactgctacaagaaagtgcatctaaaaaaaaatccttcaagaaagtggaaacagagtaaaaaagtatacgatctacagcgaactaaaaataaacatggcaactttttccaaaacaggctgtataatataggatgaacatataccgacttcaaacatgcatattaccttatcttgcatgccaaattgaacctattccattcatatttgacatatctcaaaaacacatgctgctgacacttgctacatgggagtgtgttaacacgccaggttttatatgccaagacggatgggaataatcaccgacttaaaaaaaaagagaacaggaatcaagtcacaatatatgatgtactatggagagagagagagagagagagagcacgctaaaaagagcccccattttcactatagaagcataaaaacatcatatgttacttgacaaaaatcagagagacatacacacgttggccgtggtaaatctagtaatgatgtaggttgatcaataatgttgtatagaaaataaattgtgtatataaagagagtaagggttacgcatcaaatctatttctacttttaaaatctaactctgtataaaactgcataagaaatactagtgtagcattatgtcctattattatctatccctaatgtttgtttttacttatccgtcccaatcaaaatttatattttaagttgtctttttatattttgttatcataatttttttcagcgtttgcttttagatcgtgaagaacccacatatataaaagttttacctataattaatttatatgtctaataagcattttagtttataatcaactatgaacgaaatgttggaactgattgtgtcatcatccaagtggcagggtcaacctcttgatgaagaccctcctggccaggtctgggaggactagtggctgcttcttggctgcccagccggtgtcaaacccaaccgtatcacctcctattccctccttttttaggactttatgccgtgagagaccaccctcccaaactctccaaagtgtggccatgtttttgtctcttgttggctcaccaacaaaagcagagggagccacactgcctgcctttcttttttccttgctcacctttttcctgcctctcatttctgcatggataatggaacagtaaaacacaagcttagcacaaagtaggagagaagattggttatagagagattaagagagagagagggatagaacatttagcattggagacacatgtggagccacatggttcacaagatcttgtgagttgggtgaaaaggatggcattttcctttgattccttcagatggaatcaaatggggagaagagtttgattaatcgcaccgagggagatggcagcagggcaggagtagttgattacttgattgcagtgtcatcaactcattatgatcaatatactatttagttaagccagatccagcctcttttgtagtacagggtaggaccaagattgttatggattaagaattaatgaggctacaagtacatccaagtcgcccttgataagatgacagcatctctaaacaagtactagtactactctagtcttagtttgcttagaaccagttctttccaggctatgtaaatgaaaatatgcgtaccactgttctcaaactatttttttaataaaactctctacatcaatatttgcttagacaatttgttcatgatatatatatatatatatatatatatatatatatatatatatatataattcatcactataaacaaattgtccaaaatatatcaatcatccaataaagaaaataatcttaattaccttaagccccacagatattcttgaaaatccacacgaaattgctgtgaacttcatatgctcttccaaagcaacgaggagtacggcagccaaatatggacctaatatcaagacaaaagtatccccaggaaacagcttgtgatgggctgatggtctccactgcatcatcagtagtataaattcagtattgcttctgtcatgtcctgcagatattgctgctctcacattggccattttgtttgctcaaacttatgaacatccattctctcaagacaaaatgttagtaaaatgagggaaaaaatatttcccccctcttgtggaaactggaaagtagcatgctttccattgaccagtggtgattgagcatatgctgaactgaagagtggatgcacagcatagcttgacagtgacttaactgaataattaaacaaatggtaaacactatgttgtcactttgggctcttaaaaaatcttaattaagtatgcaattttttgtaaggtgtcagtcagtgcagcgaggtgcagctgctacaagcaggcaacagcactgtatctttgcctgcacacatgtgcacccctcgttaacgtgattttatttttgccttttccccatttcttgcatcttctccctttaccatatttaggactttttttaataaaaaaaggtagtatttttgacatgagaggtcgtggctacggtgggtccacgtattcaaccttgctgggccggatcggtgaaaatgtcgttgggccgaatccactctgctcttgtgttgtgctccctctgtattttttttacattaaaattggagtagaaatgaaacagataaaaaaagagaaatgttgcaaatatatgtctgtacaactttatttacataaatttctttaaaaaaactattttaaatcaaaattttaactttaatttactcacgtgtactctcgaataattatcataaataattcagctatttaatctttaaatcattatatgtgccactggtttccgttctttagagtatgtatattggaacatattcacaggggtgtgagtgtgattgtgatgttgcatggttagtattgtgtgtgcgtttgcgtgaaccatgtaatatcagaaaatcattctatgcaaaaggatagtttacatgtatttcgtcctttcttcaaacgtgtgttacaggcttgcactgagggtgcatgcgtcttttaagtgagtaattaggagagaaaaaaaagaacgatcgatttttttttagaataagaacgatcgaattttggggtgttagtgttaataatccacattccacaagaggtgtagtagtaaagcagtgaagtaggccggtggctgtagctaaggcaaaagctagcagcagcagccgcagccgccgccgacgtcgccgtcgtcgtcgtcgtcgacgacgacgagctgacccggccacgagggcacgcacgcctcgatcccctccccttgcttccagtaacttccaccgctataaatacccctctccgctctcactcccacatcttcctccccaatcacctcctccctacctctcgccattattaaatcctctcctctcctctcttctccacatccacaagaaatttcgtagcggaatcacgagccctcgtctcgatcgtagcttgagcttgagctgagttgctggtttggtgtgtggagagatcagtggggtgggtgggggtgggtaatgtacggcgccccggtgtccaaggacctgagcctgcagccagccggggtgcggacgccgccgcagatgagctcgccgggcttgctgcggtacaggtcagcgccgagcacgctgctcggggaggtctgcggcgacttcgtcctccccggtggtggtggtggtggtgggcagctgcagctgcagctgcagcagcagcggcctgggagcccggaccacgccgcggacaccgtcctcgcgcgcttcctcgccggccatggcggccacgacaacaagcctccccgccccgccgcccacttcgccccaccggaagactccatggcctcgcatcagcagcagctcatgtaccagtcgcatcagcagcagcagcagatggcttccgccatggagggactctaccgcaccgtcagctccggcggcacggagtccaccgccgccgccgccggcaacagcctcctccggcagagcagctcccccgccggcttcctcaaccatcttaccatggacaacggttggtgcacctccctctccactccaccttgatcttgcaagaagtagtagcaatcatgaggtggctgctagcctttccatttctggaattcgagaggcgccattaatatccttaccaattataggatacgggaatatgctaagagcgggcatgggcggcggcggcggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgtgtcgccggagatggccgccatcgagaagttcctccagttccaggacgccgtcccctgcaagatccgcgccaagcgcggttgcgccacccacccccgcagcatcgccgagcgggtcagtaccgtaccttacacacgcgcacacctttcgccgccacgcgcacgccatggcatggcgtggcgtggcgtggcgtggcgtggcacgcgatccatttccttcgattcctgagctgaaaatcgtctcccgcttgcaggtgaggaggacgcggatcagcgagcggatacggaagctgcaggagctcgtccccaacatggaaaaggtgagggggatcccatcggtcgaacaccttgtgtgctatactccatgattggttttttcccctgtttgggttcattttggctgctgctgctgccatggaaggaccacgactctgatccgctgtgaaaaaaaattactaacactgtactccagtgtgagctactactactagtactagctgatgagctgaccgtttgtgaatttgggttttggttttacttgcagcaaaccaacactgctgacatgttggatcttgccgtggactacatcaaggagctccagaagcaggtcaaggtaacatatatgagtctgaaactcccaattttgtttgatcaaaattcagaactgcgacttgcctaattgtcccgggatatataggtgatgtttagatcaagttgttaccctccagatgagggcaggggtaactgtaattagctagtaggagtagtagtagtggctagctgggcacatccagattgcatcgatctcctagttactctagttaattaaaaaaatggcatgttctttttctattgaacactttttagatgctcacatgaggatgaggtttgcagttcgatcagtaaccatacataactaaccagctagctagtcttgtctgagactgagacataatcaatcaaatactgtaatactgtatcatccaagttgctgacggtgttcttgttcttgattcatctgaaggtgttaaacgacagccgttccagctgcacctgctcggcgagcaagcagaagcacttcgccggctaaatcaatcaagtcaatcaatcgccatgaccggtgcagcagtgcgcaacacacgaacggccgcaaaaggcatgcagcagaagcatctgcaccggcagtttttctaagcttcgtttccttctttgctgatgaattcgctggtctatctggtaaattgaacatgagggcattggattttggagcagtggcatgcattcttcagagttcacaaagatgatgggttggggtcccacatggtagtggtagactactgtagctgcaaagcttgattaattaattagcctgttcttttgataatgaaggagaggagagtaactcacaagtgtatagatggttgtctcatctctgtttgtcatagtacacaccaagtgcaagttgcagctgtgtctgcttgcaagaatgcatgcccatgtacattgcatccccctttgcttgacaaatgacacatccagacagcctccatatcctgtttcctctcgttgctacaccctgtttttgtgaagtacatgcatcgcaacaatgttcacgaataatcctggtcactgttttgagcagtcccatagctctttttatttggattatgtaagtacgtattcatagaatctatatgttgaaatctcagctatttttagttcgctttgtaaattctacaagtatagtttctcgtaatctgggtaatagaatccggatcgttagggagaaactatggctttgcaaaagctttcataacatgatctaagtctaatgttcttttttttttcagatttttatcacaaaatattttctcaacgttggtaaaaatatgatttataaaaaaaaatccatccaccgtgttgttctagtaaagtttattttaaaaaattaatctatcgtgccattattaagtatacagtaccaccgccgttccaaaacacatccatcctaaaacataaaacataagaatttaggatattttttttagtaatacaatctggataagaaatatctcatacaattatagcttctatttaggagttttttaatatatggtgtcgttaacttttttaagatacgtttaatcatttgttctatttttaaaaaatgtaattatcatttttttattgtgattatattaatcatcaaatgttctttaagcatgacttgaactttttttatatttacacaaaattttaaataatataagtggccaaacactttttttttaaaaaaacaatggcgttatatattaaaaacagagcgagtctgtcttaacaatctgtaccaaaatctgttccaaacagaggctgaatagtttcaggttcagcgaacggtggtgcatgcgttgaagctgtttggcgaattcctgtccctctcgtcgctgtcgatctcaactcctctaacctggctcctggcatctgtatccggtggtgtacgacgtgctcatctatccggccacaggggtcgcctccgaaaccacgggcggtagcagcagcctttgccggccaggtcggctcgccggttttcgccggcgatcgatcgacgtcggctggctgcgccgacggtatgaatgcgtgggcagcacgatcgggcgagtgagtgactgacgggggatctgagagactagtactgtgagaaaagtttcagtctgatgctgctgctgctactggtaggagtagtacttgctgtcgattcgattggacgaactgtgaggcgagagaaaaccggcggcggcgcacgcttttgtgggtgggtggggggcggcggcggtcataacggtttctcccccacgtactactactagcacaactgcacaagtacccgcgcggcgcgtgatcaggtgggcaacaaatactaagaataatagtagtatgctataagccagctaaatctaaatgctgaggtggagaagagaagagagaagagagaagagaggagagagaagaagcgagctgtaaacttatagccggcttagaaaaaaaaacccaagaaactctgcgagatagagaagtgggacctatattaattgtaaagagctatctactatatgggtaggctaagagaaggctacaaaaaatcttatagctaacaggtcggctatattattagtcttgctctaactgacttcccgttgcgcatatccagatacactcaggaaaaagttaagggcccctttgctttggaggagaagcaatgatttcaatcatatgggaaaaattcttatataagctttgaaacaaaggattgaataatatcatatcatttaaaattctcgtggaacaaataattctatagagattttagaaaaaagttaacaagaggttcaacctcttaaaaaaattccttttgagtctatctctctcatctgattcctatgtttttcatgtgatccaatcaaacgatcatttatatgtttttttctgtattttccaatcctctattttgcacttgcattcctattaaaatctttttttattcctttgttttttcattcctataattcaaatgggcctaaaaaaataataaggaaaaccatgctgtttgacagtgcatttttaggtttttttatgaaattttcttatcaagtttcaaaaattaatgaagatatacatatttattttactatacaaaagatgcacacacgtgcacactgcatgtacgtacaccacaaaccttacgagcacacctgtaacgtacacctcgagaaatagaggatactatcaaattaaatcctcaaaccataccacgtagtactgttgtaccccttcattattttaatgttccctctaatcaccactattcgaatttcttcccatcttacctttagccaatcaaccactcttaacccaacgccacctcccaccggtacgttgaacccatccaccaagctcacattattgaagtgcatcgccgatatcgcctcttagcgtcatctccaacaccttcacccaggttgcctcctccgcgcaaccgtgtaagctacacctagggggttacaccaaaacattccaccgtagaccgtagtagctgctggtgtgctcgttagagttcaatagagtagtcttaccacggctacatacatttgaccacctcgttggcaccttgatgaggcctaggcgaaagttgtcaaactacgacatggggtgcccattgtccgacaatgttcaataagcccagccacactgactcactgcgattgttcaggagaggaagggagaagaggagggaagacaccatggtccgtggtaggcggctccccagtcaatcaagcggtagcgtgacgtgtacccttgtcgggctctgggcgaggggcatccatatgcgtggtagaagatcacatcctctaacagttttatatatttactggagatgtattagagtaggtacaatagcagactattagccagatataagcatattttaatgagataaaagatgagagagaagaccagcgggctacagatctgtagccagctgcagcatggattccaagacgcagttgtatatgacaggtggaaccatatattaataatatacttcatccgttttataatgtaagtctttctagcattgctcatattcatatagatgttaatgaatctagacacatatctatatgaatacagacaatgctaaaaagtcttacattatgaaacagaggtagtagtaagcaactattatatgaattgactattagattggttatagatgaattggagttagtagtgggctatactattaaacttgctcttatagagaaaactttcatttcttgcaggggagtggaaaacccaaagtggtccctgcatgtgtgagtgtacctaccaatttcctagaggcggcggtatcttttgagtgaacgtctgcatcaccggctatcttgtgggcgcaacatcagccgtcggatcggtgccccttgccaatccgacggctgagaaaaccgctcccgtgattacgacggcgataaggcccccatctgtttcgtgcgcgcgagggccaccacggtgaatgaaagcgacgcaactgcgccaaccaatatttttctcgcttctttcctccggacttttgaaattttttgttgcttcttggagtactttatagtgcttggttattcatgatgtaaagtgtttcatcaaagtataaaaaagtgctctcttttttccggttttatgtagattactgctttgaaaggccgatgtagaagttggaaaagaaaaaggcagggtaattaagtgaatgatggtcacaaaagacaccatgattagatagtgcaagtctatcatcaacacgtcagcacggtaatatcaagagtacttagcagattgcacaagcttcaaaagctctttttttatcttcaaggtcaaaattttgcaatcgtcgttatctattaacttgctagacggttaattagctactatagctactacggtactattactactaaaattttaagattatggaataaaaataccctggtgaggacttgcctgctactctttgcaatgaactttttagttagtagctgcggttaaccggactatgcccatcgatcattgcgtcccatgcagaaacaaaacggtgcggagtcatgggctaactcacgtctctttaggacgtactgtacatcatgtccaaatcttcttgggtgccaattagagaagtctaatgtcttaactagaaagcaccaagtaaatatcatgatgtgattaactgatagaatttcttttctagattgagagccccgtcagttagcctaataaaccaaaccaaatttgaattttccaacttgattttaaagttaattttaagatatttttaatgtttttttaattttttaagtcgctatgaataaatatgtaaaagttttacctataaattatattttttaataagttattttgacttattagagaaatatgagcaatcgcaaacagtgtcactcacactcggccactgatcgttcacgggccggtgattacaagtcagaagacgatccagccacacggttaaaaaggggaggccgagcaggcaacatcaacaagcttttctcccttttcttgagaggatcatggaggaacttttgctgagtcgccgtcgccgtcgcgtcgccttgcagccgtcagtccgtcaccgaccccagccgtcttgccgctcttttgttttccctcttggctcttgcccggaaaggcaagccaccagcgaccgaccaaaaaccagccacaagcttagctctatttataagcccaaacaccatgacataggggctgtttagttcgcgaaaaaaaaaaatttggacgtcatatcagatgtttatcggatgtcagaaggagctttcggacacgaatgaaaaaactaattacgtaactcgtctggaaaccgcgagacgaatcttctgagcctaattaatccgtcattagcacatgtaggttactttatggctaatgatggataaattaggctcaaaatatttatctcgcgatttccctcctaactgtgtaattagttttttaatctatacttaatgctctatgcatatgtccaaaggttcgatgtgatgtttttggaaatatttttggggaactaaaccaggccatagtttagtccttgaaaaaaaaactttgacaagctcagaccggcatgagaaagaccacacccactgttttttaagagtaggtacaatagtagactataagccaactataaacatattttaaagagatgaaagagggaatagaagagtagtgggctacatatttatagggacagctacagcacggactcccaagatattaatagtgtagtatatatttataggtaattattgtataaattggctattaaattgactataaatgatttggagctagtagttggctatactattaaacttgctctaagctaagaataataaatcttaaccaaagccggctgagaaagatcacgagcctgatccttaacatgtggatccgtcctctataattcgagcctcaggccctgtttgtttcagcttaaaattattataatctagattattgagtcaaattactgtaagctgaattataataagccgacatagaataagctgtgagctgtttgtttctctggattataagctgtttgttagctgttagcaacctaataatctaaaataagcacatttatagtgaattactagattagattatagtaatctggtttatagattataataatctatcataataagctatctgtttgtttcagcttatttctaataatttagattataataatcctaaagtaaatcaaacaaagctttaatctgtgctttgaggtccttaattaccccgtacatgagggcctgtccaccatagatcatgtcttaaaccttggtctcttaacacacggtttcgctccccatggttgagccttaacccgtgctttaaggtcactgctccgtactcaagaacatattcatcataagtccgtttcttaacacatgttttaaccaaagggccataaagtgatcctttgctaaatcaacattggaaattcatcccgaggagagtcgaactcaggagctgataaactctactagagagctacaagcactaggctacatacctgttcaccattttcattgttaaagaaagctcaacattgtgttgcatttgtttttggacgcacgcgcacacacacacaggagtttgtaagtggccaacccgtaaaattcacttataaaacaaaacaagccatgaacctgcttattttgatctataagtgggttcacggcttaacaacttacacccctacacacgcaagccgtcgccatgccgtggtggtgtcagcaatacatacagtctacaaacaagcatgcaacgcagaagtgcagaacgcgacaacggtaccgtacctccatgtcctcgatgaacactgaacgaaggtggttttagtcactgcaagaaacccatattgcctgccagtctttcttcaggataaaagcgtaggtttggtatgaagcagatgagaaagagatagtgcctgcagccctgcatgcacaagaattggaatggatgagagacgaagagtggtaaaaagggcagcagcgtgcctatgataataagtgggaaggatgatgaggagagccactgcaacagtggaagccaattaaaagtgggcagcaactaacactgcactacaccacacctcgtgctgcaaccgagcagcaaagttgtttgttgccatggccaccacagagaaatcatgtcccggatcctacaatgcaaagcactgtgagtctgtgacaacttgaacggcacaagggaggagaagagctggccacatgacggtaccttcaggtttgtcaggtcttgattgggatggaaaaatgtactgtcgcgtggatctggcaatggagaatggctggctcatcctctgaatgaatacgatgcaatgcattgtggtggttcagacatacgacgcaggagatgcagtgccagcaaaatcctcaataattcctccaccttggggattctccatgtgtgaaggtccagactccagagttatcaaagtctgggaagaacctgctttggtgccatctatgatagggggcgactcagcacttgcacctgcatcatgacaaagccaaagaggccatctatgatctatcacaatggcataaacagtaacgataaaccttttgacggtacaacacgaaagcgagagtactatgcaaagcagatactaatagggacaataagcagtcaaagctggctccctgcctctagaagattttaaaagtgaacttttggtaataatgttacttccaaatgaggttcatgaactgtgaatttcagagagcacttgtggcataggctgataggcaagatcaccagctggttgcattatgatcaaaagtttttttttttctttgaaagatcattatgatcaaaagtcaggtcaattcaaattttggaaaccagggtggtaaaagaaagcaaaagaagcaatccagcacaagctgattcagggatccactaccatactattcgaattatgtaacctttctgacgctattcagacatttttccacctttacattcccactactccttggtataatgccaaccaatcacagaatattcatctatcactaggacttcggttggcttgcccttgtgcattcaaaatagtagttactagtatgacacaatctcgctgagccactactataacacaatggaaagaatcttagcctctagacctgatttaaaaagatatgatcatgccttaattaacaggaccatcgctgtcaacaaactggagtatgaaatcaagtaatcaacaactaaacataataatagactaaaggagtggaggattaagagagatgaaagtaagtgttaccttacaagaataaataaacttccccatcgcaagcaaagagtggattgttcataacttcaaactaggcattgcatggtctagaagttttgctcttccaacacaagcatccatgatttacttgtagcctcatgaataatgacttacttgtatcaaatgcacctccttggtttgatatacctttgtatactactgaactttactgttctaaagggtactttggatgtggtattgaacttatgctaaaaattctgatatagatgaaagaatgctgtatgaacataaggagcatttttgtcagaaagagaaggtaattagcgccaacctaaagctaagaatacattcaaaacagcgcttactcataaagtagacactgagttcaattacaacagtacttgtgaatgttgaaatcttttctacctaaatgtttccaaactaaagaggtgatcagatcaaaccacactgtgtcaagtcattgatggaaataaggaaggattgatatcctccagcaatttaagtgctgcaacataactgaacctttgtttatcagccacgctaacccccctgatggcctcatacgactcagaaactgttaaaagtgatactatcactctcaatttctcaaaggcaggagcgatgtaatacgaaaccatactgtcacaggtttgcactataaattttgtttgcgattattatggtacttttactcattgaaatcatttgcaagaatgagatttgcacataaatgcagagaacaatccattcaattaaataaacttgcacatcttggcaatgcaaatggaattagccacattgatcagtgatccatccatccatacaaggagcaataactgacataaaattccttattaactaagtacaacaagtagtaggcagagagatccaagaagacgaaacctagatcagaattcagaagtagagccccatctggacgttcttctccacgaacccgcacttggcgtagaaccccgtcagctccggggtgcagttgatgatgaccttgtagcaacccctccccctcgcgtgctccacgaggcggcgcacgacgcgctccccgagcccgcggccgcgcgcggcggcgtccaccacgacgtcctcgacgtgccccacccggccgcaccgccgtatgaacttgcgctccacgagcacggcccccgcggcggcgaggcggcccgtggcggcgtcctccgcgacgaggacgaggtggtcggcgcccagcgccgcgagctcctcgaaccgcgcgcggaaggcctcctccgtgaggggcggcgagggggagagctggttgaggaggcccagaaaccccctggagatgtcggcgagctccagcggccggatccggtaggcctcgccgtcgccgccggcggcggccgcctccgccgcggcggtggggagcggctgttccatgcgtgccactcgtggatgcgtctgtcagaagaatcgaggaattaaatgaggcccaattcggttagttttaggatggcccacttctggctatatgggtttgggccttgagtcccgtgagctacccaaaatgggccggacttcttgaagcccaacagctggtctccttggcagccgtttcgcttcgaagacgtctccagtatttactccgtcccaaaaacaaaaggcaacttcatcgttgtactaggaggggccacattgattcattttattagaaagggtcacattgattcgttgtactaggttggtctttttgggactgagggagtacgttccagctccgtactcagttagggttttcggttcgaaggaattttaggatctgcaaagcgaaaaagctaatcggcgaacagcacccccccacccccccggggcggggcgcgtgttaacagtgaaatttggtaatcggcaaagacgtcatcggcttagaatcattatcggctgcagcatctcggaatcagccgatgggagttataaagtcgccaatagtcggattcctgctatattcggttaagaaaatcaatctactaaatgaagtttatccttaagtgaccgagtttaaagaggatgcggcatgtcagtttatctattaattaggaataatttgttagtttccttttatctttaggaaaatgtgtttagtgtccgataaggactttatattttccttttatctttaggttagtttctttcttgtccgacaaggacttgtatcaacccatgggtataaatatatacacccggggtctatgtaatctatcgctacgatcaatacaattcggcgcatcgccaccctttttacttctacttttgttttttacgttccggcggaacttggcacccgacgcggggctgcatcgtcttcgatctccgacgaaaggataagtccaaagttccgtcggtccaggcaattgtctcatctacatcggcgtcgttcaaggctgcatcattacattcgacctcttggattgctctggtttagatgatatatttgcctacctatttatcatgtctctgttaatctagtcttagcatatcaatttagctatatcggctgtctctcgctttagggtttctgccggtatcggctaaatcgcgttactagattagattagtgtaacattgtcacgcccagaaattcccgaatagaattccaagcagaatgtgcattaaaatccccgtccaggaccagccggggtacacaaacgacagtgttgacattcagatccacgtcttacaaacatcataaaagattacaaatgcagcggaaaaagataaaagcgagctaagcctgaaggcttgactcctgcagcgggcgactccattccacaggcatccttgacggcagcgacgaaaccaacctcttcgagacatcctcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaagcagtagttgaaagccgtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacataccaccacgacataccggaaagaggccgtgacaggacccttcgcataaccccctctaaccgatcgcaccacaccttagggttcgcccccgtccccagcaggcaacgggcagccccccttttgtgccgcggtgaatccggaagccgatcaaccggacacctcggccgacccaactccatcacgcccaccctcgcctgggtacgtcggctagagaaaagctacactacaagcccagccgttgcccacgctagcttgtggtaagtacgataaattcttccagggcatcccgcgaaccggtccttaaatgccatgggtgcgactagcaagaccatgcacccacagcccaccatgacgtgtattttaattaaccaacacaattacggtggcactaaatcaaagctataccaataatcaagtctatgctttaatgtgatccccctttgtgcactagttgaactaagcatggctaagcatctcctaaaccaacatctagtcattttaatacccaagttatcaatggcgtaagggaaacaacatatagctgagtaataggaccaatcccacatgatattgtaaaacaatgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaataaagcacacaagcaaaacatgctataagactactgaaacagataacaaagccatttttaatggattctacacatttttatgaatttactgagacttgaatggatttaatcggagctcggatgaattagttatgatttttagaagattctatgtgtttttactattaaagaaaagccttaatcaatttattgcgcaatattgccccagggctgacgtcagcacggagggggtgcggcgccgatatgcgggccccactggtcagcgactcaagggtggccggtctaccgtggaccgggaccacgcgggtgatccaccgccgatccacgggatcgacggcccggatcggcccggggccgatcggacggtgcggcggcggtcaggctaggctcggctcggcacaaagccggccgaccggtcacggcgacggcgtgcgcacgcgcacgtgcgttgccgacgacagcaaccgacggcggagacggcggcgcaaaggcggcgccgaagggcggtgatgctaaagcgacgactaacgggcggcggcgctaaagcggcggctaggagggagagggaggggaaaaaaaggggagggggtgcctcaccgagggtggccggcgcggaggaagacgatggcgaacagcgacggcaagccacgggaggacgacgtcggcgggcggatgagcttcggggtgccctaaggaaggagaagagagggattagagagagggagatggaccacggcgaccggaaaccatggccgaaggcggcggtagaggtggtgctcacccgagtgcgagggaacgagggctccggtgacgaacctcgacggaggaggggtggacggggtggatctcggccacgcgaacccgacggcggcgacggcgcggcctggcggcgaccctaacggcggctagcggcggccggagtagcggaaaaggcggcggcaaggggttgcacggcgcgggagcgatgggaggctcgagagagtacggcggaatggggaaaaagtgagagggagcgacggggaagcttaaatagggagagagaggaccgggcgtggccgggagaggcgggaatcgccggccgacgtgggggagtgggggaggagagagaggcgggattcgaaaatcgaatcccggccatctcgggcgcgggcgcgagcgggagagagaggggagtgggcgcgggaaacgcggcgcacgcgcgtgcgtggtcgacgtggcccgaaggaggcgaaaacgtgggcgcggcggcggttgcgagcgcggcggcgcgagcgagagcggcgggaggtgggggaaggacccgacaggtgggccccacctgtcggcgaccccggagaggagggcggcgggacggcctggctgggcctcggcctgcggccagcccagcagggaggagggggggaggaaaggagagaatgggccgacggcccattcgaaagaaaaaaaaaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgcacctgcattttcttaggatcatttataaattaaattttaggcttgggaggagaacttcggggtgtgacaaacatcctcaaattttaaactaaaatttgactgcatcattctggcttttaattaaatttgtttggttcaaaaatctatttgatttttatttaaaattggtttaagtattataacccaaccaatttactctaacttattccctttattctaaaccctagtgaatttgagcaaattctctcaaattcaaaccatagattatttctttagcttaccctaatattagtggagatttgctatactctaaaccctagtgaaacctttccaaactcctagtttgaattcaaatcttttctaggaaatattcaaaaattctgaattctactgttcattgcacataaggtgttcggtagaatgtctagcccacctagagcagcccaactccatccaatcttgcacaaagtttagatttgatcctagggaccacaccccactcaaaaaccgtggatttctttacttcttcctccccttgcacacaccgcactggcatccgattttgctgcgcgccgtgtcgccgcgcgtcggccttggggccgtttgcacgtgcccgactgccttggcgcgccgtcgcccgtccgacgccctcagcccaccgtcgccgcaccaatcttgacgacgacaaagccaggacgacgatcgccgcaagaaattgccgctcgacgccgtgcgcacccgtccaagccgccgccgagtgcgattttgcttctacccggggtgaatcgcgccaattcttgccgcatggttggattggagatagatggtggtatcccctctcacaattcaaaccattcacccccgagccggccattttcaccctcgccgctgccgcgcgtcgtgctcggattggcgccaacacgtcgccagccgattccaactacggtcaagtcaatccttcgccggtaagtattcgaacgtggcctcccgccactcaaatcgatcttgcccgccctctctcagcctctgccacctttgcctcatccaaatcccgagctcatccatggcgatgaaggtgcccgagctcatccgctcctcctagccctataaataggaccccaatcccttccctgtccatcatcgatcatcaacaaccatagccccacaaccccgaagctctgcttcaccaatccatctcatcaaccaccctcgcccgtcggtcgaacaccttgtgcgcgatcgactccacccctctccatccatcttccgccctaaataacccttagaacacctatatcataccatgttctagtatactaagccctaaccaaagccctgcgtcgatttttacctcgccgcaccaagccgagcaccgccgccccgcgctgctctgttcttcaccgccgcaatccgtcatttcaaccgatctcggtgagtttttccgtttcaatcatctacatactacctagattccattttagcaatccctttgcactaacatgccaccctctgagctgccgacgtgagcacggccgcggcctatggaggcgctcgtcgacaactatgttccgcgccttgccaaaggttggcaagctaccggaatccctctaggcacctcgtagatgctctagaacccctcccctagccatgtttaactcttatcaccttgatcgccatctcggcctaaccgtgccaccgccgccgtagccgctaggccgtccacgcatcaaattaactcctccgccgccgctcgccgtcgccggagatccctagctccctcccctcctcggccgcaaccactttccccctccatcgccgccgcaatcgccaaccctagcgccgccggctggaattggggaacggctggaggttgaagaagagaagagagagagagactgacaggtgggacccacccacagtgccatttcacatttatttgattttcaaactttagaagtccatatcttttaaaatatagatccaatttcagtgaaacttgaaccaatattcttctaaaatcattctctatctattgagcccctttttgctattttttcattttattttattttattttctctatttttcttatttttggattttatttaaactccttttgaatttaaattttatatgtctaaccctaggtcttgaggattcctctgacactctagataatatcaatcaatctcaggacatcgagcaaggcaagttaccatatacctgttgatcatttaagcctatattttacaaatcatttatttatttatagccttctattcaatattctattttctatgcataaattaatcatagaaacccagataatttagtattgcttattttgcttacaatctggttaaaataccctatacttagattgggacaatacgtaagatttggatgatttccaggtggctagtattgtctcaatcgatataagttttaacaggtacttatgtcgaacgaacgggtacgaccgcagattctagaatggggacagacctagttattatgttaattagcaatatggcacctctgtatagtggttcttatttttaagtcctcgcgcaggaggcaactatagccgcgaagggcaactttaaccattaccatgtacaggtaaatggtttgtgatactcgagtataaactatatggtatatttctaaaccctgatcgaaatgacgtggtgtcatacgatcagttccccttaaatacctcgggaacgccagaactcctcttgctgctgttaacattacgttcagagcatatgaggatataagttcatggaacaggtgccataattgttattgacttaatactgggccatgactaaagccgataattatcagcaagtcgtggactgcgggtaaaacgtacatctgctgcagtagaatatctttgaaactattcgaatagccgtactcatggagttgagtactgggactcatatggtaccctggttagaaatctaaagtttatatgttttataaattctgctataacttttccagattgtctaataccgctttttgcaaagaaccctattatatgtcaatgcataacatatttccatgataacttgctgagtattgtgaatactcatccttgctcttataacccctttttcagatctgggtcaagaggaggacccatatgactattactacgaagaccccgataacttagaaaatccctgagggttttacctcactagtcagaatgtatagaaacttccgctgtgtactaattagataggtgagtacctattattgtaaaacccttagtattgtaagactttaacatatgcaataaagaaccagttatattgtatgtatcaatttttactgatccagggattgatacaataatctcagtcggatccaagttgttagttttgggctccgacaattagcctaggcatctaccaccctgaaaatcagtcaacggcttgattgtctagatattgtgtttcttttcatacttagtgttgcatcagttaagtttgatctactaagtcgtgcttagaaccataatctctagactgcttattgattgccagtaagggtttcatcggggtttcagctggtgagttacatggacgttgcatcggctcataaggattgcatatacatataagttggatttagccgatggcaacaaaggtttcattgtttaatctaatcttgtggatttcatgacatcggacctccagccgatgggtgctttaaccttcggatcaatacttgttctactatatcatattgttagccgattggtttatacaggattatattgctatattacatcatcatcagccgattgcctttatatcagtatctacatttgacatatagccgattgcttaaaccctatcgctatcggcttgtatcggcatcggctattatcggctatcggctggaactactccatcggcttgtcagccgatcggctgtttgatctattatttgcaaatcttgtcagttacaggattaaattgactggcacgtccgcatctcatcaatctttggacctgcacaggagctaagcagatctcccaggccggtgtgttcgattttttcatcaacagcgcggcatgtggcggatgcagaggggggcggggcgggatgagcacggtagatggtacacgtgtccccgttcggttttttctattttatgtttttctttatttcttttgcttttttggttttttttcctttagttttttatacgtacgaatacaaagtttgtatatgtgtatgcaaactttgtatatgtatgtatgtactccctccgtacttgtaaaggaagtcgttttggacagcgacacggtctccaaaacacaactttgacttcttgtttctataaaaatgtttattgaaaagtgatatatgtatacttttatgaaagtatttttcaagacaaatctattcatataatttttacattttcaaactcaacaacttgagagttattcatgatttatattcccaaggtttgacttaaacattgtcctaaacgtcttcctttacgagtacggagggagtatacacgtatacaaagtttgtatatgccatatacaaattttatgtacgtgtatattttttatacatcaaaactatatatatatatatatatatcatattttttatatacatcatatacacacgcatatatatactttatatacatacaaagtttatacgtatgtatataaagtatatacgtacatatataaagtatatacatacgtactccctccatcccataatataaggcatggtcaaacttagcacggtcttcaaaactaatttttgacttataatttctcatatgctataaggtttattgcaacaaaattataatcatcttaaagtacatttaaatgttaatctaatgatattaattttagcaaataaaatttaatttatattataataattgttggtcaaatgtttttaaagttgaatcttgtaatatgagcacgctttatattatgagatagagggagtatatactaatgggactagaggggcaggactgaccgcgcgggtgcagccccgctcggctggtcgccgatcaggcatcccttgcacagctctagatctcatattcaagttggatttaaagtttgtatgttaaattatactacctccattttttaatagatgacgctgttgacttt

SEQ ID NO: 35895 - DNA, 61329 bp, Oryza sativa
  unsure (1)..(61329): unsure at all n locations
attaaaaaacggagggagtagtagtttaaaatgttatatttcatctaaatattatcagtataactttaaaggttgtatattgctagcaggatataaaggtgatgtcacgctttctagtatcattaaatcatcatcgtacttcactgagaacttgcccaaaaccaaaactaagaaaaagtacagactaaacagaaagaattagtaatgtgtatacaccacaagtacaaaatacaccacgatcaaataaaagtataattgatgctttagaatattaaactggtaaaattagtttgcataaaatacacaatttcttgaagatttaaactgatggaatatctttagtttgaaatggaaatcttggagctttgtctactcaataaagagagaatcaaggataaagcagagtaaaatcaaccattccatgcagattcagtcatttgaatataaattaaatttgaaccggctcaaagctgagttcatcagttttatcccaacttaactaccaaacctaactcccatcagaatcccaatttattttctataaacacaagaaatcaaacatagtgagacttgtattgatgtggtagaaactaactcatgattaataaaaatatttggtggattatacataagcttgagactgaagactatcaaaggctactgacttgtattgacattgaaaaacaaattggcagttcagccctgtcagggttatggataccacatacctaatagtagttgactaaatctcggcaggacccaccacataccatgtcctatacggaaacaacctacggatataggagggagttccggataaggaaagacaaccagagttctacatggaaacgacaaggactacttgaattgtatccatattggtttccctagttctacttggacaaggggacacctatgggtataaatacaagcccccctaggaggacagggggacacacacccaccatggaggatcaacacgatcgacccccaccatgagatgatcaacaccaatcatgagacgatcaacacccaccacgagacaatcaactcccaacacaatcaacatagaagcctacatacgccaagacaagccgccggatatcgacatcagagatacgcttggatcgaccctatccggtacctttagaggctggcccgaaggatctagcactgtctctgattcccgtcggcgcgagcttgaagaggaaggctaccctgttgtcgactacgagttaaacctttagacccgcatattgacaacaggtagataggctacccacatattgtactggggtgattatggtgaaataagagcatacccactttcggccacaagatgtaaggttattacctgacaactcagggctcgaaccttgataaaaatccatgtctccatcttttttacctcagtctcgcgtatatcctagcaccaccgatccccatactgtccaaataccgtagtcgtgacatcaaacgtcgacagtggcgcgccaggtagggggattttggtgctttaggatttcgacgagatgggtttaagagatggactctccgacaacaagctactcgacgacttcggctgtggggagatccaacctaaccagatcggaaccatcatcgtcatcgacaacttggtctatcgagatcatccaagcctcaagatacgcggcgtaccaaaagatgtcagatcatatgatgtcgaacgagtacgcaataaggtaattggtagattggtttttcaaattgatctactaatttcgtagatacatccagcatgtatctacaaaggtacgcaatattttatctacaatttatcgtacctattctgatcatacaacattgtcagatctataatttattatgtttacctagagcatgttctttatacaataatatctgttgcgcgggtgtccccgatgttaaatcgactacgatctaacgctgggggctcgctctgtcttcttctgtataaatcatgcttgtttatggtttacataatgcctgatatttacatctgctcgttatatcctgataatactagaagacccatgcagtttttcgaatacatattcgatattatctgctatatatcttgccttctagaaaatatttttcaggaacagttgagcactcgagtaggtgatggtcgagtacactccattaccgagaacattctcgacaaatgcggagttatcgcacccaacctaccaacgaagaccgacgacctatctcatagcaccggccatcgctggactactcgagaaaaggttgttaacggataattcctcgtgaacgtcgtcggcttgatcacccgacatgattgcgagcggacatccgaatatgctataagttgggtatgtacgtcatgctggccacatgatatgcacatgtaataaaccaactttagcgcccctttaggtgattaagagattcctactcctggttcttgaaccagtaaaacgtagtgatctctctcgccccactttaagtggtcgagttacgactactgcctggtcctcgaccagcgatgtagcgtttctcccactacttctactttcagtggtcgagttacgactactgcctggtcctcgaccaacgatgtagcgtctctcccactacttccacttcaagtggtcaagttatgactactgcctggtcctcgaccagcgatgtagcgtttctcccactattttcacttcaagtggtcgagttacgactactccctggtcctcgaccagcggtgtaacgattctcccactatttccactttaagtggtcgagttacgactactgcctggttctcgaccagcgatgtagcgtttctcccactacttccattttaagtggtcgagttacgactactgcctggtcctcgactagcgatgtagcgtttctcccactatttccacttcaagtggtcaagttacgactactgcctggtcctcgaccagcgatgtagcgtttctcccactatttccacttcaagtggtcgagttacgactactccctggtcctcgaccagcggtgtagcgattctcccactatttccactttaagtggtcgagttacgactactacctggtcctcgaccagcggtgtagcgatttctcctactacctctacttcaacaaagttgatagtaggtacacaatatcgccaagtgttttacccagagatcccttaccacgacgacacctagcattgaaacctatcctactgtccctttacgccgtcttgacaaggcctccgaggaacctaagggatcttcggctggggacgcccagagccgataaggccttgtcggatcctgtagagacaaaaggccatgtaagatctggccgtgtaatcagaaattgacttttccaacttcacggctgggggctaggatcagtgcttattcaaccaaggcaggtcaagggtccaagagccttatcctccgagaacgattctccgacgacaaggctgggggctagggagagtgtatgactctacaaactgactgatcgaagtcggtaagagagaagaccctcatacacaaaacattggtcggtaaatttaattcattttcaatttaccatacatattataacattgtcaccttttgagcgttcgctcgggggctatttctatctaatattcttttctgagtattgatttcaggaaaattctattcgacattgttgaagactccatgtctctgtggttctacaccaagatcgactaaggcgagtacgacaaatgtcgacaaagctccgtcgcagactctacgccttcttgatcgctcgagaacggttgctggatctcgacaaggaatacggaataaagacatggtgtacccgccgagataaaatttcttgacttcaattcaaattctcgattacagcaagacgggagacttagttgtacgctatgtactttctcggtcgacatcaaagattgacttagacaaaccctttcggtgcccgcacgaggctgacaaaggaagtctaacgttatctctgaactcaccgaaaacgttcacatgagctcgataatagttactccaaagtctgcgcgcgattgataatatgaattcgttcatttgcattgaagtcggggactactgtcagggttatggacgatcaacaccgatcatgagacgatcaacacccaccacgagacaatcaactcccaacacaatcaacatagaagcctacatatgccaagacaagccgccggatatcgacatcagagatacacctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctacccacatattgtactggtgtgattatggtgaataagagcaataccagcttcggccaacaggatgtagggttattacctgacaactcaggggctcgaacctgtataaaaatccatgtctccatctcttttacctcagtctcgcgtatatcctagcaccaacgatccccatactgtccaaataccgtagtcgtgacatcaaacgtcgacagtggcgcgccaggtagggggattttggtgctttaggatttcgacgagatgggtttaagagatggactctccgacaaccagctactcgacgacttcggctgtggggagatccaacctaaccagatcggaaccatcatcgtcatcgacaacttggtctatcgagatcatccaagcctcaagatacgcggcgtaccaaaagatgtcagatcatatgatgtcgaacgagtacgcaataaggtaattggtagattggtttttcaaattgatctactaatttcgtagatacatccagcatgtatctacaaaggtacgcaatattttatctataatttatcatacctattcagatcatacaacattgtcagatctataatttattatgtttacctagaacatgttctttatacaataatatctgttgcgcgggtgtccccgatgttaaatcgactacgatctaacgctgggggctcgctctgtcttcttctgtataaatcatgcttgtttatggtttacataatgcctgatatttacatctgctcgttatatcctgataatactagaagacccatgcagtttttcgaatacatattcaatttgatatttaatttttttccaacgatagagctattgtggagccatctgatgctttaaagttgatgccaacaacttaaaaatttgcatccaaaatagcagagctatattcggctactccacccaaggaacaattagaaatacacaattcgctcatatttcagatgtgtcaaactatcatcatgagtaaaggacccaaatttaaatactttattaatacaacacatatcaaattatcaatgtattgtctacctcacatttctccagtgatacaccgtatagtcaggataatcgactgttggtatcattcccaaagtgaagaaaactatatctttaagcgctttgtgctcattaaaatgagtttgaatcattttggacagttgttaatcctctatcaacaaacataatagataagtaaccatggcgaataaaaagttcagatgcctaaatattttcatcataccatcaccatatgttataggaattaatatagccttatgaatttgcaatatgctaattgtgagcatataacaaaacatagtgttagaatatataatgattccataccgttaaatctttaacaatttttatcagaaccacctaattgttccaaccactatgatttagctgcactgcatcccaacaagctaatttcaattttagacaattattaatggatagacatctccaacggacatcaagctagttgagtagattctgattcttggtgattctaattctaattcaccctaaaatcagaaactaaaaaaatcaggatcaattagataatgtgtttggtgagaaaagtttgattgactcaaaatacaattaaaattacaataattttataaacaatctctcttgcaagaaaacaatcaacaagatcttatataaatgtacttccaatgcagtaacacaaattactgaagaactaaagatgacttgatcgtaatcattaaaccatagaaagtcgctacaaggcagtcaaataatattattacctctccattacatatgtttcgtgttctagaattaagcaatgatgcattagaggtacagtttactctctatttgtttgaagcgatgcatttctagtaagactggttatattgggccttaggtaaggatcaacattgtaagtactaaatgcaccacaccaactagcatatttttggcatcctttgcatacagtgaaaaggagaaaagataagaagataggggatgcaaatacactaatatagagtactctattcatcacagcccaacagtagtccattcaagcacttagctagcctagcctagcaggcagcagtgtaaccctacttcaatcacacacaacataaactatatgcaaatatctataatgtttacttctatcatctagtagcaagtaggcaggaaacaatattgtcgtgaccttaggtcacggacaagatttgggatagaggggaaagtgtatattctccgtctatcctgaatatgagctcgaatgtaaatgccaagaattgaagtttgtattcctcttcctcctcctctgttacaaggttagggttgggttatatagccctcaactatacatatgagattacaaatttgccctcaaatgcttacaaggagttactataatacccctataaagcttataaccctaagggtatattggtacatttttgtggttcctaaagatttttggcgccaacttgcaagagtagttgaagtggtccgcatggaatcttctatgcttgagagcattttccttgatcttctattgccttgggtgaaagacatttcccatgcgaggactcgaacacactcctccgttggctagctccttgggtgtctgtctgctataagtaaaaaatctccccgactgtatataatagctcgaatgtgatttgccatgaccaaacgcctcattggctatgtaaaatagctcgaatacagttttccatgaccaaacacctcatcagctatgtaaaatagcttgaatgaagtttaccatgactagagaccgccttgatcaggctcattgagtcgaaaagtatttgccaagagtaaaagatcactttgacttgttcgccaagggtgtttagactgaatagggggatggagtttaccctgcctcaatacctcatggacctcatttctttttatcccaaaatcacaatattacatagcaaaccaaagtaaaagaaaatatctgttaccaacatgatgcatacaaaataaaatgcaatcattgctcatctccttaaccaaaataaagaaaaggtggcaaaaagaactatttatccatgaagcaaatttaccattctttcacgctgtagttggtatgcaggatggaaggaaagatgtgaaccgagggaaagcggctttggtggctcttgtcgagacgaagtaggatggtcccagtggcacttggggatgaaaagggatgattagcggctaacgagatagcggaaagcggcggcgggcacgggtgagatcgagataggggtgggacggcggtggacgcatcaactgcgtgctcgtttgcacgcgcacgcccccatgccgacgtgtggatgataggaaaaggaataactctactttacctccctcaactcatgccattagttgaatagcatccctcaaccgcaaaaccggatataacccatcctccaactcacaaaaccatcacaaattgactcctcgggtggtttgggaggcggtttcgtctgacgtggtatctttgaccccttgactagctgagtcaacacatgggcccaatatgtcagtgtcttgtagtacaaaaagtctactttacctctcccagattcttcctcctccagccgatctcttgttcgtgcccatgcactgtagcgtaacctcaccttccaagtctggcctccccatcacctctctttccaaattacttgcagaaacggattcttctcgatctcctctccttttctctccaagaaagcctcatcaatatcatgttaaatcccgcgaattttggccatattcttatcccgacgaactcaggatgaaccctagttttccacactgaatccatctgtttctagaccggtcttcctctcctccgcctatatatatataaccctggtttgaactcatgccctagccgcctccccgagcgctttatctctatgttcgcccaaggccaccgctctagccgagccgcaccgccgcaaccgtcgtcgcctgaggtggctgtcgccactgtcgggttcgcaagacgaaggagaagctcggcctcacctctgcttcacttggacatcatcggagcgctgtcgtcgacatcaacccgaggtcgtcgccttttgaagctcgccgccggccactcccgtcgcctctcgttgtcgtaattgcgtcggtaaggtccatcgtgttcccctcttcttgcctatgcccttggtttccaccgccacacctttgttcgccgtcatgccatggccaccgccgtgcaccactaccaggcaccgccaccgcctctgcaagacactgacatatgtggtccgatccacatgctgacgcagctagtcaacggggttgcagatgccacgtcggacgaaaccacctcccaaatcgtctgaagagttgatttgcaacgattttgtgagttggaggacgggttatagccggttttgcggttgagggatacgattcaactagggtatgagttgagggaggcaaagtagacttatttccttcctatactttattgggtgaaaactgtgtgcaaaacaatacggttagttttactatagcccacttgaagctacatgggtttgggccttgaggcccgttccaaaatgggctggatttctcaaagcccaacaaggcaacagctggtctccacaactcagccgtttcgtttcgacaagatgtctccagtatttcacatttcgaaaaccactttcgtcaaaatcacccgctcaaaccaaaaaaaaaaaaaatccccaattcgaaacgcgattcgtcagccgtcgccatggtcgccgccgccgtcggcgaggcgacccctccgccgggcgggccaccctcccgcgtgtccgtgtcctcttcttcgtccaccccgcggcgccggtgcgccgccctcacgagccgcttccgcgagccggcgagcccgcggcggcacgcgtgggtgtcgctgcagggccgcctcgtcggcgccgaggaggcgacgtccgccgcctcggccgcgccggggctccctccggatgaggcggtggcgtgggagctcttcagcccgctccaccgcgtgctcctggtcgccaccgtcgcggctgcctcctcccgctcccacgaggcccgccgcgtcgagcaactccagcgatcgattcatattagggtttggttttactgatctcatatatttcgccttatcccagatttattagtcacatagctaatacttaatagattgaagtgttgaacccctttgttgattttagtgatctcatatatactgaagcctgtgtgttcttgtcatttcggccaagtgctatgcgtatatgacttttattatagtacctcgtaggtgattaggttccacttgaatgttgcatattctaatgtttgcggtaatgtgctatatgcacgatatctcggcttttacatgctgttcttgcagccttaagtaatcgtatgaagaaatgtttatggtatgcaggatgaggtgcttcaaagcatgcagcagaagcttgatgatctgtttgacgagatgaactccctgcaacagcagtatgtcaagtgcaacaccttcatttcctcggagcagggaaaatctgagttggtgggtagcaagaaggtaggagattatgacggagctagatgctgtgcgtgtgcaaagccagagattgctgctactcctcacaagacaaaggtattatgtctttacagagagcttgttccatgaggtattttcatctcacttccttttcatatggtggacgagtgcaggatatctgtggaatggacgatgcaaaatctgatgttgttgataggtccagcgtgagtcatatggaccatgaagagcgccgaatgtcagacctctcagacttttgctggagtgttgtgtcatcggtggataatcatgtaaatggggacaatcaggtaaatcctactccattctgtggtgaaagcatcttatttatgcgcaacgtcatcattgttaattgttcatgtacagtttttttttcaatgtacgaattattgatcaacatttcagtattaccttcattatggagcggagtgctttgataaaatctgaacatttctcgtgctttaaatgttgctgactggtgacactctggtcaattgcatccagctaagttccctggcggcagaacaggaattgtacaaccttcagaaagaatgcgaagagaaggatgcaatcataaaggaactggctgcaactgcacatacatctagcactgctgatgccaaggtacaaattgtcgtggtggtatgccaaccatgtgaattatatatacttatgttatccatctgtctatatgcagagaatagcagagctgcaagaaattcttaaaagaaaaaacatggtgatatctaaactgaagaaggacatgtcagctttaaagcagatggtatgtggtccattgctacttacatcttgtgatttttctttgtgtgttctggtaaagttgtaacatgtcttgtttcaatgtttcatactcaaggttgttgaattaacaagggctaaaagaacatcttctgtcaatttaagtactagctgctctgaactgccagtgatgtcaagtaatgttctttatgatatgagcagcactagcccatcatcatcggattctgagtctcctgtagcaccaagagaataccttgatgatcatcttaaggttgatgatggcattgctggagactctgaatacaagggtagttctagattctcaatggaaagcgcatgttttcccacaaaaaactcatcagctggcaagcttcggtcgactagtccattaaaagagaaccgtatagatccgaatgttgaaacaagtttggtcggtagacagaagcaacgtatatccaccaatggagactttaaaaggactagacggcaaagccagcaagactcaaggaacagagctacaaagagatggatgtagagtttagactgcagttattaccaattacaggtacactgaatacatgactaaattcagttccacagcttttgttaaatttattctactatcaaatatgtgactttattcagtgcacctttcttccatgtatattctttttctttgtactgtgtacttttgtcttcctcttccatcatctttgctgttgctagtcctcagaaccgtagccaatattagtgcaatactccctccgtcccaaaaaaaaaagacaaaccctggacatgttcagattcatagccagggtttgcctttttttaggatggagggagtacatctctaggtgataggctgacagcctttgccagatcagcagatacagcaaattgatattctatatttcattttgatttgtgtattaactgtaattcagtattctgttaccagatacactgtagatatctgtttattctctagatctttatttctttttgttagttgtttctttattactgaaagacttttggacgttaaattacatctgagaacacatcggctgcaacttttcagtttgtccgctttttagggatcaaatacagtcagcttctttgatactatatatccatagtatttcttttaagatgcacatcgtgtaaaacgtcagttaacttcatgtccccttttctttaaccgggtgcagcagctctttttttttcttttaaaaacttggttgatacgctgaccaatccattgtttcggcatttcagagcaggaagagacgaaattggtagcttcatcctggctcctgctgtttctgtaaacaaaaaatatcgatgcaagttgctacatactttatttatgtctatgatgaaaccgaccaattcaagctgttcatcttcgtcattggtatctgctccgatgtataatatgccatttggatctgcacagtcagcgtctctctgctcttgaatctatcgctcttttttaattagtggcttaatttatcaaacggaatccagcagttcatacgtgcacatttttcctatattacttgtttaccaggtacacaaaaaattcttcatacgagttgccagatggttagatatatatactcctggattctgtccatcaggagctcctgattctttttcttccagtagtacaacttatgtgcctatgtatttgcaatttgtcgcacaatttgatacctggattgcttgccgctggcgggctctgcatatgccattgcttccaagcttcatcatcgtttatacatatagccattgggttgggaagtccacaggggcaatctgatgaagttgactccatttgggagctctccaatcgcatctaaccaacaaagtcttagcttggaaatttggaacatatgtgatcaataggaaatagtagtcaaatttacaaaggaatcagctctgaatcgattatggattatctggtttttgagataatattcaagggtgtacaaatgaataaattagctaccccaattacgtagaactaattagacatcatatggtacttcgaattatctagatttatagtaccggattaagtgttcaatctagtattaggcttctatattttagaacgtagagtactttaaaattgaaattttgtttcgttaagaaaaaaaaggtattataagaaacttagtttttgcagaactcgcaacgtttaagaagcttgcaagcatacacgtaatagtttgcaagcattactcttaaatcggtaagaggaaaagaacaggagtcaaaatcaactcgtgaccataaaaaaacggagtaatcaaaacacgccctgcactgtacgaacaacctgaacaagtgaacaggaattcaccgaatcgcattcaattcggaggtggacacatcaaatccaaaggccagataatccaacgaggcggccgccgatcccatcaatccatcaaaattccaactgtactccatctaaaagtttaaattataagagtactgtatttcttttattactaaaagtagaaaggaattcactcgtggatcatatgaaaaaaccaagaaactaataatatacatacatgtaaccaataagtattaaaataatttcttaagttatgatcaataatttaatctaattatctagaacatagatgttgtaaatatattaatctcatttgaaaaaaactaaaaaaataaaatatgcacgaagtgagcgtaacttaactgtggtggtggaatcagcctacccaggtagcaagacgtctgtggtaatagggctattgtatacgtgttgtgtgagactgcgtttatactatgtatttttaaaaatagaaaaaaaattgaaatatgcagtgacattttggatagagagagtactatgcaatacccccctctccctctgacatgtgggccacgcagcaacggatcgagcgggcctcgcgcgcgcgagaggtgagaaacgaaacgaaacgtgacgcggcgcgattggtcgtcgtcgtcaaccacctcgacggcgacttgcccccttctcctcttctcttttttaacccctcccccctctcgccgcgcgcgccgccgcggccgcgcggggcgcaaagtctgcgaggagcacgaggccgcgcacagtattctagagaaagtcgccgccccacttggcccacgcgatcgttgcagaggttgatcactcgaggtcgagggcgatcgatgatggagcaggaggacgcgaggaggaaaatggcggcggcggcgggggagcgggggcaggtggtggtgctggagtgcgtggcggggagctccaaggcggaggagtggggcggcggcggaggggtggtgcaagaaggggacgtggtggagccggtccgggtggggcgcggcggcggccccggccccggcgccgcggtgctggaggcgccgttcaagggggggcgcgccgcgctgcacaaggcgatgcacgccgcgttcaagcgcggggacacctccgtcgaggtgcgcgtccgcggaggcagcgagctgcaggcctgcatcctccctcactccggcgacggcgccgccgtcgaagccggtggcgaagtcgaagaagaaggcgccggcgaaggtgggaataagcagtacgtgctgcgttccctgcacgaccccaactacgttcttggcttcgtcgaccgcctcgaaagcgagtgcctcttgttgcaaggtaaactacttcgctcactgctcatcgctctgaaatctgaatagttcatccgttttgccgcgcattttgcaattttgctgttccagacgaattcaaccaaaaaatatattactgtttcaagttgattcaagtatagaaatgttctgccgcttcagctcatccttggtgttatgaactgaacctttttgctgatcaaatcgatttcagagaagttcggtgtgttcatttcattacgagaattttttcttgtgtgtgttcattcaatgtgttggtaaaatataaacaagagtgaaacgaacgaaacaggagtatcaacaagacagatgcggcatttaatcttgttttcattttgtgcctttcttggcctctacatgtgtttttacacctgttgtgaaaaagacaagtttgctgtcaactctttgaggttcaaaacccccaccaagaatattctgataagctgatctttcagcgcgttgttgcaggcctaatttccttgcataagtgtgtgtctttctctcacggagagaaaactaatctgcctgtagttatcaatgataagaacgatagctacatgacaaaagataatggaagcaaagtggaaagaaaatagtgataaagtatgggagaatatggaagacgtttcggaaacaatgtcaggccaattgctttggtagagattggtcgtttgtctagatggtgatcaatttctagatacctcgtaatgttcactcgttttctcaattctcatatccccggggaagatggaatttctatggtggactagactttgtagtcgttataaacagtcatcgtttgtggcctcctgattagttggttcattactgttgggacataactaccgcactcttatctgattaggctggtctggacatatatggcttttgatctacctggctagaagttataactgttagtgccctggtgcaacttttctttgtcaagcatgtgcgttttcctgtagaattcagcgcttctgaacaactggtagatgcttccatccctgactttaagttttaagtaagaaacagataatctatttcgttgtgaacttttgggtaatgaaacatataatctcttttgttgtggttttttggattatctttctatggaaagtatgtgactttcccttgattcatgaaggcactaggagcacaagagtggcatcagccctgagcagggcacaacttcaggatggttatgttgcatacccatgggagaagaagatgcgtgactcgttgcgcatgcccaactccagcagctacctctcgatgctcgtcctccccaaagctctggacctgaattcatgtcgatacgagtcctttgaggacacccttgcccgtgccaacgcgtggatctactcctcgcaggtctcaggaatccccatcgagttcatgaatgtgcagagtgaggctcttctcaccaaggtgcagatacaatctccctgcttcaggctttttgcagcctaaatttcctgttgcttaactgaaccttcagtagattgaacctgagtatgaacataaaaccccagataagagttgatttggttaactctacttattaagatgtgatctttgcacttcaaaatgtacagatatctggagagacagcgtctgcaactgttaactcaggttctttgtctgatctgtctaacgtcacgaatgcgaccctgtatggttttgaggattaccatggggtagatattggggtggtgaaagcagcccgactttggtacagctccatagcagaagagatgccgctggagattccacttgaagaaggtgacacgaggctaggattcgccatcagccgtactgaagaggtactttgtcacttgacactgtacacaatgccgacaatagtgtacctgaacaattagaactacacatggaacacactgtgacacatttctttctggcagggttttatcttcatatcttcagtggttgacaatgacaaggacaatgaggcgccatcgacacggtcagggctccgcgatctgttcaaccaggcaagggaggcatcaaaactgctagttatctcaagggtgtccaatgagaaggtccttccctggatgatctccagctcaggagcgatccgctgcttcgacaccatctccctcagccaaaagctttccttgcaccgccttgcggtgcgccccatccagctccacctgctcatgtgggagaaacctagtggtcctgtagaaaggatcattcgctctccgaaacttcccccacaatctgagctacctcaagtaccctggaatctaattgagagcattgaacctagagtagatgttgatgaggactatgtgggggatttgtcatttcggattgatgatctttcagtgggaaccagctgggtgtgatcctttcatgctgcaagcttctaatgtgcatatgtatgtcttcatttacatagttctcttgggcagtatgctcagttttgttccatttaagtgtagaagcctggctagaaatgtccagagccttactaggtttctggatataccaagggcgaggctttcataacatctgaaacattatgttgtgatgcaatgtttttgttgatcatagcataccattggaggaatacataagcatttcaataattatctaaggattatcccaattatgggcctgttaagttactcccaaacatattgttcaacactgacatttctgtactttgtactgaacataaagtttgttacacttaaaccacacaagctattggtcaatgagagctaagccatgaatctcaattatgctacttatcaagttgtgagcactctacacttgagcactcgatattggacatagaaccccggcattaccatgatctttacctgacaaggattgtgcagctgctgcttgtcaggtaggatgtcctccatgtacatctgatcgaatacgcggctctcttcgacccgcatgatcgtcagcgcgggggtgaaggagaaggccaggaggtggagcagccagacgcacttggcagcgacgaagaagcactgcagcagctgctccggccatggccgggaccaattcttcagggtggacacaatgcagctcatcttctggtcgcagaaccggctgaagtcctcgctgtagtacttggtgcccttcctgagcacctcgttccagctcaagttgcgcagtgcgacgaaggaggcgaagctctcctgggatccttgcttgggatcgaggcaccgtggcgagccgttcttttggaacgtgcagttctcgaaatcctggtacattgcctggttcatcagagcttccagatggtacagcaccagcttggagcaatgcttgttgtcagtgatcatgagctggtaaggttggagaagaatgtttagtttttctatcaaaccattgtcaggttcttcgacctgctggatcaatgccttgcagaattgcttcaccgaaagccgcgcctcggaggcgatctgcaagaagccttccaccatggcttcatggctgaccggccccgggagctcctggcttgctccgatcgatcgcgttgatctcctcgacatggaggatgatgatggttgagcgttgctggttgagctcgtcgctagtcgcagtgccttcttgagctccgagcagtaggcctcgaggccggcgagcttggtggtgagctctcccagggacgacctcatctcggcggcttcctgcagcgcggcgtcgcggtgcgcgttcgcgtcggcgagctctcgccggagcgagtcgagcgacagcaacccccactccttgagcagctgcgacatgttctcccgctcgatggcgctcggagacatcggcttcgccttcttcttcgccctcgggaagagccacgagaggatctgcgcccttctgtgcttcgccggccggggctgcgccgccgccgccgccgccgagagcggcgcgccgctgctggcgaggaacttgagggccccgacgtcgatgccgtggtcccggccgatcgtcgccggccggaacgcgctgccgcacgtcgacggcgccttgagcagctccgccgtgccggccatggtcgccctccccgccgacgcgaggaaacggtcggccgacggcgcggagtgcaagaacgccgggtggaccttgtgccgccggtgatggtcggtggacgacgggaagcggagctcgctgttcgaggacgagaaggcgttgaggttgtcgtagtcggagaaggccgcgtcgtcgtcgtcgtcgccgctgccgccgccgcccaacgcgatgccgctccagttctccgaccggctccggttgtcctggcaaatgtggctgagtccggccatttgctcctcatcgtaagcctgaccaatttaacaagaaattcaagccaaaaattagccaaaaaaatcttgcaaaagaacagaacaaattcagggacagtgagattgaaaaaaaaaagtgaagaaatccaaacagaatggcacattgcaacccacatttctgcaatctgcatggagttgctactgaaagtttccaatttttaccatttaccaaggcaaagtacaggttgctgctataggttaaagcacagcaagagattactccacagatgtgtcatcaagcttctttcagaaaaaggtgagaatgtgacatcaaaagaatctgagataacgcaacttttactgttgcttaactgcattacatgtcctattaattgcagagtaatagtaggagcatctgggattagctgtcaagaagaggaagaacatgctagcagcaagaagagcatgcaagttaaggagaactaatgaatggctcaagttcatcaccaacgaatgacccttgaaaacgagaagagatgaaccaagaaggcacatcgccatggcagcatcaaagatagcagtgacagggtgactgtacgcaagaaaagctcgctcaccggagtaaacaccgggtagtcctcgtcgacggtggccaccgccgccgccgccgcccccgcctgggagagcgcgggggacacggccggcgggaggcggatgatggccgggctgcggctggcgctggcgccgccgcttacgccgccgccgccgcgctgcagcagcgcggcgtggagcgcccgcagctcgaccgccttggcgatggcggcctgcacgtcctgccgcgtcgcctgcaccggcggcgtcgacgtcgccgccgccgtgccgaacgcctcggctgcggcggccgccatggccatgtcaggcgagtcaaaggctgcttcgccttcgcttgccccaaggattcttggaacgcagagcgaggcaagcgagcacgggtgaggagaagcaatggagggggaaatgaacagtagattcttgagagagagagagtggttgttgcagaggagagtgacagattgagagagagattgaggaggtggagggaactgcacatttgaagagatttgccagtgcttgctgcaagcaaggccctcttttcttttgagcttttttttggctttcttttcttttcttttctttttgcttttagctgcattatgtagattcgctgctgctttgtgtatactttgcttgattggtaggagtaccacctcaaattcgggcctcctttgccaaaaatcttgtaaaggtgtattacatgctaccgaccaatgttaaagaaacagccgacaagttggtgattaaggttacgtttttttctgtttattcatcggcttcttgggacaaagattatcagaatctcgatccatatgctagtaccttacaatactactacgattctaccaaatcaaagcggtaccgatccacctagtatttgcattatgctttaaaaaaaatgttttctcgaaaactttcttctactgcagtgctgagtagtgaaatacacttgaaatagagttttatatttgcacaaatttccctccgaaatttttctacacatacaaacttctaacttttccatcacatcgttttaatttcaaccaaacttttaattttgaccgtgaactaaacacacctctatatctgcacaaatttcgagccattgtcactatttttcacctgtttatggctggtagttggaggtaggtcaaaaatctcaatgccaacactacctctatctgcaacaacccggccattaatggacatctctgttgcgatgccctgcaggctttcttgcttgcttgcttgccccgcggtggcggatttgctgtccaaccgaggcggcgacggcgcattaaattcccggccgtcgctctcctctccggcggcggcggccaccgcgatcgccgccggtgacacacgctgccgtgtcaggctaagctcgtgacaacattctggttggagctcggactgaacattttcttttctttttttatggttagctcagacacgagacagacattctgcttagctcagctagctatcacgcgcgacgcggacggaatactgataagcttttttttatcttttgaaagataaactattaaaaggttggacctttcgtcaggaatgcaacctggctttaactaccatttctaaaaagaatgaagcgtataagatgcagttgttgttgttattggtatttttttgggtagatgcagttgttgctgatgatccatttcctcaaaacttaaaatgtactctgaaatctctccatgtcagtataccataaagaattttacaaacattaaggtactatttttcttagtgtaaaatttagtatctttacataccttcttaagcgaatatacaacaaccagacaaatttgctaacatgatatagatgagagtagagagaaatgttgttataagattaatatgggcttaacaatgatttttattgtttataaaagaaaattgtgctgtgtaagagtagggaagaggaaagaatgtaataaaaaaatccgtatactaatagttagagcatttgttatctcaatcgttatatgatgataatctctaactgagttgtgctttaagagccacatcaggttctacatttgatcatgccctaatgggctgtgtacatccttttttgggtgtagaggccggtttaatccattatctaaaaaatttgatcatgccctaatggctttaaaaatcatagtatcctctggaacttatgaactgctgaagcagagacagagatttagatgttcctttttccttgattgtttttttaaggggaggatctcaaggagtctgtcattcttcgcattgttttgagcttagtgcaggattggtcaaaagttagctgtaaaaaggtttacaagatccaagttatacacctatcttgaatcttaaattaaaccctcagggaagtgtcaagcagagagcatactagatgtaaagctcaaggtcctagctgtacatatgtccaatccaaaaggcccaagaatcttatgccaggactcaagatatgttaagggggtaggttgatcattcttaactttatccatggaaatttctcaacaagtgatctgtgaaaggttttttgcaagagacaacacaaccaacaaaaaggtgatctatccattccttttctcctctttacacctttactgaattttcctttgtatcggagtgcttttccaatggcatctagctagatggatctttgcacattgagctcaccatggccatgcatacatgcatggaaggaacaagattggacgtctcattgtcaagttaaccacaggggctgcgtgctactaaagcctaaaaaggcactaaaccaaacactttgagcgtatcttatcttaaccttttacaaccccattgattgagtaagagctgattataaacttatcaacataataaaattatttgtgagtaaaccttctctatatatgtgttcttagcaattttaaagccaatgctggaaaaataaactacaatgaaaaaaaaaacttaaaatcaacttcaaaattattttcttttggcagtggcatatataaccttttatgtgaacccttctattgtcttgcatgcatctgatctgcaaatttttaaaaggagttttcagagcaagaaaacgaaaccaggcaggcaatacccccaaagaggcctttgtcttggcacaaagcaaggaacaaaatactccagctagggggcagtatgcgaagccaagggtagctgcagattgttgcagattgtatacctggaagggatggatgtctgtgtccatgatggtgtttgtttaatccaaaatggcatccagtgatgcccatccattatactagggatgtgtgagtccattttgtttgagggttattaatttattaatccattgtgattgattttacaaatcacaacaaaatagccttagaatccatttttgtccgggctgttgttcaggacaaggtggtgttaaggtcatttggaattcaccccttagtttaagtatgacaggtgcatgtgagctcctagtcctttctggctttctgtccactcttggttaggttaggttaattatctcttccctcttatccttcaatcatcggtcgttttgctaaaataaaagaaaaacatagtaacctttcctaatagcttatatgagcctgaatgcaataagaaaaatacaagtgcagaaactgatttagggcatatttggtttgctactatcttcaaccttaccaaattttaatactcctattgccaaattttttaccctgtttgaaacatattattcactggataattgccatgggttatctacatgtagagataaattaaacatttttataaacaaacttaacaaatagtttagaacaagtagtgtaagcaatgaaataaaatttatgagaaaacatactttagagatgcataattttcccttaacttattcacataactctgcacaaaaatctgataatgtatcaaaccaaactaacagagttattaagggggtgtttggnactctcaaaaacataagtccctcccaaacaccccctaattttggcatcaaactgaacacgcctttaatcgaacagaaaagcagtgtatctttcaggccagaagagtacagggaagcacaacttgtgagtgtttgctgctgcaaaagattgcagcgtgcacagtactaggggtgaaaacggagcggatattatccgatccgatccgctccgaatccgtccgaagtgaggatatggtaagggtctgtagatatccgtccggatgcggatgcggatgcggatagatgcatgcggatgcggatgcggatatggtatcggtaatatccggcggatacggattatccgctattttaaacggattatccgataaacgttttggcggataatccgaatttcacagcccatataaccactcaatttggcccatttgacatgagcattttcatcgtgtaaagattcagcccatccatgtccaccttatccatcaatctatccaggagttcagtccgtgactcaaacgacgtcgcgtcaaccaatttttttatcgagacttctcttctttcagtcctcccacgccgccacctgacgccctgacttacgtgtggaacttctatgtcttatgtgatactgttttttctaacaattgtgaaacttttatgtcttgcgtgttatgtgaatgcgatatatcgtgatgtcaatactgtatgtgtcgattacatgcttttggacagaagacaaatcaatgttaacaacttgacattatattatgatgtgattggtgctttcatgagtcatgtgaattgtgatattggtacctcattgttgctcattgcacagatgataagatgttatatcgattgtatatacatatcacatccgattattttcatccgtttccgagccgagtccgcaccgagtccgcatcatttccgacacccgaaataatccgttccgcatccgcatccgcacattatccgtaccgcctccgaatccgattaaaaaatatggtataggatatggtatgactactatccatccgaatccgatccgttttcacctctacacagtacaatggttgcatatataggactgacaaaagctacagccgcgagtgcgaagccaaagcaggtccaggagacagatataactgcattctgtgagaggcggacaagatcagcggcggtggcaccactgcacgacccggtcggtggccatgcaattgcagatgcaggtcaggtgcatttgcaattgcaacgcaaagaggtgtgtttggttggtgcagcttcttttccgcggcgcctttcgccgcctggtccagagagagagagactcccattgtttcccccattcagcatttgttgttaaattttgaatttagaagttaaaatttaaagttgatttttgattttttttttcatcaaattttattttttatcattagtatttaagtcgttaagaacacatatatgacagttttatctataaattattattattttgttaatacgtcgtatggtgtattatccgtattcggccaaacaatggtggcctaggaggatctgcacgagagcttctaacggttgttgtttcttttaaattaaaagctcacttaaatggtttaatttgtcactctagattttaacaagttgtagttatgggataaaaaataaactaaaaacaagaagttagttttttttcccttgcttctcctgattctccttctcgaaacctaaaattcctcacagacattatagatcatgtttaagtagctgaagattttgataagcaactagtaagaataccaaaataattttttttagcctcttccttttagtttataacctttagtatctgaatcaaaaccagactcttcgaaagagtagagagatttaggaagagttgtagctgtcaaaaactcttctaaacagggccacatgtgtgcagtggttcagggacagagatatcaggatgctgccgaaagacaaggtgccaaaagaattaatgctaatggctgtcttgacagtcctactgtccactgtggttaagctattacgcatggcagggcaggctttgaggctactgttactaatgggccctattatattgtttttttcttgttcatcttttcttcctctttctttgcaactgtagtaggagtacagtactccatttgtgcgtctcaagagaatggatgcccagtcagtgtcgttcttgggagttggaaacagtaagataagtgtactaggggctggtttggttttgctaccatgccaaaatattggcaatgccaaatcataggcaaaatttgatagtgccaaatgttttggcaacttatgtaccttataggcacattttgttagcaaaccaaacactagccaaactactatttaaaatgccaacaatttgatagggcacattttggcatcaaaccaaaatggccctagattagtaggagtataccagaacgtctttgcaatccttccaagggaatgaattggaatagtaagataatatgtgttgtgtaattagccggtaggttaggtccgagcttccaggatggtggtgtggtgtgagcacatcgtgctagcatgctaacagctaatgccactcattatgcaaggcccacaagtttaacctgagtaatactccctccgtcccaaaatataacaacttttaacccctagaatttatcttaaaatataatacttcatccctttcacaatgtaagttattctagcatttcccatattcatattgatgttaatgaatttagatagatatatatgtctagattcattaacatcaatatgaatgtggaaaatgatagaatgacttacattgtgaaaaggagagagtaacttctccaccaacattctcttcccaaccaatcgcaactctccaccattcatttttcccatctaccttcactactcatctaatcacaaccctttacaatttacatctacctactttcttaataaccgtgtccaactctaaaacttattatattctgatacgggggagtagatcattatgctcgagggtttttttcccctctgaatagatatgtcaatatctaataagtttcagacttcagacgacttattcattattggaagtaaaatctttgctgctgctcaacacagtagtctactgcttatgtagctcactactgtttgcagttgaacaatctgatacatgaaaataatgtcaaatctgacaggcagccataggggtgggcagaaaaaaaccgaaccgaaaagactgagaccgagaccgagaaattcggtcctaggtagtgaaagaccggattttgttcggtcaattcggttagtcccctcgggtaaccgaatagaccgaaaagaccgaattaccaaaaaaaatatctaaatgcaacatacaatccactatatttaataggattaatctctaattttcacatcctacttcttctaggcatgcaacctattaagagtctttactcataagtgcttacgaatttttttttgatttttgtgttgaaaatttctattgtttctttgcatatatgaaaatattgttgaatttcggtcaggactgagaccgagaccgagaccgaatttgtcggtcctgacattttttactgaaattcggtcttcacttttcaaagaccgaaaagaccgaagaccgagaccgaaattttcggttagaccgaatacccacccctagacagccataccccaagaccacaaaaaaggggggaaatgtactcactggcagacatacattgtacgctcaatttatgcataatagcatcgatggcattgccggtgtgtatacatgatgcagaggacagggatgtgacccccttctgtctaaaacagcattgatcacctcatgtagagaaacactgaaaataaccttactgataattgttgggaaaatgggaccccatctgcaaatgggttgtaataagcccacaggaattgaacatgaatcttgcaggagcaataaatccaaccctccaagctcaatgctcaagcatcagaggttaccagaaggtacatcgtcattgttacatttggtatagtagcaactacatgtttagtcataacaggggaagtaacaatgtacatctgcaatagtatggccacatccatgcaatagtggatgctaaatcaaaaggttctgtcaggttttccaaggtcccgtggtccggttctgctgtacaaagaccagaatgtgacgctatgaaccctttgaaggtacaacagttgaacgccaccaaaagctaacagagaaactaatagaaagagatctgacgtaatgccaccattttggtggaatgtaaagcaagtcaccctcctccaatatacagtccaagaaatcaagattttctacccgtgggaactccttcagatcaacgttgtcaagatctacctgcacaaacatttgagctgtgttgataaatgggcagttaggagaaactataggcagtgctaaaattatcatggggctagaacactctgtatcctcacatcgcacacaacagaattggacataatgcttttaaccaaataatctgagaaatggttatgactagcaggtaactgaaaaggttgacctagaaaatggaagtcaagcatatttattgtttcctaatttagctctttaaaatgctctgataagtagatccagcttgcaatttcatgcttaagagtaatcaagaagaggatactaacgctgagttcttttcagcaactcattggcaacttactcattttccgttagcacgcatccaaactgctaaacggtgtgtttcgtgcaaaagttttttatataaaagtttctttagaaaaatcaaacaaatccattttttaagtttgtaataattaatactcagtcaatcatgcgctaatcgcttgtctcatttcgggtcacatccaaaatttccgccaaactgcccaattgaatggcccaagaatgcaaatctttggctcacgatccatatatattaaatggtgatgacctgcaaatatatattttttccaaatatgtaaccaatcgaacggagttatgtacctgactggtgttacttagcatagtttctgtgtgtgggtacaagtcctcagatatggaagcaggatatagtctaatatacttccttcccaatacctatcaaggagaaagcaaagatattattaaccaataactgttgataaaagttaccaaaagaaactgctgagtactgatagttatgaactatgatagtactatgcaaacatctcaaatgggtcagccgtccaccatcaatggattaatgatgtgcagaaaggcatttgaatttgtcagctaaactcttaaatatgtatcagatcgctatttttttttggaaaaggagtatcagatggatttgaatgtttggacactcgaatcctttgcaccgcaaagtttcatttacaaagattgattcgctaatattagctttttcttgactgctccaatcaattaaacttatcagatgatcattgttgccaattttgaagaaccgtttcaattatttcaatcaattaaacttatcagattatcattgttgccaagtttgaagaactgtttcaattatatctacctggtagctgactacggaattctgagtagatttatgcatttagacattacatagatgacatgtcaatcagcacctaatcataacgtgatgagtaacatgatagcataaacagtgtgaacagttgaacttgctcatagaaaaaagagtatttactctagaaaaaattattgacaacagatccaaacggggaaaaaatatgaaaaggagtactcacactatacctgagctaaaatgttgtgatgtggatcatggtgcaatggtgtcactgtcccgtgtggaccaaaccatgcattaagtgactgaagctcccctccaccagcataacagtagtcaggaaccattatatcttcatggagctcttttatctgcaaatggcacaaaaaaaaaactgacaattgggcttatacttactagagaatccacaatgatagcatggttacctgttcaaacaagggatgctgagccagatatgtcaagtttgaaggacagccagctgaccacatcctctcaaggaactgagagaaagtgattagctcctgcttccactcactgcacacataattttttccaacctgacagatattcaattacattagtgctatataagtattcagaggtaggtcaatacaggaggaactttcatcataaaatgtcttcgagcaagcataattactcgatgcatgaaaaaggtaactacgggagaataaatgctgcatactaattggattagccatgtaattcagttgaataaatagcatttttgagacactaaattaatgggtaaatatgttacgacacaactattctactgtgatcaaatttcaggaaaatgttccatcacatagaagtcttgtgaataataataataatctatgtatgaaaagattgttcatgcaagagcgccgtagagttaatctagctgtacatgttaaacaatcacacaatcatataaaccaaatctttcggcaaaataagttcatacagaaagagcattgaacataatatgagtaagttaaaatactgaaccaaataccatggcaatatggcatcaaactgaaaccaacaaatatgaacggaacagcttaaaataggttcaatctacctactgttctgatcaccaaggcaaaagattagtgttccaacttgcaaccggaagaatacattgtaacacatttctcaaaattgcacctttgtacaagcaagttgagtcagagacaaatacaagatacaaaaataatctactgtaacttaatgttacttgcagacagctggccaagttcactaaatatcatattttgatgtatataggttgtttgttacaaataagtaataaaacttagcaccaaatttagatgcacttgtttattttacttcaattgaaaagggcataatattggcgctcgaatttgttactatgatcattaatgcactataaaaactataagcatcgaatagtttaaacaaagttaactaaacagaaatggcttgtttccatataatagtcttccagatctagtgtaaagagcaaaaggcatttacttcaacaggaacagttcgatctccagcaatcttcttcaggtattggatgtctttccactttgtccttgcaggccaatgatcgatgcttccactgattataacaggggactcgcgtaaaaagtaatcacatataaattcctccaaagaaatgcatgatcgcctctcaaccttcttacaagataaagactttgccggaagaatattaagtgcctggaaaaagtactgtcagtagtaatacaagatgagcagaaggtaatgattatgaatgcccttatccatacaacaaattcagaaaatgagtaagcgaagtggtaactagaatgaacggtacaaaccataaggagtaatctacaaatcttcactgatcattccagaaaaaaagatattcctacaatttatgagttgatatacggcagttcacccctaacagtttttcgccaccagtttgttccttagccggatctaactatatatgaaattatatagttgcagccatagttaattacgcatactgcaatgagctcctaaaaaattaagctaagttggaacccgcattgccgcagaaaagcgcgcaaaacaaacacggaatcctacaaaggcaacagcgatctcacatcggcgacgtctcgattcctctcgagcccttccctccacctccgggtctcctcgtcgacggcctccgcgtcgccgccgccgccggggtcggcgacgatgcgcgctatggcggcctcgaggtcggcgcggaggaggttcccccccatgatgaggcccatgtcgagcgccctgagcgcggcgcggcggtcggcggcggccgcccccagccgccggagccgcgcgacgtggaggcaggcgagcgcgtaggcgtccctccacgcggcgcccacctcgctccacggccccgagtggagctgctcccacgccatctcccgcgccgcctccgcggcgcggaggtcgccgcacgccgccttttccgccgacgccacgaacgcgaacccgccctcctcggttatctcccgcagcagcgccgccctccgcccctcctccgcctccgtcgccggcgccggcggctcgccgccggccatcggggtggaaagagaaaaaaaaaagcgcaaaaagcggaggagatatttttctggtcgtcgttgcttttgctccggatgcttcctcaacggggatatttgcttactccgtttggtatgctaatatcacgaaatgactttctaatttgggacagataatggttgggttcggcccatatgctttgggcccactagtagacaacatagcaatatatttgggccctgctgataggcctatgtttttggccccaatatatggtagggccatgtcagctggtaccaacagatcgttaatgggctaaaaaattgggccagtaatatatcgatcataatcggcccagaaaatttagattaaggcccaatttcaaacgcacacttgaatttcacattatttttcttatgagcttcacataattcagaacaaaaaaaaaatcaatgtttcttgcattcttttcagcttatggcccatgagttatatgcggataatttgtgtcgtgtttcaaaaaaaatacaatttattcaagaaccttttacattagcattaacaacatcattgtttcatttattcatttgcttatttgaatcacttattagcaaataaaagatccatttgtcagtaaaagttttatatacatatccttatcgactcaaaagcaaatacactaaagtaaactagggtgaaaaaacaaaaaaaaattcaaaattaaattctaaaatgcaaattttagcttataagcaagcaccaagcaatgagatcctaattgtttagataacttattctaaccaaaatatgttatatacttttataatcggttcaaatcatccatttcaaaatgcccccgactgctggatattcgtcggatcgaaggtttcaaaaacgaaaattaatcttgaaaaacctcacgttgcaaacgcggtttgatcgagggagcatgcacactcctacagattaaacgaattaacaacgactgcaggttgcgttttcatcaggaaaaagtttgattgagctgcatcaacacttgatgaaccagctgctgaggtaagatccgctaattcaagatcctatcgacagagatctcgatcgatcgaccaagcagtcaaacacgcctactttgtttacatcaaagggttaatgcccaaacacagtacacatcggttcatccatccatccatccatccattccatggggggtttcacagtcgtcgtcctctctcgatcgatcgcttaatttctgatctctcgatatctctaagctgctagctaagagctacggtgtttgcatgcgttgccggcggcggtgatctcaggtgtggggggcggcggagtgcggcggcggctggtggtcgtaaggcgggtgcctggggcgggtgacccagagggagctgagggtgcggaggcggtggaagtagtcggagacggcgagcagcgaccgcgccatctgcctcgtcgtcagcacctgctgcagccggtgcagcgtctgctgcctcaggttctcagcctgcatatatccagttaattaattacattagaattaaatctactaatcatgcacgagctatttagagtaagtataatagagcgctataagaagactgaatgctgagatagatgagagaggaaaggagagagagagatgagaaacgggactgtaagcttacagccgacttaggcaaaaaaaactaaaaaaatctatgagacagacaggtggactatatatctatagtgaagagctaaccactttataagtaagctgagatatagaccataaagatctatacagtaaacaactaaataactggttgtcttattagccttgctcttagcttgtcggaatgtctgatgctttgccaccgtcatgccaaaatcagcagctaatcatccagaagcacagttagttgaagactttggagtggagttggagttatatatggtaaaactattatatattcgtgcaatccacgatataaaagtaaaaataaatattggacgtttgtaaatttgtcactggttttttctaattttaaaaggatgccactcgaatgatagttttgcaaattcaactctaagattatattttagacgcggatgataagaaaacaaatagacgataagagactataggctggaactaaatcatttctattttcaaaaacaaaacatatattaattcatacttgcatctcaaatggatataagaagttatcctcctatatattttaattgtaaaaaaaaagcaacaactagttacacgcattgtaggaatattactttacacatacgtggacatcattaattagttggctgattaattatactaagcacaaacagtaaccaattaagcaagttgcaaagtgtgatatgaaatgaaatgtgtggtcgatctgtttgtggcatccatgagcaggtgaagggcggcctataaaaaccgagcagccaggcacatctacccaacatggaaagaccgatgaacaaactaacaattagtcaagcaataaaccctcataaattatacatgtttgtggtgtttgttacacagccttttcagggtttttatatcaaatccaacctctgctctctcccgtttctgggatggagacagtcgggtgcttttcaaaagctgaaaaacctaatccacatatgcttctctgtcgatcgatcgacacaacacctagctaggcgacagcaattatctaatttaatcatgaacatattcagtattgcagtgtcgatttcaattaggtgaactatccattgaaccttctcaactactaacaaatatatgtgatcttctcccattggctccagctctaactaatccatcgaagtgacaggagattaactaacaaataaactataataaagtcataaacatgtagtacaacccagttttattgttccgaataattaaatgaacagatggtatattatctgactattcttgagatactcgacgtacaaacgaatgaattaactattataaagttaaaatgtggcttttattaaaaaaaaattctaggcaatctatatataatttcttgaaaaaaaaatcgtattgttcagcagcttggaaagtgtagtgcgataatcaatactccctccgtcccacaatataagggattttgagtttttgtttgcaacgtttgaccactcgtcttattcaaattttttttgcaaatataaaaaacgaaaagttgtgcttaaagtactgtagataataaagtaagtcacaaataaaataaataataattccaaaaaaatttgaataagacgagtggtcaaacgttgcaagcaaaaacttaaaatccattatattataggacggagggagtaattaatctgtaagaggaggaagtacaaatgggcctacaactgatggaactgaagagaaaccaactaactgatgatgaagagtgcatgcaatgcatgactgaactgattgcaagaagggttggtaatttggtatggtttggttactgagctcgatcaaatcatgagagaagaagatgcagacagtgtgtgagaatcacgcaaggtagggtacctggcggacgaagccctcgagggtggagagcttgttgatggcgacggccatctggcccatgtagttggcgacgttggaagggcagctgagggcgtcggagacgacggtgtcggagagcgactggtagagcgcgtcgaggccctgcgtcagcgcctcctccgtctccagcgccgactgctgcagcccgtacacccccacgatctgctgctccgtcagcggctccacgtgcgccaccagcatctgcatcccctccaatccacattgatcacaattactacttattaatcaatccaatcacattaatcacatcacgaattcagtcatgcaatcgagcaaaaaagaagagaacaaatgcacacaaactgttgctctgtcagctagtgatcagatattcagatattcattcaggagttatagtatatgtcaatgcaggtactgtgatagcagctgatataacagttcagtatacgcgatcgatggagcagtttaattacactgaaaaacccagcacaattaatcgtaacagattcgaaacgaatgtaggtaaatcctgaatccgtaatggtttttgttggtttatcagtactgctacgtacgtacgtacagttctacaacatttggttggattcagttgtggcccggcttgaaaagctgaaatcccagtttcctgatctgattatgatcagatcgatcattcaatgcgtcgatatatcgatcgattcgatcgacgcatgcgcccacgcggtcgcgaagatggcggggaatgctcgcacgcgcgcgagcgcgacagatcgatgaagctagctatccatccactactcgttgtcgtcgtccagctctctccatggagggagagggtatgatgagcttgccgagcaagtgcacaacttctcctacccattgctggaaacgacaataacaaggtgtgtgttttggcttttgtcacatgaatattattcactgcctccgcgacccatataattaaggtgccaatgctgctaatactctctccgtttcgtattataaacaagtactaaactaaaatagggtttactatcgacattgtttttttttttaaaaaaaaagacattttcctttacagacggctaggatgcatttgcaaaagacggaatcgcccccctaacagaaggccaatgaaaattttcacatgtagaaaattatcacattccacaagcagttggcttaactcaaccacgtgtgcggccaccttaagtcagccatatatgaaactacgttttcgtatgcgatcaatgacacgacccttatggattgtcaatgcagtcggagggggcatcaatagaaatcattttttatatagtgaggctaagtattatatattttcaattttcttatcgaaattgttttcgataagttacttttttcatgttgatcaaaattagaaatgcgcaaacttttttcatgcgacatttttcttcatcactctgaagacccgagctagttaaggttgtttatgtaaattcttttattttcttttgagggactaatacgcaatataaaaatattcgaggggtttcaaagcataatccaaattattttttccccactttgttccgtttgtcttctacctcccgacgaagccattgtcaatcgctacgagcatctagggttagggttaatccaatccaagccaatccatggcggggggagtgcatagtagcgtaccttgatgacctcggaggggcggaagccgccgagccagaggaagcagcgctcggctgggctcatccagacgccggagatgaggtggaagacgtcgcccctgatggcgccgtccttgatggcggcgacctcgtcgtggtgcgccaggcagctctccacgtacacctgcagctccccctccggcagctgctgctgcagcgccgcccgcagctcgtacatcagccggtggtgctcctcctgccacctcccgtactccacgtcgaacatcgccgcctccgagctcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggctgtatatatgcaggcatgcagctggaacaagacactactgtgctactgctgctgctgctcaaattcatcatgctttgcatggcagagagtagtgtgtactatatatgcatgctaggtacgtccaaagctagctatagctgcagtactgcaggcacacaggcaacacgagaaagctgggggctacgagagatacgggagccaaggacagatatcacacagctgcacagctagctgctgctacactgcaacactgatcactgtaacctgaagctggaaacaacagaagtggatagcatcgatcgggtcaaactcgaacaaatgtgcacatcttgctactactcctagctagtagcagcaacaagaacgatcagtagcatggggattgatcgatcatctcttcggcgtgtgtgtgtacgtccctctttctctgcaccaggccacatgcagatgcagctcgatctcggcgaaatcattgagcagtttgttacatgtcacagtccaaaccagccggccagatcttagcagtcagagatagagagagagagagagagggaagagagaggtatagctagagagattgttggtttcatatgcatggactttgggttgctgattccctggtcctgagatgtgtgatctccacaggagtgcagtggtagtagtagcagtagtagtactgcagagatttgttgcagctagcagatatcctggtcaaaatggagtacctgagaatctgctgcatgcaggccggccggccgtataccatgatcgtttctgatgaccccagaaaaaggatgcaactttctgcaaccataggaatatatccctcctcctcctatactacagcctactgctactccctgtgtatgcttggcacatttgtttctgtgcctaagctatatatactgctgttattatgctattattactactaatgctaaatgccaaaagaagaacaactgaaaactgttactactgatctcatcacctgcattaatactctttgaaaaaaaaaatctgaactttttgcaaggaaatatatatggtgaatgcatgtttgagaaaatttgtggtgatttttcggttggcgaattaaaatttacgggtttttttcgtatacgtacgcctttgttcttggtgcgacgccgcatggctgccatgatccaggtacatgaacaaggcctggtccagctcccccagatgatcataagctcctgcagatgcctccttgctgctcctggtggtgcaacacaagaagcaaaattaggagcagcacaagaagcaaaattgttggtgatgaggtatagctatatgtatgtgtgagatagatgcaggtagtatagtagcatgcatgcacaaggttgaggaagtagtgaaggcatcacacatcatcatgaaatcatgcttctataagccaattatgtatgatgctatattaattatttgtctggtccaacctctgcaagactgcaagagtaggagcagaagaataatatgaatctactctacctttgtagcatttattttggcacagcccagaaaataagcatggccatgtactctccaaatttcatgtgtgcaagtcatgctcactgtaaattaaatgtaaaaacttgggcagatatgtatgatcagttggtcataaatatgtcttaggtaatgctcttgtacttatgcggaaatgaatcgctgacctcccaaaatttgaaagaaagactagcgagttgttgcaacaattcaactatatctggctccagatattaaatcacaagtactgaatttttaaatctgaacttgtttgatcatcgtctaactttttttttcttggggggagaggaagaaggaagagaaaaggaccgatctgtttgcatccgctcaaacaatcactgaattcccaaccaggaagcaaaaaggcaaaatcgtctgcatgtaaaatgcaaaattctagcaaaaaaagaagcaaaatcttcaacatgtagaacagtagaatgcaaaattcagtccacaagaagattattggtaacctagtttctccatggctagtgttttgttaaaagaggaggaggaggagaagaggaaattaaagcagtttccataaaaagaagaaggagaagaagaagaggaaaccatggcaaaaaagagatcagaagaaccagcagaaacaaagagagcaagcaagaaaaaagaaccaaaccaaaacaaaccatgcatgatcatgactaacaaatcagagatcaaaatcaaactccaagacacggcccaaatcaagaacaagaaagagacacacatatatatgcatcaaacaaatcagagagagagagagagagggagagagattcagtaaacaaagccgtacatgaagcttgcggcagcggcatgcatggaggaagaggaagacgatgacggaggcggatgatgatggtgctgctgctgatgctgtccgtagtgatggtggccatggttcatcatcatcccaaaggagatgttcatctcctgctgctgacgatgctccctctcctgctggctctcgctcccgctcatcatcgatcgatcaaatcaaagctaacctcttcagaatcgagaggaggaagaagagaagaagaagaacacacgccgaaacatacacagagaaggcaaggtagcaagctatatacgtatgcgtatgtgcctctatctatctatagccatagctgcaaggtgctaaatactctttgactctatgaggctagcagccaaggcgccacctctctctctctcactcactttctctcttcctcttccacaccagcaactaccccatgcatgacctctagctctatctaggactctagttcgtgatggcgccttggacactagcaccacttgcaaactaccctctcttactgctttgatgatgctgttcctgggctgctactgctttgatttcctcttaattcactaatatggttgctgatgatgatgatcttggctatgtgtttctagagagagaggtgagtgggagagccattaatggcgaaacagactttctgtttggctccatgctccctctgcatctaatggtatactgctacaaacagccgacttcttctcttctctcctctcctctcaattttctctctctagattgagagagaagtagagagagagatggaggggcaggtgaagcagaagacgtcgccacctttaatttttctgccacttttgcaccgaagcactcgtggtttctcttattctcgtttcaattcaaaccccggccggtgacaaattgcattagccattaatttagccactgtattttgttaactaaaaactgaactgttattacgatttgagatgccggtagagttgtgcagttgtgcatgcatgcaccaattaacgatttgagatgtgatcctttcaacttgtctttgtctctgttttgactttcggtagaaaccgatattgatgtgttcactcccaacagcaaagtcagtagtacgtactaccatgaaaaaagttggtcagagccacccaaagattgcgagagagaatttttctatgagagtgagctagaaaaagtaagcaatgccttgtgccaaaaagcccaggcctcttctaaaagtaaagtgagttcaaactgcccgtttgtctcacggcctcgatcgtgtcgatatgatgttgtagagattaattgatactatctttgatttttaaatataagtcgttttagccttatgataagaattgagaaaacaatacaaacgactttattgtgcttcatttatactgcggggaaaaaatagcgtgtttatttgtgagcgaggtaggtagcatttatttagcaatgacgggtagggaagaaagaccgaaaaagtgtcttgaagttccaaaaggacttgtatttaataatacattgagaagtttaaaatgatttagaatcagagagagtattaacttgaaaatttgcaaaatgtcatgtgaatcagtttaattcccatagaactccatgaaactttgtacccatgatttcaaagaggagaagaactagataggtgtggtgtaaaaaggtaacgtaggtagcatgatcgaacagaagcatgcgacgaacaaagaaccacccgccttcctagccatggtccccaaaaaaatatacatatagtttaattctaaacggaagaaagatctaagaaaaccacacaaatgattttatcgtgcttcatttatacatggaaaatgattcatttacttacgagtgaggtagcatttatttagcaatgacaaccagggaagaaataccaaaatagtgactataaattccaaaataactcatatttaagaaaacattgagaagtctagaatgatttagaatatgagggaatattgacgtaaaaattttacaaaactaagtgtgtgaatcagttcaattctcgttgaattccactacccataattccaaagaggagaagatcagctagacagctagacaggtgtggtgtaaaaaggtaatgtaggtagcacgatcaaactagagtaggagaggacaaataaccgtccacatgcctagctatggaaaaaaatatttctagtttaattctgaacggaagaagtgaatcgttttagccttgtgcggaacaagtaaaaaaacaacatgaatgacattattgcacttcatttatactacatggaggaaataactcaattatttacaagttaggtagtaagcgtttgtttagcaatatcaaacaggaaaaaagaagaccgcaaaaatgactagaggttttaggacgacttagatttaggaaaatattaaaaatgctataaaataacttgaaaatctgacaaaagcctataacattaaagaaagtacaaaatgtcacgtggatcagctcaactcccgtaaaacttcctacatatgacaaattgggaaggaaaacgttgagcaagcatgctataacttgaaatcagagggagtataacataaaaactttacaggatatctaggttttaattctcctgaaaattctgcaaaattatactttccgcctatgattagtgtggtgtaaaaaggtaagagtttggtttggtagtataggtaggttggtcgagcgaagtggaggatcgcgcgggcgacgacaaaagaaccgcccgctcgctcgcgctggctgtgggcatggtccaagattgagagccgcgcctgggatcagacgcacaagagacgcagaagaattattcgccgagtatgtgaatgctcctgttgctgccctcgaggcacgtataccgtccccaactcccaaaatcatcagtctgttgaatgaatgaaaatgaatgaatggccatcgccttacgtggccgctatctccccatcctccgatccaatgcatctttgcttaatttgcgttgcattatcccccgaattctcggcaaatttctcttcatcatctccagtttctgtttgttttattatctcgatcatcataatacaggtagtagtagtttgttatagtacatctatcatcttgaaatcacaacacttgtagtcctactagcaattatttttacgtgaaaaacataattaaaaaaaaccacctgcgccgataaacaatgatcattgagttgtctggcttaacaaaaatatataaagagacaagatagaatcctaaagtcctactagcaaactaacctgaatatattgcatgttaaaattcaaatcacatttatatttaacagtacgtttgttgaaattggttcaattctcgttgaattcctttgttgcaacggacccaattgaattggtgcacacgttacaaaaaaactggcctgaattcttggaggaacaggggagaaaagtttcgactgaccgacttaaattgttcgttcactggacgcattaactttgaagtgaatgtgctagcgagtgactggcaggaggatcgtcgatcggaccaggaggaccggaccgagggagttctgacatcttggaaattgcagtctcgagatggtaactcgatcagttcagcagcctcatggcttgtaaaaattcttcgtcttctcgtgtactagaaaaaaaagattgttccttttgagactttgaaaatacagttgctgctgctcatgtcatctggagacttgcagcctgtggtaggacgctcctggaaattgcagcatgagttgtgacccagtttagcgaagccgtcaacctttgcctgatgacgacgaaacaggaactccgtcagctcctagctaaagaaaacacagggtcagattatctcacgagattattaatttattatcattcgtttatgacaattcatattctaggaaaaaactcagcatatattattatgtacaaacggccggaagcagattcttttctattatataacgctcgtttcagctacaaaatatggtcaagacgacagtgaaaataaatgaaaatgcaaacgtccatgagttatttctttacctaatgtgctagaagagaaaaggtagagcaattgctaaaagactcaccttgacagcataggtgaagaggagtaagagcaggtacgatagcaggctataagccagctataaatatattttaaagagataaaggaagagagagaaaagcggcgggctacagatctgtagccagctgcagcacgaattctaagatgtaatgtgtgtatgatagatgggactaggtattaatagtatagtaagcaactattgtatgaattgactattacattagttatagataatttggagctagtagtgggctatactattaaacttgccctaataaaagattagtactctaggggtagtagaaaggacttacggagtacacttctctccatgcgtaaagagtacttgcatccaaaaggagaatctccggtagaagtcaaaactgttactgcctgacatcccgtttcgcaagtcgatattctactcaacagagcttttcactgatccagtcgttctgaattctgaacatatgctccagcgggtagcaggtctgccatgtgatgggaggcatggagctgcagctgctgctgcaaaaggattaggatcagaggacccacaatagttggcccctgctattttgtgcacaagaacagcaatcaaataagggaacaagaagtcaagaacaacattgtctctccaagccaagaggtatgaatcttgtgtctttaacgcaaaaggaatcaaacaaaatcatcctaaaaacacacgaacagaaaagaacaacaaacgagaggcagcaacaacattccagcatggactgaacagcaatggcaaagctcaaacaaccaaccaaacaatgcaaatcactgcgatgtcaaaacaaaaatgcagatgacagataacagcaatgggaaatgattatgcaaaaacagaacccgctccatgatgagatgaatgtgttacatgaagctctgcacaattagaagtcatatggcaaactttgtaaaagtactgctgacattgacagtaacaaaaattagtatttcacgaacataactgccccaatgcgatcaaagaaaaatcccttcactttgacctttccctaattcatgcattacaaacatgtcgcaagtcaatgacaatctcaatccattatcaattcgaattttttgaaaataaaaatagcagcagccattcattgcttggattgatctctacttttatcattgaaaagaaaatagtatgtcaacttttaacatttgaaactatgttggctgttatgcatacaaagcttttcttcgtgaaatatttatcaagaccatttcaagttcacatgctactcccaactcacatgcttctcaaggatacataagctacagctcgcagatcttggatgcatgcatagtcacatagatgcactgtggtgagaaaacttacggatagcctctagataagaataatcaagcatagaagatacatggtgcaagggatccaagatgcatggtttaggaaaagaaaattgtactggaagcaatttctactttccaagaaattgtgctgggtcataagtaagcagctcccaaaattaaagcatctcataaaaataagcaatcatgatgatatagttactatcaatgctgcaagaacctagtaacattctacatgctcatggcatttgggcagaacaggttctttcatataatagtcaaaactcaaagattatactttcataataagagcatcagttcaggaccaactctagccatagattgatgggtttcttcgcccaattaaacatcatgtaaccacatgcagcactgtgcttagctgaagttattagtattaataaaattaagataaaacttatgcttcccagtgtttagccataagcaccagaacatttccttaacattagttgtttttagttttttaggtaagagaactacagaagacactccatggctcttattcagcgtataaacgctttcttggacttctttttttttttaaaaaaaaagcaagcaggattgcaaacagattctacaaattggaaaatgtaccagtcatacaaaatgtccagcaggacaagctatcatagtatcatacagatttaagggttattttcttttagggaatgcacaaagacttgtctatcatcacatcaagcctgggtactgatgttcaattacatcgatctaacttcacagctgcatgagaccaccaaaagtaactatgccatattgccatgtatgatgtatcgttgcatcaagggttcttttctctcagctatctccaaaaataactatgccaattgccaagtagcacaaggggacagaggaggatagtgttggtgtgatttagtagcagcccccattgccacctggtagatagtgccattacattagagtatcctaaaattttatatgcacttatagaattgcttcacttttgtaactattagaaaatggcactggcaaagagcttttgatctgctacaacagttctctacttcattgtaattgaacatatggacagatcggatacaggaggttcctatcaactgatgatttttcatttattagtcgcatataaaatgttgaggtgaattctcaatgtttctgtagaatgcataaggggagagagtgagagaaagcaggagaccaaaactttcatttctcgcaggctaaaaaaattacaaaaactatgttcattcttcactagatatctttcttcagaaaaggccatatttcaaacttaaatcatatacacctttcccatttacaattcggtcatcatttgatatatcatttccaaagaatgcaagtcaggtataatttgccatgctagaaacggtatcaactaacaagattgatatttgatggcaaaataagaagtatagccttccatactcaagttacgatggtaatcctactgacaaaatgggcgacagaaacaaatgcaaggaggcattggagcctaacctgaaaaggagaaatgaaaaaaatggtcaaagaggaagcaacatcgaataaatggatatgtttaatgaatttacctatgttatgttcccaagtattccattagatcatcatcatgcagcagcaaatcatcaatatctgggattgggctactgatactgatatagtctaaaggtaatcccgcaaaggaactgccagcaaacttatcttgttcgccatagaaagggtaatcaatgagctgcatatctccaggaacagaagtagaattcccactaccaattatttgatcactataaggactgttgtcagctggtgttctgatacccaagggaaccacatgatgctccatgatagatagtggaagtggttgcttaggaggtatggtctggtaactactaggcatattgttaaagcctgaatcagaatcctgtgggaagatatttccagtttttggcctgaaattgtcactgctttcataaggtacagcctggcctctcatgcatatgcttacaggagtagcaattgttgcctgcgcattgccatagtgattaaaatcggcaggaagatgggccagttcttgagtatttcctctgtgttgcaaagcttcactcgtattagcttcctcattgaagcttgtaatctggttagccatgccttggatttctacctggtccagtcggttcatatctggaatcatattccttgaatgttctgatgcgtcatcagctctttgtacctcctgctcaattacggtgacactgtggcgtggtctttttctctttggtggttcttttgttcctgccttcttaggaacaacctgattagggcgtttgactttagctctttctctccttgttggggcatgctcctcgctcaactgtgcagccggagaaagatcttgttcatcatctccagatgatgttgaaaggggagcctcctcaaaaccatcaacatcatactcattactgctgctgtgtgtgtccccatttctgtactccagagcaccgtggtgagtaacctctgacatgccattgtcaatgctgagaacaagcctttcctctctctgtagaacacccaaccaaatcaggctctcttttgcagtcatcttatcctgcaagcattttgatttcctaacatggtttctgatcttatcgaagtttggggacatgtgcttgatcacacctgtaagcaccccaaccttccagaccttcttaagatcatgtggctttttatacggaggaatttgccccctcggaaggcccaacgcaatccaccaatcctcgttccctgaaggccaccacgggggtggagtgcccctctccaatgggtacttgcgctgcggtggatcacagtgctgcatcaatgacgaaagcagtgaaccgagagtggcgtcttggagatccatcaagctgtgctggctcttgatcccgctgctcggagcatcagccgacgccaagttctccgactcatactttgcgattgccgccggcccgttcttatcaaacttcaccttctccttccaccaagctctaatattgtcggaagcgccgctcacgggcttccctttatcagggatgatcccgtaaacgaacccgcgcgcgttgcacacctccatcagcttgagcatgtacttgaggatcccgtcctgcgccctcgacatcttcttgcgcatggcctgatcggatatcggcttccccttggacttgtccagctcagcctgctgcagcgcaagggcgagcctgtcctgcctctccttgatcctcctcagcttgatcctgtctttccacatccgccgggccagatcctcggcctcaatctcctcgtcgctgacatcattctccgtcagattctggatgccctccacctcgaagtccgacgaatcccccaactccgtcgcaatgatagccagatgatccatcacaacaccacaaactagggattttccacaacccgatcacatccaactccactcccccccaacccttttcttgtcagcaatccgcccaccgaaatcctagcgagaattcatacctcccggtgccaatcgggagcgagtcagcaccaatccgaatccgcgaaacaagccctgcaaaaggcgaagaccaatacaggattaacgccaccaaaaaaccaaaaccccatccatccaccccgactcatccaggaacaccgaaacaacgaacagaaatcggaggaatcagcagggcgggcgcgtacttgggcagcagcggatgggattgtgcgcggcgcggcgcgaggcgaatgcgacggcgaaagagagagaagaaatcgctgtgctcccctcctccctcgaatcgaagcgaatcaatctgttcgggggaatggggaattttatttatttttttaattttttttgcccagtggaggtggaaaagattcgcttctcttccgtgtttccctttttttagaaaaaataaaaggggaaagggaaaggaaacacgagggaggctagcgctgaggaggaagggagcaggggtagggaaggaaagaaagaaaggctcgcagatcccatttgctccggtccactctgtgcacagccctgtgttgtctaggactacctccgtctcaaaataagtgcggtcatggaaatctgttttcaacatttgaccgttcgtcttatttgaaaaatttatgaaatttttttaaaaaaatagtcacacataaagtattattcatgttttattatctaatagcaataaaaatagtaatcataaaaaaaattcaaataagacaaacgatcaaacgttggagatgaatagtgtaaaactgcacttattttaggacggagggagtaagttggagttgggaactctcctccaaacatgtaaaacggagctatccattagtaagaattaattatttttttaaaaaaataaatcaatatgatttttaaagaaacttttgtatatttttttatgcaaaatcatgctatttagcaatttggtaagcatgtgtacggaaaacgaggaaagtgagttgggaaagctaattctatataccactttaaatgatgttacacgtaaatgatccagaattactaattttagaaattgtaaagggttacgtacaaaaccttcaaattcaccttctaccaacaaatgaattataagagtctccaatcttgtatgatccgaccgtatgactcgtgaacatagtcggagaggataaaacgaggtgatctagaagcattttttcagtgtggctgcccttggagatgacattatatgcttaatcatctaaccatgctataaacttgttttttttttgcttttgcttttatttctcaaaatatactccctccattccaaattaatctgcatatatatttttttaagttattcctaaatgatctacatatttgcgttcattcattaggactattcgttatttgtacattggagtaaatagatattgatgcatgcatccatgcacacaagcatttataacccacatgcaatatcttgatttgctattggctagaaaatagtggggatggtgtatgcattgagtttgttgctagagtaaatatagtatgagagagttattagcttttcttggtcttggtatacctatgaaatatgcagatagggagtatgttgcaacacacaggttttagctagttttttgaaaaaaaaaatgttggagtgtgtgtcatttcacataaatttcatttatcaagttaatttataatagatgatagctgggttagaatatgtattttttaccaactacttgtcgtaagttacagttaaaatagttaagctgtttagaaagatgcgaagatttgttcgtgattttcaaatatagtggttttctcattgttgttagaatataatatactccctctgtgtcaagataaatcaacttttgtcctaaatctagacattaacgtagagagttaatttatttttttatgggagtatcattttttattacacaaaagacgcacactactcccacatccacgagtgtgtctcctaaaacacgctcaaatttagccgcggccgtagcaccactataacccatttgttgcttcattttgcgtgtaaagggagggttcccaacccttccaaaacaacacagcccgtataactcagccaacccaacagtcacagaaatgtgaaacctcttcctctccacaaaggatcccgatctcaaggggtcagccatgatgcatcaatgttcactggacacccccaagcttgtgtttgtgtacgttccttccttgagtgacttttcctgcttccgtagagccgttttccagcgtcaacccatgctcggaatctcggattctcgctcggctacgaccactccccatcccggagaccgcccgtctcaaccaccccaccctctcatcgattccatcctttctacgccggtggcggcggcggcggcgcgcggcgctgcgaacggtgagcgtcaggcattcgtcgtcttgaccatgaaacttgaaagacctcgtggttgtactctggcagaggcgtcgtcagacgtgtcatcgtcaagtggctataaaaactaacactacttaagtttgaggtcaaatagattcagagccacacgtttcttaaggatcaaggagtttgatttagcaaaacaaaaaataagattaagcaaagttatacaagtaacacaaacttgcagggtatggataagatagtagccctactggtagtattctaggagtactgctggtagcagcttgtttgttcgtgcatggcacctttggtggtttttttttggccatttgctaaggttcactgaaagggcagattcattgaacgtggaccccctcgttaggtgccgaggaagccgtccagattcactgtacccagcagcgggcctctcatgggccttgtccatcaatctgggccgagagccaattcaggccggaacacaacaagagcagtagtagaaaagtaataagttcaggttaggtcccttgaattatcaccgagttcgactttggtcctcgaaccacaataccacgtacaacaacgagggggcagtccctcaacttgcaaaacctgtacccgagattctaaacagtatagtgtccagttttaactaacatgactaggtgggtctcacatgtcaggcatatttctcgtcctctccaacctcctgccattgctaactaaaattataaatctctcctttttagttttagtagagttgttggtattttttggatgtatccatcctaatcaacaagcaggaggtctcttctctgatttaatttgctagcccatcagatatggggtgcttcgcgttcaagagcggcaacaggagcaaaggccaagaacgcgcggacgccggtggcggcggccgcgtcgtcctcgcgcgccgtcaagcgccttaaccagcgcagcctgcaggtcagtatggttttgcatttactcctctcaaaaaattgccatggtgcttttgatttgagctagatttgtcaaaaccataccgaatttgttcatcagaatgatcgaattacaggcgatacttcggcaaaaaatgaacttgcagattttgtcttttgagcctgtgcactgaccacatgtctgcatattttcagagtaccaaaaagaaataggcctaatatgtggggctcactcgtcacataagctaaaaccaagcattatactgtttgggatctcggctacaacagttttataagttgagagacacgttatatctggcattgtgtttgggggatgaaattcgaactcaacaactagataaaggacgtaaagtgaacttattccagtggaaaacgagatgaaacaaagagacgagaatttgttttattttcctccagatcgacgaacaaacaaccgaaacgaattccaattggtaaatcaaatagctcaagcaacaatgagctttatcccctccccctcactcaacaatggcaacggtggtcaagcatgtacagtacatcaattcaccaatcactctgaaactgaaaatcgcacagagagctagcttagcttagctagaaccattagctcactcagtacttcttccgcttgaggaagttggcgatccagtagctggactgcttgtggtagcgcttgagattgttgaggcggtcgatgtagatgaggccgaatcggtcgaggtatccgtcgccccactcgaagcagtccatgaacgtccaggtgaagtagcccttcacgttcaccccgttcttgatggcgtggttgacgaactgcaggtgtttcgagtggaactcgatcctatgcccgtccttgagcgcctccgtgattggcaagctcttgttgttcccctcggcgattcctgcaatcacacatgaaagtcatcttgcaggatgtcgatcccctcgttttttttttcatttccatgttatccaaatagttgtgaaaaagttttggagaaaaaaaatgagaatgtagttcaaatgtatcagcccacaaaacatgcaacttcaagttcaaattaatctatataaagagtgtactacttatctatactcctttaaaagaccctaatgataatggtgagtggtgaatctgccaccacccaccaccactaccatatgggtcccctaaatactgagataggtggacttttatcccttccttggccagaagccatcaaacaaggaaaacttattttaaagtgagatacaaaattatgaaaaacataatgtggaatgatttataatggggataattttattttaatatttgtggttttaaagccgtatattaattcctgttgcaatgcacaagcattcagctagtatatcaaaaagaagttaaagccattacaatgagaaagttatttaattgggaagtgcggcggtataaatcctaatgctcatgaatattatgcatacatgagtacattttcaataggaatttagtggagcttaggataagctattagtccctgtctatttgagcgtatgctagaagtgtgcgtactcgtgggtgagtgtagtgcacgtatttatctcgtgtgtaatgaaaacaaagatggttatttaattaccattttctgtgacgtagatgatcgggttgttgtacctcctcttggtgtagaggagtagctcgcggagacccggagggtagttgaagaagatcggggtgaactcctgccaaaatgttggaagaaattaatcagccgtggattgatggattgatcgatcggtctcaagaaaatcaagaacatgatgttgtgttcatgcgttggtgttgaggaggagtcgatctatgtacgtacctgcggaccaatgggtttgccgttgcggaagccagtggtgttggcgcggatgtcggtgtcgtaggagagcctgtttgagctgggcagcggcacgctcttggcgtagtaggtggtgtagtagttgacgccgatgaagtcataggatcccctcaccgctgccgcctgctccgccgtgaacgccggcagccgcgccccgagccaccccctcatcgtgcctgggtagtcgccgtgcacgatggggtccaggaaccatccgtacatgaagtcgaggctgcgttgcacaacgcggcggtcagcggccgtgtcattatacggcacgaaccagtgcgacaccgccgtgatgccgatctgcccgtgctgcgtgggttggtacttggtgcggtagaggtggacggcggtggcatgggcgaggatgacgtggtgcgctgctaggtaaggctcgcggctggagtcgccgccggcacaggaggtggagacgtagggggagcaccggcccaaggcgtggatgccggtgccgtagccctgggagcagtaggtccatggctcgttgaaggtggcccagaacttgacacggtcgccgaactcccggaagcacacttcggcgaagtccacataatccttgctgaaaatattgacaatccaaatctctaatatgagtatttttttaagataatggtaatggtttacatctccggtgtctttcgacaggcacacagccaaatttgcataatcgacaaattttaatgtgagtcattgatgaattctagccaaatttgcagaaccgacaagcaatttattttgattcagatgaccaaattacctaccctgttctatctaactggtttttcttttgaaacttaggtgaatggcctaactttaatcaacctcatcatcagcttaacaagttgagtgattttaacaggtttatggattttctttgtctctatctaaaaaacttacatgatattctcactcaggaatcctccgtatttgctctcaagggcctgtggtgtgtcccagtggaagattgtgacaaatggcttcatccctgttatgaaaattttgtaattaattcaaagtttactacttaaaaataccaaaaaaatatttataattttgtagtaacagtaacacatgattgtaaataggacataactgaaaaaatttactcacctttggctatgatttcattgatcaggttgttatagaaagctactccttccttgttcacccctccactcaatgttccatctgcattcaacaggcatttacaaaggaaaatttcacggtcaaaaaactgaaatgcaactgaatgcgctgatacgatctaggaaatataatgcccattctcaaatacttcctctgatcataattatttgacgttctggacagccatatactaagttcaagtcatcttaactgtctaaaacgtcaactaattcagtccggagatggtagaattaacttcactcacttggcaggatccggctccaagaaatggaaaaccggaaggcgtccatgttcatgtctttgagaaggtttacatcctcctgcattttcaaggttcaacaaaagaaatgaatgatcagttcaagaagattcctgtccaagataaactttttattcggtccatcaagtcatgaaaacatttattttttgacatacaacaagtcaaagattaaaaccttgagttaatatctttttaaataattagactgacacatggaaatcatatgggtaaaatctcatagtaaaatcaggtttttataatgtgctcacttcggtcaaatttatttgacgttgggagaactgagtttagttcttccaatgtcaaatattttttttactagaggctggagtatactataacaaaaattagtcattaaaattgcattccaaagactgcgattttttggggaaattactgtagaaaaggcttctacagtgtgtaaatatatattccaaagactgcgttaataccgaacaatgtgtttccttgaatgcatttcaagagcaagaactcctgctttacttaaaagaaaaactagaatctaccttgtagcgatgatagaagtcatctgccacatcgccggtgtcaccatttaagatttttcctgcaggcatgaaaatagtttcccttaatcacctattttaaattttacatgccagctatatatataatagtgggaggttaacacttaataataataataacctgggatgtgcgagaaagtgtcccacacgctaggacgctaggacccctacctccttccttagcagctccctcatactgcaagtaattaagcaatgcaaggatacatctctgaatttgttcaggaactaaccaagaaccatgtgcattgcacttgattcaaaccattcttgcagatgtaagagttttggacaaatttatctctgtatggatcacctgatacgctgcagagccggtgccgaagatgaaatccttggggaagctgtacctgttgaacgatgcatcaacaccgctgcagagtacagcaacgaaaacaagaacaggaacaatctgccttcccattccgattccgagccaggccatctcgaaactggaactgatcaagccaagcagcttagctgggcagtggctctgcaggaagcataattcagaagggtatttatagagaagagttggcgatgcagataaacggatcagatcataggccagcagatgtgttggcgttgcttccctgattggcaattctcactattccgagatcgagttcctcaagactttcgagaagagatatcgtattatatttgattttaaccggttgaatttgtcatctacagtagcaagaagacgttgaaattgatttgtttagttcagcatgaggggcacgagagggcaactgctcaaggcttgagacatgtaagtacagtttttttttatatatatagaatgtatatatgatagcggctgatttcgttctcattcttctgaagaggacgcaccacctataatttttagttaaagtattttgtgattggtacgaatggtgtataaatatataatgtacgttgcaataaaaggaatagttgctataacgacttacgcacgacgatcgcctagttgctataactggaaatgtattttcaacaccgcaattaattctcttcacatgtaatggcgtgccgctggttacaactgacctctgtacttgtaaacctcttcaaatggcaatggaaatttagttgggaaacctctcccctctggtctctggtgattattaaaaaaaaatagttgtattgattataatataagtacacactatacttatattataatcaatacaactattcctttttttatatctcacttggatactaataatatacctcctatgtggattaagggagagacatttgatccttacacgtaaggtaatgatataaaaccgacatcacagtcgtcatctatatacaaacatggaaaacactataagatcaagattcattctagataagtcatttaaaggcacgatatttttgataaattttcatgaggtggatttattgcgcgcatgttcgcgctcgaaatcgctaatagacgatcagtcgcgcggggcgtgcgactggacacgtgtcatgcgtgaaaaggggggcgtgggcggcgtgcagtttctttccttttttttttgtttttttcgcacggtttctaggcggcacgcggtttcttttttttttctctttttatacgcgcggtttctttttttttttttcttttcttctttcagtatcgttactttttttttggcgcatggctttttttctgtttttttttctttccgtatttttttgtttttcggtttttttaatacaaacatatacaaattttgtatatgcgtatataaattttgtatacgtatacaaaatttgtatacgtgtatataaacttcgtatatgtgtacttttttatatatagatgtacaaactttgtatatatatacgtatataaagttggtatattttgtatgcatacatatataaactttatatacatcgtatacaaactttgtatatgccatatacatacattatacatgtgtatatacatattagaatatctacttatatatactacttaaaaagtttaagatgtttccttcctctgttaataaattttttttaaaaaagtccgattgtaattaaaaaaagcccggggcgaaaaaaaaagtgcggcaaaaaaaaactgaccgattcctatccttacttaaaaaagcggaacaaaaaggtgcggcaaaaaacgattgtaaaaaggaagcccggcacggccaaaaaaaaaatttgtccgtttcctttttttttccttttccaattttattttattttcaccgcttttttctttcaccgtttttccgggctttttcggccgttttctttttttttcgttttattttctttgcgccgttttttctttcaccgtttttctggtttcgctattttttttctgtttttccattgggccgaatcctagcgccgccaccatatcgatttgcatttttatgtgtttcctcatccaattgattgcaaaaaccgattctccactactctcttatcattttccccttgaatttctcttccagttcgtcattttttttccaagttttacggattgctttgattttggtaaaaaaccaaaaagggaatcgagtggatcaaaatctctcaacaattttggagatcgagaaagattcgaccgcatttgacggagaggatcgactccaccatcgtacagacacggtactatgcgagctcgaccagattaccggatttgatgggtggatcggctccgtcatggtacgggcacgagttgacggagaggatcgaatccaccatcgtacggacacggtactatgcgagctcgaccagattactggatttgatgggtggattggctccgtcatggcacgggcatgagactgttcgagctaggcctacagttgcacttgtgggctaagccgaagagaggtaggccaggcacaggactgttcgagctagggctacagctccacttgtgggctgagccgaagagagataggccgagcatatagatgtagtggactactctaggactagagctgaaaaggaaggaaggaatgaatgtccggtccaaaaacaaagaagcatccggtccaaaaccaagggagtataatgtatcggcttgtttggtaactcaagggaaggggattgggagtttacacgagggaattgatgatgagattaagatgggaatttgatttttaatctcaatatcttgtttggtagaggtgatggaaattgatagggagtttagttggagattagttcattaataaaaacggatggctgagattcgcttagacaaactaaaggaggaattcccttccaattaccttcccctacccaggtattgaaaaggagggagttccttactcaattccccatcccaccaaaattctcatatctcccaaccaaataaaacacttaatagcctcatccctctaaactctcaatccctcataaaaactccttccaactaaacgagccatataggataaaaaaatgtttttacccgtagcaacgcacggatattttttcgtgtgtgtgtctatatatatatatatatatacacacacacatatgtataaactttatatataaagtttaggaaaaagtacgatttaccccccaaactattgcgacagtacgaattatccccccgaaccacaaaaccggttatattacacctcaaaactattgataccggctgaattaccccctgactcaatactgagcggttttgctcctacatggcatacacgtggcgtcgacgtggaaatccaatcagtaaaaaaaaagaaaatatagggcccacctatcattactctcactgtctctccctcttctcctttggacggcgacggccgaggcagcaagcgcacgcggagtcagcagcggcgaggcgaggcaaggcggcggcggtgaagagcggcgggg

SEQ ID NO: 35896 - DNA, 6213 bp, Oryza sativa
cgctcattattgagtcggggggggggggtaattcaaccgatatcaatagattgaggtgtaatataaccggttttgtggttcgggggtaattcgtactgtcgcaatagttcgggaggttcctaaagtttatgcatacgtatgtatatacatgtagtatatgaaagagactataggatcagaaactgaccgcgcggctgatctcacattagggcgcccgttcgcgctcctatagtcagcgtgcaacatgacaaaaattaacctacgtgcggccgaagacacgtgttcagcccatgaagcattatagcccacgtactatcctttcctcgttcagcccacaaccgcatgtgcccaaatatatgcttgcatttggactgttgagtctactagttttcaagctcagtaagcaatgtgttgaaaaaatatataaaacctttatatatgtactccctctatttcataatgtaagtcattctaacatttcctacattaacatcaatatatctagattcattaatattaatataaatatgagaaatgttagaatgatttacattatgaagcagaggaactaaaacttatatgtgaaaatttataaatatatattttgtggggacaaactttatacacaaaaaaagtttaaacatatagaaagggtctacacataaactttacatatatatataaaacatattcaaatttgttttcgcaaataaataaataaaataaaacaaacatgtgggccatctgtcttcatcgtattcccacaccacattagatttggcatgctctcgcaaaggaaagaaattaagatgagctaagcacgaaaagaaaatgcatgcagggaaaaaaaaggtggatgagcgatgccagtcctttagccttgtcgagttccacggtacgacaagaatgtctctctctaaatctaacttagttatagtgtattatagtatcatcgaccttaagttggttatacttaccagccgcttacaccgatcgcttgttctacctgttccgctatacggtacttcctccgtttcacaatataagattttatattattgtctatatttattagatgttaatgaatctagacatatgtatgtgtttagattcattaacatatatatatatatatatagagtactataaagttttacattgtgaaacagagagtacatcctaagtatatctcagtcctagtaatcaactccattcatgtctatatctatctatgtatcatatatacttgaaccaaaatctcaacatacgtttaccacaacaccaaaaaaatcttgatcattggatcatcttggtaaagggctaggagaagatctcagctgatatgaaactgtctttaattctcttctgttcacattcataagtgcatttcatcatcgtaattacgggatgttctttcctgcagcttttaactgaagactatatatattgatgtcctaaatcatgcaaccgaaaaatcagtacttttatcctttttttttgtccctttttcttggggctgtttacggctcgggcgtccgatgatttcaagaaaaatcgggcgctgacgtcagcgtccgatttacgtgcaaaactactttaaactgatttttctcctaaattacttatccaaatcataattcgattgcaccattaaattcattgcaattaaatcttcaaaacaagaccacacatggataaattccgacgaaaaaatagcttattattgaattatttttaaatgttgcatgatgttccaccaggtatatcggaattgtttcactaactagatcgaaatgtttcactcgtttaaattgagtgttgtttcaccttatataaaaataatgtttcaacaaatagcgaaagaatatttcagttcactgcaacattaaatctatacatagtgaaacattgtgagtacattaggtgaaatattttttggtggaacaaaaaataaaccaaattcccttaatagggggtttccaaaatatgtgggttttttgttgcaatggaatgtctcgttcactgcaacattagatctatacatagtgaaacattgtgagtacactaggtgaaacatctttcggtggaacaacaaataaaccaaattcccttgatagagggtttacaaaatatgtggattttttgttacaatagattatttcagttcactgcaacattagatctatacatagtgaaacattataagtacacttggtgaaacatcttttgtgtaacaaagggagggataagtgggtgggtccagatggggagaaaggagcgcgcgcatgggggagggggagcgaccgatttttcccacctcccccggtcgcccgattttaatcaatttccctttttctttagcttgcatatcttttcaaattcacttatgtgcccgctgcaactcacgtggtatcacctactatccaaagcaaactctaaccgaatgaggaatcgaatcaatcctaacctagtcacgacaggaaccaaccaacgtacgtaggctggagtttctcagatctatcaagaacactgtacgttgcgtggcattggtacgataaagcagcgattctaacaacaattgactgttctgcaataatcgattcatgattatactagatcgcaatatcttcctcctgttttgttttcaattatccggcccccagcttgtaagatatcagcagacagcaagttcagcacactgcacaccgacgccgacaccacattagggaatgcaggaacacatgggtttactggcgtgcagcaaactgaaacgcggctcatcgctcaccccttccatcgatctgtcggcgcaaacccacattaaacttacccagttacattgctggggaagagagctttactcccggttagtaatctttcagggaaccggaacatctaatcatggactaaagatgcatagcaagtcagaaaaatctgtgggtgtgggatttaaactcaagatttctcacctcattccttacgcacgttaccatcccacctactacacatatttgactttgatagagatgatttttttaaactaaccttggaaacgtttttagtctagattggtgacaccaattgggactaaaaatatatttagtccgactaaatattaatttttaaactaaccctggagacatcttcagtctgggttggtaacaccaattgggactaaaaatatctttagtttgacaccaaccagaactaaagatcaatatttagtccgtgttaatgcatctttagtccggaatagtaacaccaaccgggattaaagatcattaggggcctgacaaggcctaacagctattgatctgtggctaaaagtgatttttagtcccaattggtattgccattgggcttttgaattggggctaaagatattctttagtacggatccaattagaaccgggacaaatgtggtttttgccatccgagtaaagatcagtttttcattaatgttagttcttccctccatttcatattataagttattttaacttttttaaagctaaattttaggtttatcaaacttataggaaaatctgacatctacaatataatatgaaattagttttattaaaaataattaaatatattttaataatatgtttgtttagtgttagaaatgttgctatatttttctatatatttaattaatttcttttaaaaaaataataattttttcctgaatttttcattgataggtgaaaatatgggagttacagagcctgaggaacggtagcatcgtgcctttacattgatttagagttagtagggctagagaaagcttgtttgcaagcagagatcacaaagcgttccgagttcttaattctttccgcctagatggttgcttcatccatgcagcggcgaagcagtcggtgaaggcacgggggttcattcctgaagacaatatcgtgtcggtgatcagaacaaattcaaagaaacttataatacaaaatagatagtaacacgttatgtactttccccatcccataaaaataaacatgattcatagtacaaactacaaagagtactccactccctccatactcgtaaaggaagtcgtttaggacaatgtttaagtcaaatcttgaaaatataaatcatgaataactctctagttgttgggtttaaaaatatttgttgggtttaaaaatataaaaattatatgaatagatttgtcttgaaaaatactttcataaaacaagaagtcaaaattgtattttgaagactgtgtcgccgtgctaaacgacttcctttatgagtacggagggagtatatcgttatctcgttctcgatttaagcctgtttagttggcaaaagaatttatccctacatgtcacatcagatatacggacacacatttaaagtattaaacgtagtctaataacaaaataaaattacagattccgacaggaaaccgcgagacgaatttattaagcctaattaatctaccattagcaaatgtttactgtagcaccataatatcaaatcatggtgtaattaggcttaaaaaatttgtctcgtaatttcctggcgaattgtgtaattaatctttttttctacatttaatactttatttatgtgtccaaacattcaatgtgacggcgtaaaataatttggtttaagaactaaacagacccttattttttaggcaaaatttgctataggacatccaaaaaaacgtgtaattagccagtggacaccgtaagatcacgaatttactgtagggcaccaccaaaaagtgataattagctagtagacactcaagacattattttattatttttaaaggaaaagaggtgagagaatttttgaattgccgagaatgccctggtggcgcatcacgttatcccgactaggtccggtcgagccgacccggctgcaatacagctgcgcccacgccctccttgccgccggcgcgtcgtgaacaccatcacccgctcctcgtctcagcgcgcggaggtcgtcgctgccggcgtgggagagatcgatgtcgtagcccaagaaccgcgccgacgcccacctcggcatcccggtgctcccgtccatatggccggcctcggaacaggctaccatgctccagttgcacgggccgccgtcactgacgccgaaaccagcgttccagtcagcgaggacgttggccgtgtcatgcggtgctgccttgacggccagcaacgcctccgctgcaaggcgcacgcgaatgcagcaagaaaaaccgggtgagtgcagcaagaagtgaaaattttcatttgcaaatttgaaatatatcaagaaaagattgatatatttggaagaacttttatcatcatgattcaagcaagaaagaatggtatgagctaagaaaccaatcaaagatgaaacaagatgagaagacacggcttgcgatcaaagaatttttttattttctttttttcgtgttcagcaccttcgccggcggcggctggggaagaaagaacctccggcggcgtgggcgccacaccggcagaggacaagtcggacaccacgaggctcaaaaccagcacggcgagcaagtaagcagcagaagcagcaactctctgctcgtccatggcgtcagcgtcggcgtcatgcgtgctctcgttcgtcggtgactcggtgtcgtcgcgtccacgccgagagagcgctatagcccaaagcgaaccgctcgtgcgatgcgaggagaaaaaggagacgagacgctcgcgatcgaacactacccgctactggacgcgacatgaagcggaagcgagagctacaaccgcagtgacgatggcgagacgcggttgacgccatcgcgggctggccacttgtcgcgccgccgctctggccacgccgctcggcaagaccgactgggtctggttcgaccggaccgatcgggataacgtggtgcgccaccgggggcattctcggcaattcaaaaattctctcatctcttttcctctaaaaataataaaataatggtctaagtgtctaccagctaattaccactttttgatggtgccctatagcaaattcgcaatcttacggtgtccaacaagctaattacacgttttttagatgctctgtagtaaattttgcctattttttacgtcactgataaagttggttgtaggtacgcaggaggcaggccgaccaacgccgagggacgtgacccgatcgacggggcccgggggctcacgggcgacgcgcgtgatgccacgcgccgaggcc

SEQ ID NO: 35897 - DNA, 3729 bp, Oryza sativa
  unsure (1)..(3729): unsure at all n locations
cccccccccccccccccccggggcgcccccgcggtctctttccacgcgcgagcatgtcacggcccacgcgccgcgcgcttccttttccccaccacgcggaacacgcggccgggccggcgcgtctcgtcggtctcgatcggtgtccgatggaggtggagcccctgcaggctgcacagcgcgcgcgagaggcgaagcgatcgagcatggacgcggcgcacaacgcctcgccgcctcgcgccgcgtcgcgcgtttccgtatacggtacacgcatgcgcgaggtgcgcgcggcggtgtagttggtgccgtaggcgaaggcgattggcacgggcccggccggtggtgcacttgtcgccgcgcgcgcgagagcgaacaacttgttggcgcgcagagccaaaaccgccggaccggagaacgtctgcaactttccgttggcacacatggcatgcagcaaaggcaagcagcgcggcactcatcggtcatcgctcgtcagtggcttttttttccctcgattgagatatagattttacatcggtttttggtttaacacgtttttttaaatggttaaacggtgtgtttcgtgcaaaaactttttatataaaaattacttagaatatcaaataaatttattttttaagtttataataattaaaaaccaaaattggataagacacatttaaatccaacgaatctagatagacatacttatgatcagattctttgaaataggatgtatgtcctgtgcagtgctagattgctatattttaaaatggatggagtaattaactatggatgtgtttggagtatggatgtgtttggaggagatagttgtggctgcacagcgcaacagctacaaattgtgcagtaaattttatgctacttgtattgttaatacagctggctcagcccaacatctgtaatatacagcacaaacgaacacacctatatgttaaatggttttttctattttacttgctctaaccttattatcttttatcttcgttaggaaaaaaaaaaacatcaccgtagttgtgtgagatatcgagtattctgtttagctagcagagtatatagcatcaattattcaaagatgattggaggagggttcagttgatctcatcaatgacgatattaattaagcctgaaccagcccaacactgctcgacagggagcattattgtttcttcttattattgtccggctcaatgggatcagccagcaatgatgcacaggtactgaggtacacattcaatagtaatgcagcataattcatcacgccatcatatcggtcatcaccactgatgcacaaatcacaaattaaccagctgaaagctagactgacgaaacacaaatctggtggccagccgatcgatctcgtgatcaatccgaaattttgtggggctggatcagtgcctcttgaggaagtcttcgatccagtagctggactccttgcggtagcgcttgagcgtcttgcggtcgacgtagatgaggccgaacctgtcaaggtagccgtcaccccactcaaagcagtccatgaatgtccacgtgaagtagcccttcacgttcaccccattcttgatggcgtggttgacgaactgcaggtgctttgagtggaactcgatcctgtgtccatccttgagcgcctctggcagtgtgctgttgttaccctcatcgatgcctgtacacattgcacacaaattttacgcctttcgatgttcgcgaacgatttagtatatatacatgttaattgagttaattgaggatatggttcttttcgatcaacctatatttaagtttaattttggatgaattttgtaggaccagtgttgaaagattatatgttcttaccgttttctgtaacatagatggtcgggttgttgtatctcctcttggtgtagaggaggagctcacggagacctggagggtagttgaagaagatcggtgtaaattcctagacatgacaaggattcgcgtacgttgaattcctcagtaaaatggatggatcgatgtgggtatatgtgtacacgtagtcacgtacgcacctgtggaccgatgggtttgccattacggaagccggtggtgttggcgcggttgtcgaggtcgtaggatagctcgttggagttaggcggcggtatactcttagcgtagtaggtggtgtagtaattaactccgatgaagtcgtaggagcccttcaccatcgccgactgttcaggcgtgaactctggcagccgattgccgagccaacctctcatggtgcctgggtagtcaccatgcacgatagggtccatgaaccacccatagatgaagtctaggctccgttgcacagcgccacggtcagcgtcggagttgtcgtacggcacgaaccagtgggtgaccaccaccatgccgatctgtcccttctgtgttggctggtacttggtgcggtaaagctggacagcggcagcgtgggagaggtggatgtggtgtgccacgaggtagggctcgcgactggagtcaccgacgccgcatgacttggaaacatatgaagagcatcgtcccggcgcaaacacgcccttgccgtagccgtaggcgctatatgtgaatggctcattaaatgtggtccagtacttgacacggtcgccgaactcgcgaaagcacacctccgcgaagtccacgtattctttcctgcacatgttgagcaagggtgttttaaagtggtattttctaatattaaaatcaattgaaagatagtttatatttttctaatataatgggtcatatctatttataatattatctctaatgatggtataataataatattacctatttataatatcatctcaactattgatatataataataatattttctattagtattagaactaaatgaaaatcaacggttgagatcacttgtattggtggtgataatactgatagtaagaatagtaaaatactatcagtagatactatcatccttgagaatgtatcgtgaggtgctatattttctagcgtaaaatttggtatctcaaggtattttcttaaggaccataaaatttctctaaatagtattgtaaaatcactcgggaattaaaggttttttctcgagagattgcaagaatgtttgtgaaagtacagtaagcaagaaagaacttacactatgtcttcactgaggaatcctccgtatttgctttccagagccaagggggtgtcccagtggaagatagtgacaaatgggatcatccctatgtgatacagaaatgttgtcaaaattagttcatatttttttgcgtttttggaataaaagttagtgatcaccttttgctatgacatcattgatcaagctgttgtagaaagcaaccccttctttgtttattcctccactcaaggatccatctgcagtaattacaatttgcacgcagtggctatgtgattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35898 - DNA, 659 bp, Oryza sativa
tcaaagtactcagctgaagatcgaaagttcatgattggtgtaggaagctgaatcgttcctatctttaacgttgctgccgcttccttctcgttattgtcggcacccgcccatggggtggagtcttgtgggcgttctgattcagatattttcccattcagtatcagtgcagcaggtgttgtagtgttgaacaacttgtagcgcgcgagggtgaggtcgatgcagcgcagcgatttggctccagggatgcggttgtccacgatcaggttcagaaaccgacgagagaggcccatcgtcgattggattgggattggatataatggtcagcttcaaaacagaaacaacaattaatctcgtcggtctccgtccccccccaaaaaaaaaaaaaaaagctatgctatgcacctggagaagtaaacgacattcaaggaaggaagagtaccgcaatagcagcagaagccggcgattctactcgatcccaagtcgactgaactctcctcctttgtctttccttgcgatcgattcagctaacagccgcccggcagcgatgcctttaaagacggaaggaagggatggcttcacaaaagccaaacaaacaagagaagaataacaaacaaaggcgatgagaaataggataataaattagcttttgatcaatgaaa

SEQ ID NO: 35899 - DNA, 73 bp, Oryza sativa
ttggttttaattagtcaattgaaagctattctaaaactctagatttgcaataattgtaatgataattgtaatg

SEQ ID NO: 35900 - DNA, 591 bp, Oryza sativa
  unsure (1)..(591): unsure at all n locations
tgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacaggnngggtcggggcacccnttncgggggggcccccccccccccttttttttcccgggtcggggcaggagcaacccgaccccccctcggggaaatcaggaggaggacggacacctcaccctcgggcccgacgtccccgaaggtgccaggccacgtgggcgattccatctgcctcaagcctccgggcgcaatactcccggtcccatatcaccgaca

SEQ ID NO: 35901 - DNA, 547 bp, Oryza sativa
catcccagctgaggcctgtttggctgtttgtgtttcgatgtggaataggccccaaacccgtccttccgtggaatgcagcccacgcctggatcaattcccacatccagcccaaatatgcatttagctgttcgtgtattgctgtgtattgcggctcgatccatgccgacccacgggtgagagaataatcctcacccgaggcctggaactctctcgcgtgcacgccgcagctcgcgactcctcctgcaccgccgccgctttctccaagccgtccaccgcctcctcgccgtcctgctgggccaccggcgccgccgccttctccgagctgtccaccacgtcctcgccatcctcctgtgccgccggcgccactaccttctccgagccatccaaccgcctcctttttttctcattcggccgtcgtcgttgtcgcctcatcgccggcgtcgccccggcagcctactcgcttgatcaaggttcaaagtcctctcctccttctcctccttcatctcatctcattttctttcccatcttctttcatccacttgttttg

SEQ ID NO: 35902 - DNA, 291 bp, Oryza sativa
cccgggtcgctggccccgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagcccgggtccctggcctggtaactcgctaacacgagttccaccgctccttgggcgaggtccctcgaggatgacttgatggtcttctcgagctcc

SEQ ID NO: 35903 - DNA, 741 bp, Oryza sativa
gctgccctcgacactacacggagcggcgttgcctcagccagcacaagtactcaagtctcgtatggctcgtggggtgcatcagctgctcgttcgttgggacggtctgccggcatctgcaacgtcgtgggaagacttggacgatttccgtactcgctatcccgcattccagctcgcggacgagctatttgtcgaggaggggagagatgttatgtggggcattcagtatcagcgccggaaccgacgccaacagccagagcaggcgccgtgaggttggattaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggcgaggcgtgcgccctcgccctcccgtcgagcacagctacgcgctacgccatttagggccagcgcctaacaccttggtcagatacattcacaaaagcgctaaaaccatgtttcagtggcacagcaatcttgaggtttctcctcactccaacatttatcctcccggtttctgaattaggaaaaaaaaaggttagttcatgtcaattgtagatccaatattaaaaaaaagggttggacaccaaggaagaacttggtgtcaatggttttaagaaaggagaggtaaatattt

SEQ ID NO: 35904 - DNA, 1129 bp, Oryza sativa
ccaacctcccgggtcagatcattacttttcggctcccagagccatttcacttgattaggcggctcccagagcctttttcatttttgcggactcccagagtccaaaagaaaagcagcaaagcaatccgcttccactcgggaagcctagtctatgatgctcgtagacattccgaatcacacaaattcgtttctgaccactcaggtcatccatctgccacataggctgaatctggttacgattcccacaccacaacaacttttcacaaagcactggcaaacaaatctacgcaaaaaaaacccccggggggggggggaaaaaaaaaaaaccaccctcaacatcccgcccttgactgtgggcacggctgttcgaacagttagttaacctctgcagaggggtacactttacccacaagacacgaacttactccagacactggctggtgtcggaggttcgtgacaaggcctttccaaagccaatcctgggtcacctcatgccacatagagggtctccctgaccaagatcgggccaactccggctttcccttaggactcccgggtgccttcctctgtttcggactcccaggatgcctctacccccacatcccggctttccacctctattggcatacaagatttcccaaaagcaactaattacttagccagggtgtcccataccaccatgtggttgcacttgttatgcttgatgaatttcccacaggaatcggtccttatatgcgaatacgggatgacgccacataggcacaacacccgcatcgcgagttttcacaattcattttattttcaaacacaccgacaccacatgtcgggttttcaaggcttctcaaacccattttccaagttttcgacaatcaacggtgtatgtgggatatttggtatacgcgcttagagagcacggataccgaggtaccacaagggtggagcgacaaggaatcagggtagtacagcctacaggaattagtgcgactactgggtaggtccgtcggtttggcacgcaaaccgaggccaagcaagttaagtgtgtgattctaataatgcaagttgcaaacaaaataataatgattttccaattataggagcaattgatcaaagggtgacttgccttgctcaag

SEQ ID NO: 35905 - DNA, 845 bp, Oryza sativa
ttgggcgtggccagcaacgaccaagaaattataaggagttgttcaatcataggcatgccatattgcggagtcacataaagagagcaattggtgttcttaagaaacggttccctattttaaaagttggaacgcatcattctattgaaaaccaagtgaagattccagttgcccagtggtgttctacaatcttatacggatgcttaatggggatgagggttggttcaatccccaaggaagcaacatatctccagaacagtttattgatgtccctgaaggtgacgacgaatatagtaatgatgtgatgtcccttaacagtcaagtagatgatggaaacacggttagagatatgatagccctaaatatgtggaatgactacagtcataacttgtcttaataaatgtgagtcttaactggtctcatgaaatattttgcttttgtatttgcatcatgatgtttttgcatgcttaaatttgataacggtttttttttattcgcagcaacaatatttggaagagggtccccaaagttcaatttaatccaagctgcagctgtccaaagaaagccatctccaaagatttcaagacatcaaaagaaaaaggcatcgccaaaaggtatgggctttttcttgtcatgttaaatgcacatatgggcttctcaagttcagtaggttgatagattaaaaacatgtaattatctgtagcttatgtgtggttctctattccaactgtacttgatcgttcaagagctagttggaatgcaggacttgaaaaagctttggttgacctactacatgatcacaacaacgactgctataggagtcagaatgggtggtccacagaagcatg

SEQ ID NO: 35906 - DNA, 691 bp, Oryza sativa
tattacattttttttaaaaaaaaatccatgctattaggcaattagagccgacgggaacccaaaattaaaccatgaaattggcttggagttgagccagaggatgagaggagtgctgctgctggactaaggtataagctttattcaagtttcaaagcacatgaattcatctctgtctcgggataggcgctacgactcgttcaagacgtggtccgggaagcttgagcggcaactcacccatctggctagcgccggggacggaggtccctgaggaggaggaggacggttgcgacggcgatgccatccgcagccaccacatcaagtccatgcctcaggttgatcgcttcttcgccgcactggagggccctaaactggacaaactccgggtaagtttcttgagctaattcttccggaactacacatcgatctatgtgctttgatttgctggaacactggagagagctcatggtgtgtgttgtgtcgcatcagtcatcggaggagctggtgcttctgtcggacaaaacgtggccattcctgctctgttcccggtgtcggcgttcggtatctgcctcggcatgagcagccaggagatcctgtggaagacagtggcgacgtcaacgccgatgagattccttcacatcactaccaaggtgaaccaggtgctctggtgcgctttctgtcgcgctcatgtgcg

SEQ ID NO: 35907 - DNA, 598 bp, Oryza sativa
tgcaaaaaaaaccttaccaaattttggtaatgccaaattttggcaattatgccaaaattttgataagatttcttatatatttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcatcgacggggccggccgtcgccgtcgccgccgcggtggttctggacttctggtggtcttgacgtggctgtggacggcgctggtgcagctggtgtggaggccgtacgccgtggcgagggcgttcggcggcaggggatccgcgggccggcgtaccggctcttcgtcggcagcgacgccgaggcgaacgcgatgcgcgcggcgacgtgctcgacctgcgctgccacgacatcgtcccgcgcgtgctgccgcactaccgcgcgtggatgtggcgctacggcaaggtgttcgtctcgtggagcggcgccacgcccgcgctctgcgtcggcgactaagccatggtga

SEQ ID NO: 35908 - DNA, 1598 bp, Oryza sativa
  unsure (1)..(1598): unsure at all n locations
tgcggcctctcgccggtcagattctcgcctccgttcctctgcggccgccggatcttcggctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccccggggccccccttattttcctttttcctttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggnncgcaaatcnccggaaaccccgggaaaacacccgggggggggaggtagtcgccgtacaccatggccccggtgagcccctgggatcgcaggcccgcgaggcggtcgaggacggcgtcatagccatcccccagatctaccggcgcccgccagctggggcctgcaccgggggctggctcggaagtcggagatgcgcttcgtcggcgaggggggtgtagaaccagtcgctcttccagtcatcccactttttgcggaggaccaggggatgtagcggttcaacaccggcccccgccgcaggaaatagcagccgccgaccaccgacggcggcgacaccgactgcacggtgaagaaccaccggaacagccgaagaaaaatatttttgggggggggnggggcccngncccaccccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcag

SEQ ID NO: 35909 - DNA, 842 bp, Oryza sativa
acatgttgccagcccgtgcttcccgcctctttgcaagggcaaaagcactcggtatgatgactaaagggtatgtctggattgtcacagatagcattggtattgtccttgatgtgcttccccaacattccattgaaagcatggagggaattgttggtttccggccatatattgcagaatctacaaggatcactgatttcagctctcgatttaccaccttattcagaactaagtaccatccaaatactgatattaggatggcaaaaatactgatctaccccaaaacccactatctttcaattatgggcttatgatgtggcatgggcagtcgcaacagcaactgagaaggttcataggaccagatctttgaacccaacttttcatcctccgggaaacataggcaagaacttagtagatgatctcccagcattgcctgctggtccagaactcctcaattccattttgcaaggagagtttgatggattggctggacaattcaggcttatcgatagacatctgcaggttcccacatatgagattgtcaatgttattggagagaaaactagagttatcgggttttatagtcctgattctggactcacaatgtctgtgaactctagaattatccatggtgatgctaaatttagcacaagttcttctgatctggaaaatatcgtttggcctggagattcaacaacagtgcccaaaggctgggacttcccagtgaatgctaagatactccagattggtgtgccagtgagacgtgattttaaacttttgtgaatgttgagactaatccgaacacgaatagatcaactgtcagtggctacagcattgatatgttt

SEQ ID NO: 35910 - DNA, 609 bp, Oryza sativa
tgacatggtgagcactcaaaaagaataaaatcaacatcacatcacaaacaagaaataagacactcatagcataaatgaagtgcaatatatataaggagcagctaagagcatctaacagtcattacatccacacaactagagaaatattacatgtccacaagtccataagagtagaggccaaaggactgccaggtccggaacttccggataaaatacccggaacttccggacaagctgacaggaatatagagcgagggagctgccaggtccggaacttccggataaaagaaaggggaaaattttccccccccccggggaacttccggataaacagacagagcaggcagcaaacaacaaaaacaaaattttgaccctcttcgattgcaattttctccccctttggcatcaaggcaccaaaaagagacaaaatacaagggaagaagaggatcaagcctcatcaccatctccatcagaaggaatgatctcggtgtcgccggagtgaggtgagtcaatgtcttgcccggcggcgtccactgcctcatctggatctgtaggcacattctctgtaggtgcatcggactctgggtcagggatatcatcaccaccatc

SEQ ID NO: 35911 - DNA, 2137 bp, Oryza sativa
  unsure (1)..(2137): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacctaagttcccgtgacttgctgagtacgaaagtactcacccttgctctataaatatatatatatagttcctccgccctgaagagatggtgaagtgaagtgaagaattggggtttcgccctggttcccagccgtcgcctgtggtgttgggtgttagaccgttggttccgctgctgttgttgttggtgttcgcctcgtccgtgtcgtcggttgtattctcgggctgtctgagctgcaacctaagttaaggtaaataagtcctctatttattttaaggattgttatgattcatatttgtcaccgtgggtaccagcactatgtcctgggactggtaccgagatcgcggtttcgtaggaagcggttcgcgccgctttccctacgacacgctcctgtcaggtgccgttgtacggcggtatcagattggggtgtgacatgatctcgagagctgtcaccacctctacacctacctcaaacgtactgtgggatacgcagcaattactggataataattacctaaacaccacgtctaaggaatttctatctacttttgtgtttataactcaccaaagtaatcactatattttagttgattatagtgaacaataatcctgtatgttatttaggaactaactaagagataattctcacaagataaatctaaattactcaagaaaaatattatattgaattcagagtaataaacagaataaaagaaataggacaagattaccggcaactccggaattcttccgacctcttctactctactctcttcctattctagtagacaatattgtacaatagagcctcttataattcggctcaaacttggaagtgtgtgtgagagtgaatgaagtgaggtccttttatagggcagttatgacggttgtgagaaggggaaatgtccgaactgccccgcaaccgtcattgggagaacatctggaacgtccacgccaaaccctaggatcaacggcgatcagggggttcggccgaacctgggctgggccctcctggcctctatccatttctcggagttttgggttgattcactgatgttttgattaagttcacaactcatccttgtagggatacataattttcctcactttagtctagatttcctcccaacatcggggtttatcacctgcatacaaatatacaccaacacttgtggaatatgtgagattaagcaactattaatatgttggatgttttattatttgaactttatgtaaatgttggcggtatagaattgacatttaacagccgccaacaacctcagagttctttggaaatcggtttccaaaaaaagttgcaacttgttgatatgagtattctattaattctattagaccctggaccgggatgtcacatcaggttaatgacaataatgttagcataacatccaaacaaccccttaagagcaaggataataatgcagccagctacttacttatagcctatctatcacctcactcatatagtggttaactcttcactataaatatatggtccacatgtctgtctcacagattttcttggttcctgtgtctaagccggctgtaaacttacagcccgcttctcatctctctcctcttttctcctatccacctcagcattcagccttcttatagcccactattatacttgctctaagttgcttaaggcaaaggacggctttgattcgtcggcagtggatcagcttgccgcggtcctccattggcccaatctactccaggtgcacttgctttttctcgattttttttatttatagtaattattagtgacgtacttgaattaaataattagtaaatctttcttcgaatttgtaaaaataatgaactctgttgccaataacgttcagatttggacgcactttcgaagagcgtccaagaaaggacgctgttccggacgaggttctgactgatgcgcctcgactcctctccaacacaatgagtgaaacaggaaaagaaaagaatcaatcttgcgtgagcgtcgttctccggctgtctcagccatcatttgccgaggcacatga

SEQ ID NO: 35912 - DNA, 3715 bp, Oryza sativa
ttttaatctttcgcacacctctttacaaatatagaattgaaagtttttaattttgacttgaaagttttcaaattttgagttgaaagaatctttcaactcaaaatttgaaaactttcgaccggaatttgaaagatttgaaaactttcaacttgaatttgaaaactttctacctgaatttgaaaactttcgaccagaatttgaaaactttcgacctgaaatttgaaaacttttagctcaaaacttaaaaaactttcaactcaaatatgaaaacttccaaacttgaatttgaaagctttcaaatcaaatttcaaaaccgtcaccttgaaattttaactttcaaaatattttttaaaaaaactttcaactcaacttttgaaaatttcatcatatttctgaaacttttcaacttaactatttgtatattattttgatataataaaatctataattaaattaatctacacgcttagcactattattagtgctaatgactagtgggcccacgcgcttaacctcccatgcaagaagtggaaccgaaaatacagaaaacggaaaaaaaaaaggaacacgaggcgctacggactcggagtgcgcgcgagttgctaatctggcgcgtctgcgcggattagcaatctcgggggagagggctgcttctctctcggtttgcacgtgtgctgcacgtgaggaatgggagggccgagtgaagaggatgggccgagcaagagagaaacggcccaacgaccaagagggacgcaaaatagacttttccaaaagatttgatttggaggtattggattcggatttggatttagaattgaattcaaatgtgatgttcgaactcacggacggagaggtaaaggaaaggatccaaggagaaagtcatcattcaaaaacggaacgatgggagatgacgatagagcaatagatagatggatggatagggcgatagataggtcgatcgatagacatggatggatttaaggtagggatttaatattttcttgtaatcggggacaagtatttggcgaggattcaaaggaatagattgaatgtcggagttgtctttggaatgggaatttcgaggagacaatttttgatttcgacgagagggatcaaggagatttaaactgagatccacgacatgacttagactcgcccacaaagaatgaaaattttcgcaattaggattttattaattaggttttttaacgtctcgcgaaaaatgaggcgttacacttttcaaactggtattaatccattaacactaactgtggacccatagaatttactaggaataaattgggcctaacccatttagttctaacaataatccccacctaatttcagagctcacagaaatgttctcagtatttcggcgtagactgtgaagttgaactttcacctagaaaaaggagttacacctgaccacaactgaacaatggactattccttgaattgtcggtcttgtgcagttaggctttactcaatttcttaattgatactagactgtcattagcatctcctttgtgtggtgtgtataagttgtactccaggccttttcatgagtatctagagatcacctaaatctcatagactttggctagcagtcggactcatataggtgtgttccttctaagatgttctgtaggctaacatatcttgtttaagaaaagccactcaggtcacataagggaatgcaccaacccaccatacaaataaggagataagtacatcatagaaatgagctttgggtctctcctcctagctaccaaatagcttgtttcaccatcctaattcacaggatctctaatcataaaggacggattatcactattgtgtaactcaagtggatccaagcccatctcactcgatgcactgtctatcacattacgcgatagacccttagtgaactgatttgccagatttttagtagtctgaacatagtacaatgctatcactccggagtttttcagcttcctgacagactatattagtattctctttatatgtctggatgacttcatgttgtccttctattaacgccaaaatatggtatgtttttttactgcattcaggtaagggaaagagcgaaagggcctgtagcctagtggttacaagagcctcagtagcacccgaggtcctgggttcgactccccatgggagcgaattttccaggatttaatggcgttgtgctttcagtggtagacgacgtacccgtcgacagcgaggcgcctgtggtgacttcgtcaatctctccaggatttgccggcccagtcttcgaagatgctcataggggtgagtgcacgtgcgttgtgagtgtctgtgttgtactgtgtaattctcaaaaaaaaatgtaaggaaagaagtcgatcaactaatgtaaacctatgcagaagagaccaatctccggaaggaatcgtgaagatcatagtgtggcaatttaattctacctattaattggacataatttagtaattttctgttatcttcaaaaagttttgtttagtgtctgatcttgacttatatcttttatttttatctttagaaaacttatattgtgtccgatcaagactagtatcaacccggaggtataaatatgtacaaccaaagttgttttaatcaatcttcataaatcaatacaattattttcaacgcatcaccaccctttttatcccggcgagttcttagttaatttcgaggggggatacatcggttaagttcgatctccgacgagaagtgagctccgtcatcttcgctttcattggcgttgctaggactttctcggttaggtccgatgctctattcgggctaaagcaagcgttgcctatcttatatgtcgtctctaattttttatgcattgttgcttaaagttacatactcacatcagattagtttggactttattggttcagtccgatattctaatcaagttaatgacttttattataaatttgttatatccatctctttaaatataacattttttttaaaaaaagtgggcaaaagctttgcctcgtatatattgatagagaagaggtactaatatatataataatataatatctttttttaaagaacccaacaaagctggttttatattatagaaggaagagaataaccatacaggagcaggaatgacattcctagaacaaaaatgtctcccacaagtaactactccctccgtcccataataatataagaagttttaaagttggacacggttattaaaaaattaggtaaaagtgaatggtggaggattgtgattggatgagcagtagaggtaggtgggaaaagtgaatggtggagggttgtgattggttgagaagagaatgttagtggagaagttgttatattttgggacaaatcctaagaactaaaagttgttatattttgggatgaagggagtagaaattaaaacaagcctattctcgcgacattatacactgcactcccttagcacccgccaactcccacaattggagttcatccataatcttgcttgtaagtaccggtggtgtagattcgatgttcctgaagatgcgattgtttctttctatccaaaccacccaaagcgtggtcggtgccaccaattgagtagggtgtcatcattgctcgtgttcaagaatcgatttggtctgatctggtggcctatctcctgccaaaccctctgtatgaagaggcactcctttgtatgaagaggcactccttgaagagg

SEQ ID NO: 35913 - DNA, 18584 bp, Oryza sativa
ctcccaaaactgtgaactctacaccatctcccctatcgtggaggtggcgcagttctttgccgcgaccactactccgcctccacccgtcggtttcactacttcctcccactatattctgccaccctccctcctcctttcctcaacgctcctcctctactgtcgctcctaccccccactccactccccactactcgagccgccttctctctcttccgctgtcgatgccaaagcgatctcctccccatccttccacctccatcctcccacgtcaagggtgacctgctcctcatccctaccctcccacttagcccttgatgccgtcttcaccccgcgctagcccttcagcggctacgagctagggccccacgatgctggccgccatcgtttgccgcctagcaagagagagggggaagggagaggggcaaaagtatatgagatttttatgacatgtggatcccacccgctgacttagctagtcaaccatggtcaatatgctacatgagcaaaaaaacaccttccaaaccaccaaagaagctgatttgcaccggtttttaaagatgggggagtcattttacccggttttgtgattgagggaagtgattcaatcaacaaccagagatgagaaaggcaaaatagacttactcctatggaaaatttatttgacgcatctatgcctctgctccaggcctttccatggccctgcagacttgtaggcccaacatatatggaacattttaaagttttttttcctattacgtgtttataatagttcaaattttgagccgaaaagtttctaatttgggttagtgtttttaaaatttcaatttgaaagttctaaattttaagttaaaagtttcaaaatttatgttaaaagtattgaatttttaaataatgaaacaaagaagttctattacaaaattttactcgaattgaaaaagtattaaaaatgacttaaaaattgtgaacccatacccattcatcggttttcctttagattcgttacaatgcatgggcatgtgactagtagtgtatataacacactaaaatggtacttaaacttaattaattaaacttgtaatgttgtgtcatctatatttatagcagtatataggagtactctttaagaaaaaacaacacagagaaaaaaaaagttctccatgaatttaatgccaacatatcacactgaacaaataaaataaaataaaataattcaagtcttcacattttaaaaaataattcaagtctcactcgatcagagtagactagcacataatcagctgccgccctcatgacgtaacgagatatatctgaacacccggattattacccccgcgagatcattcatcaaattcaaatccggactcatgtcgtccctacccagatggcccggtcagcgacgccgctttaccgagagaagccgcgacacctgacaacccagcttggtacggcgcaccgaaggcggcgtacatgatcgccacggcggcgacggccatcaccgtcgccacgaacagcaccgccggccgcttcccccgctgccccatgatccccagcgcgaacgggtagaggagcgccaggatccacacgttgaacaccatcccgagcaccgcgaaccgcccctgctcggtgagcaacccccacgccgctgccttgccgaccgccaccccgacggcgccgacgttcacggccaggacgacgatggtcgggatcagcagaggcacccaccgcacggtgtacaggtcggcgaacttgtcgccggagctggccgtcgtctgcttcgacgtgagcctgaagtggatgcccttcccggtgaagagcttgagcgccatgtacagcaccgccgtcgggtacacccccgtggagccgatcatgtagaactgctcgttgcggcaccagtccagcaccgtgatgccagaccacttcacctcgaacatgccgatcacgtggatcatggcgatgatggcgacgaggtagaggaggtactcgccgaatggctgctggatgtagtactgctcggagatgagccacatcaccgggaagaggttgtagaagaagatgaacacggtgacgatcgggtaggtcgacatgttgaggtaggcgatgcgctgcagcgggtggaggcggcggccggcgaggagcgcgttgctgtgggagaagaacatctcgagcgagccgcccgaccaccttaggatctggtagaggcgctcggtgaggttgatcggcgccgtgccgcggaacgcggcgggctccatggaggtgtacacggagcgccatccctgctggtgcatgcggaacccggtcgccacgtcctccgtcgcgatgtcgtacacccacccggcgtctctcccccacgacgtcccgaggtcgtagccgcacgccgtcacggcggcgaggtcacgggcgaccgacccgtcgatcgccacgggcggcgtgatcgaccgttcttggttggcgccgtccagcatcgagctgactagcgtcgacgaggcgccgaacttgttggcattgtccatggccttgatctggctccccgccgccccccaccgcggcggctccaggccgtagagcgcggcgcggcggaacatggtgccggtgccgaggtaggaggggccctggaggccgttgagggagagcgtggtgccgtcgaagaagacgcggttgtggttcgcgtaccggtccgtcgggtcgacgtcgtcgaaccgctgcgggaactggacgaacgccacgtcgtcgccgccgccgcgccggtcgagcatgaagcacatcggcgcacggaacgcctgcgagttgttgacgtagtggtcgcagtcgaagttgatgatgaagggcgcgttcgacagcagcgcggacacgcggagcagcgcgttcatggcgccggccttcttctggtggttgtacccggggcgcttctcgcgcgagatgtacaccagcatggggagccgcacgtccacgccgctgaagtccaacgggttgtcaacactcgccgccactccaaaccgtggcttactggtgggatggttcagtaaaacctgtcaaaaacacaaagaaaaccactcactttggggaaagtctattatattctcggagggaatgtctaggttgtgcatgttgcctcaaagttaaaaaaaattatatttatactgcattaaaagatattagtgatggtgtctaaaatctattatatctataaagtaatagaaaaagaagcctccacgttcgctctcacggtctagaaattctcacattaattaaaaaataagaaaaaaggaaaaatagaactaagattaggattaggattagttaaaaactaaagaaaggcaaaaaaaactaaaaaaaactaagatacttgaatcggacaacagtcaaaaactaaaaaaaggaaaacggaatcatactaatatgctttcgtaggatacaggaaacggacaaggtttctttcgatttagaaaacgtatcagacactaattttgaaaaccgtgtgagacactaataaaagacagactaaaaaaaaatcatcgtcagattcatgcaatctgaattgtacacaaattacatgccatggtaatatataaatagtacgctagaaatcttctctccacaatccaccgcaacaaaaaaaaaggaaaaaaagattaagtacaaaatagtgatgaaactctgtacgaatccgacttttagcgatgaaaaaaattgtgagataaaagcaagtgtttcaggaaaatagcaactaactgatgctctaaaataccatagagctgaaacgatatcaaaacaagaaggcaaactcaatctattatcttaataaagaaatagaaataaaaaaggagccaccactctcatagactaaaaattttcacatgaattagagagaaataaaaattctaatatatgaaaaaagagcctagatggaaagtaatagaaaaagaagctaccatgtttgctctcacggcttagaaattcccacgttaatcgaagaaaaataaaaagtagagtccatataggaatactatttaaaaatagctgaaattcagaattaaaaataaggaatattgaaagagtagacaagagtccatacaagcctacaatttagaattaattaaaattcggaactaaaaaaaatagaaaaactaaaattagaagttagagtccatatagaaatacaatttagaaataactaaaattcaaaattaaaaaaattaagattgggagaaggtcatagtccgtatatgaatacaatttataaataactgaaattcaaaattaacaaataaggaatactggaaaaaaaaagtccagcgtccatataggaatacaatttagaaataactaaaattaaaaaaataaatattgaaaaaagaactctagagtcaatataggaatacactttaccaacaattgaaattcaaaattaaaaaactaaaaaatattgaaagaagagtttagagttcatatagaaatataatttataaataactaaaatttagagttaagaaaaaataatattggaagagtagtctagaatccatataggaatagaatttataaacaaaggaaattcgaaagtagagtccatataggaatacaatttaaaaatagctgaaatttggaattaaaaataatgaatattgaaagagtatactagagtccatacaagcatacaatttagaattaattaaaattcggaattaaaaaataggaaaactaaaattagaagttagagtccatatagaaatacaatttagaattaataaaattcaaaattaaaaaaagtaagattgggagaagtgtcatagtctatatatgaatacaatttataaataactgaaattcaaaattaacaaataagaaatcttgaaaaaaaagtccagcatctatataggaatacaatttagaaataactaaaattaaaaaaatattgagaaaagaagtctagagtcaatataggaatacggtttactaataattgaaattcaaaataaaaaaaatattgaaagaagagtttagagttcatatagaaatacaatttataaataactaaaattcagagctaagaaaaaatgaatattggaagagtagtccagaatccatataggaatataatttatgaacaaagaaaattcaaaatttaaaataaggaatgttaaaatatgattcttgagtccatatagaaatataatttataaataactatcacatatatacaatacaataaaaatatcacacatttgttagttcaaccaagaatttaaaattatgttgtcaataataaaatatgaaaatatttaaactattgtatgagaaaaaaaatctaacaatgctagccgtgcaatctgcgcgggccgccatgctagttgtcgttaatgttacaagctgccatgtgaccataaggtccacacgtaaatattatttttagatattgcattatattctaatccattaactatgctataaacttgtatttttttttgtgttttcttttatctcttacagtatttgttgcaatgtaggggccttagctagttttttttaagtaagtagatcaatatgggatatgatattttacatacttgcaagtttaaactgaacttatataagaaaaaacaaaaataacaaaatatattgattctaaatagaacgtgcaatttttagtcaaatctattacttttatttcttattgtatagactaaatttgaactggtgtgtttgtggaataatatgtcacatattgatctatcttatttatttttctaaaaaaaaagtttaatgtttttttaaatgatatgcactaaacgagacgagggacacgtccctctatgaacaatagtccatctccactcgacaaaatttgtcgtcagaacaagattataagggcaacctcaatgttgggttgctgaatgagcagatagctttagctatatctatctctacaatggttatggccttggatgagaaacaagccgggtcccactgggtcccatcaaagaagaaacataccaccaattcgcaatcatatgctgataggctccattagatatcattttttaatctcttaagttcaactgtaaggttagagctgtttttaagcatttaatgtcttatgtccatgtccacaatgtatatagctgaaaaaaagtcttaaggctcactcttatggtcacattgtggatgccctaaacagaaactaaaatgcaataactctgtctttagatattggaaaaggaataaattctcgcttcatgcgtacgttacgtacctgaacaatcccagcgtgttgccctttccggtgattctccgccggctcaaaccatgtgccgggccaatgcgtcccatcagccatccatgtcgcgttttcaccgtcatctttgccatccttcgctctgttgtacgcgtcagatcgcttgcgaatggtgctgaacagcgagtcgatcctgaccttgaactcctcgtactctcgccgcacgcggcggcgatcgctcatcagctcgccggcgacgccgcccctgtacgcctgcgtcttcatcgcgaagtagctctccggcgccctcggctcgacgcagtgcttccggcagaagggcacccacagctcagcgaacttggcgacctccaccatggcctcgtagtggaccagcgtcccgccgtcgtcggacaggtagcaggcgtacctgtccaccgggtagtcggcggcgaggatggagaggatggagttcacggtgtagaggatcggctcgtcgacggggtcgacggtggtgacgaagacgtcgacgccggggagctcgccgccgccggaggtgccgtgctgctgccggtcggcgagggcggcgaggtccgcgacgcgcttgatggggttcagcttcgggagctggttgagcgcccacgagaagccgaaccagacgtcgccggccatggacattgtccacagccacgcgccgtcgcggttcttgtggcgtacgcgccacgcgaagaaggcgacgatggcgatcagtcgaactaggatcaagaacctgttcgtatattagagaacagcataagggcaaccaaaatgaatgctgtaaattaatcacactttattgattcgcaattaatttgtctaagtttgattataagtttataagagtagttagtagtatttgacatcagtgtgggcccaggcggtcagacctgtaaggatgcaggatgctgcccttgaccttgtacgtccggaacagcgtcggccgaacgccatcgccgccgctgggccccgacacgtccgcctcgtcgacggccacccacacgtcatccttgccgccgccgtcgttcacccgcttggccgccggcgagcacggtgccgccgccgccgccacgtagacgccggccgcgccattgccgttggtgacctcgacgcggaggccgcccgcgttgatccggcgagtcacggccgccgcggacatcgtggaggccgtagccaactccatgcacgcaaacgcacctagctaactacgtaagctccgtggcgaactggtgaacacatcgtggtggcttatatagcgcggcgaaacgacatgagtttaattaaatcatcgtctcaccctgcctggtcaaaatactgctgctacctacgtggtacaagagaagccgccactgtcacagtgcagcaagctgatgagcatttttcctctctgcagcgtatgtaattttcgttcctctctttcgatcaaactcggcaacgatcgtcgtgttggcgatcaaaaaccaccggcacaaggtcaccagtcgggcgcagaaactacagattctcggttctcctctagcagccaagtcagctgatcgtgtgacatcttcagaaacaaggaaaaataaaacgtgtacatctgcaccagcaacagtagagacctactccatctaatttatattacaagacatttttagttttctttaatttgattatattgtggaataaacgtagtagcaacatctataacatctttcattaaatctaacattaaatatattttgatacatttttataaaaaaaatacttcaacatttttctataaactctgctttgacttaaaaaaaatcaaaacattttataatacaataaggaaggagtacctaacaaaataaattaatatgcaatatatcattctctacaaacatataagttcaaatttaaattcaacatgttataacaaattaaactctaagtaatatatttgtagtcaaatttgtctctttttttttacaatttatactagttgaatttaaatttaatatatgcttgttgaatgcttcctccgttcaaaaactattagagatttagatggatgtggcagtacatcctagtagtacgaatctgaccactcaaaatataagagatttaggatggacggggtacattctaatatttcgaattcggacaggaacctggccagattccaaagtcgtaatgctagaatgtgtctcatccatcctaaatctcttatattttaggtgaccagattcgtactattaagatgtgtcacatccattcaaaatccattatatcttgagatagagaaaggaatatatttcatataaatcattcttgtcgttctttttttaaaaaagttataatcaccttagtttatgtgtaataaacgagtgatcattcacttgatgattaactcaggtgattaaaaaagatagagataggctgcagcttccacgtcaaaatcataaaaacagctggaacgaaaggtacgggagaacatagtgttgtccacttggacacgaacaaaaaaccgaaccgagtacgtactcaagttgttactaattactactagtatatatatcgaaacaagtgcatggattatgcccaaaattgtgcacgcatgtgttggcctttctgagttctgaactcctgatgatgttatcaagcgcgtacgtacgaacgtacgtacgtaagctcaaattttcaaaaaaaatattgccgggttttgtatgagaagacagagttaaaacatgtgtacgtacctagctgccgtgctggtcagaggggaggaaaaataaaagggagagaggtcaaggagagcatcgatcgagtatatatgagacagtgatcaagtggtggacagccaaacttgatggggatagcaacggtgaaatgaaatcagcagctgacgagctcgcccactgatactctaataactttttttcgaggggaagatactctaataactgagatgttccatttgagttatttattagtttatttatgtttctttggaaagaaccagcggagttgtttaagtttttctgaggaagggttagcacaaaagaaaagagagaagtctgtactttagtccgtaatttctgaccaaatcatgcccgttgaatatagtgtttcagcaaatccatattaactaagtgcaatttgctccgaatcagttcgtgtgcttcctaaacctgcctaaactcacacacatactctcgttctttttatttaacactttataattggtgtccttagacatctaatttttttaacagttcatcagattctttaccagcagaattggacacatgaaagctacaccacttgatttgtcattattgcacagttcttgtaacttgtttaattagagttagtaataggtatttctaaatagcggtctaaattctgttctggagaactagaaaggtgaaaaaaaaatcaaaaccgaatagcatagacagatatattggattttacttttgtctgctttgaaccaacaattcaaattcctttctaaggaaaaaaaacaaacataatcagagttagatgcttgtcgaatggtaaagcatttttcagtgttgagcggtccaccgtattcatttagatccactccaagtgtgatctttgtaaaacttaccagagaagttacattgaagagggtgacatatctttgcatgttctactgattaccaatatcctaaaatcgatgcaaaccacgaattaaatttaaaaatatattgtttatttataattttcttataaacattcgggatacaaatttttttacaaaagtataccatcgtcgctggatgaaagcgcgaaaacgatacggtatcgctgatccactatgcgagaatgacgtggggtgacgatgcgccacggtttcgtattggttagccgcgagagcgtacggtctcgcacattgcttgtgcgagaccgcacggcatggctgcgacagggccaataattaatgtttaatcacattgattagcgactaattaatccctaatcatcattaattaatcactaattatggtaatcaatcactagttaaacgaaaccattggacaacacattcggtatcgctgtttcattatgcgacattgtttcggtctcgctctttcctttcgcgagactgttcggtctcgctcttttcatctgcgagaccgtgcggtctcgcaccattgctgtgcgataccgtccgtatcgtcatacccacatcattttcgcacaacgatcgtgtgagatcggacgtatatttctgccaaaacaattgtatcccgaatatttttgttaaaaaaataaatgaacagtatatttttaaatttctttctgcaaaccacctgcttttatatttactcatgtggtttttctatatgttcaatatgaaaaagatataggacatgaatatataaagacagttgatggtacatatgaaagttctcatataagggaagtccaaagaagtaaaattgaacagactcagagttagatgcttgttgaatggtagcatgcatctacagtggtagcattttttcagtgttaaacctcacggtccaccgtattcatatagatatagcccaagtgtggtctttttaaagttcaccaagaaagttatattaaagaggttgacgcatccttgccaattataccgattaccaacatcctaagatgtaaaccactcgcttttctatttactcaagtgatttttctatatgttcaatatgaagaatatatatgacatgaatatgtaaagacagttggtaatacatatgaaagttctcatataaggtaagtccaaaaatatttgacacaattggattagttcaagaacaatattatttattacaaaagttaaacaatacaatcttttatctatgcacctagaatggaataatgtttgctagtaagatatgggtagcaacatatacaagggcaacaattacaaagataattggcaacaaaacaacaagaatgattgacctctttgcccatctccccatgattgctagtgcaaatgggtaaaggagaaacataacccacatgttgaataggagtcccattgcagcatgtctcttctgtgctatcgtccatactcccatatatactgccgtctttccaatagctacaccaatggcaccgatattagcaactaaaactaccattgttgggattaacatgggaacccatctcatctcatataagtcagcaaatttatcgttggtgtcagcggttgtttgctttgaagtgactctaaaatgtatacccttctttgtgagaagattgaccaccatatgaagcacagctgttgggtaagcactcgttgagccgatcatgaagaactgctcattgcgccaataatctaaccatgtgatccctgcccactttatctcgagccatccgatcatatgaatcatcaaaatgatcacgagaaggtacaccacatacctagtgaatggcctctgaatatatacttcatcggggataagccacatcacagggctgatagcatagagtaaaataaagagtgatgtcaccgggtagattgtcatattgaggtatgagacacgctggagaggttggagccgacgacctccaataagtgggttattgtgggagaagaacatctctagggatccaccagaccaacgtacaatttggtgaagacgttctgttagatttataggtgcagtgccacagaatgcatcatgctccatggtgcaatacatggatcgccaaccttgcccatggatgcgaaaacccgtgactatatcttctgtggctatgtcatatatgtatccaacacccttgccccaatcggtttctttgtcgaatgaagctgacacaaccatctccagctcattgacaaatatgtcattgaccggtgatggtgtagcaaatcggtcttggtttagggcttctaacactgactctaataagagtatggagttaccaaacttgctagcttcaggtgtgatgttgtcttgtctccaatgaggaggatcaataccatagagagctaagcgacggaacatgcaaccagtaccaaggtatgaaggtccttggagaccatttagggcaagcattgtgccatcaaagaatacacgattatgattgccatatcggtcttttgggtcaacattgtcaaagcgttgtgggaactgaacaaaggcagtattatcaccttctctttggtcaagcatgaaacaaattgctgcacggaaggcttgagaattgttgatgtagtgatcacaatcaaagttgatgatgaattgtgcattggagagtagagcagaggcacgaagttgcgcatttaatgcacccgccttcttattatgatcataatttgggttctttccacgagacacatagacaagcatcgggatgcgcacatcagtggcattaaaattaagattgttgcccgtgctatccttcaggctaagattgtggccacggatgggatggtccaacacaacctgttcaaattgacaaatatgtaggtcatgttaatggaaaatttatggtgaatccacttaacaaggtaattgcggattgcacaatatgatattatccccttagtaatacattagaaaaaaaattaaggtggagttatgtaccttaacaattccagcatggtgtcctttcctgtgattttctattggctcaatccacgtgcctggccattgggtcccattagccatccaagtcgcatttggtgctccttgatcagttttcatactattgtaaacatctgatcgtttacgaatagtctcaggaagtgcttccaatcgcaccttgaactcatcatactcaagatgcacaatcctagagtcattcttgaactcctctggtgcacttccagtatacgatggtgcctcaagctcaaagtagctctctggggatctaggctcaatgcaatgcttccggcaaaatggaacccatagagtagcaaatttggctgtctcaaccaatgcttcatataggatcaatgctccactatcatcagagagatagcaggctgacctatcaacagggtagtcagccgcaagaatagagagaacacaattcatggtgtatagaaccggttcgtcgattggatcagcggtggtgacgaaaacatcgatgccgggaagtctgtagcttccgtcggcgagatcacagtactgccttagggcagtaaggtcaggtatggttttgaccggattgaactttgggagttggttaagtagccatgaaaaaccaaaccaaacatcaccggcgactgacattgtccagaaccacattatgtcagaattattgtgcctgatccgccatccgaagaagaggagaacggcaatcaagcgtgcaaagatcagagccctgtaagagattaaaaaaaacatgatccgactgtagttaatttctattgaaacgaaggctgaattttatttattatcttaaaaacaattatttctagaaatgcaagtaaatgcacatgcccaggtgaccagaaagggtaaatattcttgatccaattataagctgcaaagacattattggaaacatgaggccgtactgtgggttactacgagtcaacggattagcactgaaagaaatccgggagcagaatatatatcactcacgatccatccaaatgatcaacgtgctcattgacttgcatatatatatacttcattctaccaactagaaaacgcatacattcccggcttaactaatttttagatactcccccgtttcacaatgtaagtcattctaccattttccacatttatattgatgttaataaatctaagcatatatatctatctagattcattaacatcaagataaatgtgggaaatactaaaataacttatacagaggaagtaacaaaagtatagcgtccagattctgtatctagcaagctcagtactaataataatctttatgcataaaaagattttcattgcaatgtcgctgatttttcgatcgtacactcgatcggatgtacgtacctgtacgggtgcaggagggagcccttgaccctgtacgacctgaacagcagcggccggcggccgtcctcgccgccgcactccttcgccgcgcgccgctcccccttatcggcggcggcccagtgcttccccttggcgccgccgccgccgccgccggccgccttcctctccgcgccgccgatgctgctcgtgcggctcactagcagcgggtcgatgaggctgctgcagccattgctatcctcaccaccgccggcgaccgacgccggcgaagccatgacgagcactctatagagctcactggcaagcttaagccagtgcaagtgtgctgccctactggtacttgaagctgaagagagtgtgcagatgcaccatgtatatatagtactgtactagtgactgatcgttgggttgaatgaatatttgcgtgcatccagatctgcgtgcgccgcaactatcgtctatcgattgatcggtcgcctcgcctcaccaaacgtgttactccctccatatattaatttatatgtatgacgccgttaatttttcaatcaatgtttgaccatttattttatttaaaaaatttatataaatatgaaaatatttatgtcatgtttaaagaatatttgatgacgaattaagtcataataaaataaataataattatataattttttttgaataagataaattattaaacgttgaaaaaaagtcaacggtgtcatgcattagtacgttgcttcgtctgagcactaaacaaaccactggtgaacaaaacgtgcagcagaatgcataagcatgttgcgtccatgtgcctgcaggctgacccaaaaaacgcacttgtctgcagtgctttgcatgcatgctctgtactgtcttacgtcttgtcaggctaattaataaatatcgccatatggttactttggttaagctgcattgctaatcagctgtattaactgtgccactgtaatatataagctcaggttatttgtgaaagtcaacttttgccgccttaattacggcctggtgttactcagtcgtcgtcgagcatgtgggtgcaacgatcagatcgatggagatggatctacctatgcaagttgcagttaagcagaagtagcttaattagatcaccgtgcatgcatgagagagagatcgatccagtgcgaggggacgatcagaaatctggcagcatagattttaatttgtttggttctctcgtgtttttgttaaacaaatcagaaatccagtatgattctctcttggcagatctgcagagagtactgattttggtgcatataagttagtttatacatcaatgtgttgcatgttgtgtgttgattttttttttttactcatagagatctggtgatgccggttgtatatactactggaatccaaattgatctcacagaactgtggggagataaaataaatggccagatctatatattgatcgaaataagagttcacacactgctcggagaagcatctttgtggtgaattgatctatgtactactactccctccgttttatgtttactactcgctccatttaataatgtaagtcattttaacattttcacattcatattgatgttcattaacatcaatataaatgtagaaaatactagaatgacttacattataaaacggaggaagtactactcaattcgtctcaaaatatagcaacctagaattaaatgagatacatcctaatacaacgaatccggacaacacctaagactagacgagacacctcctagtactacaaatctgaataacatatatgatcggacgtgagacacattaaattactatgaatctggataggctctgtccaaattgagtatatccagattcacagtattaggatctgttttgttcgattttaagttgctatattttggaacgtatgtagtaaattagaagacatatcctagtatgcaaatctagatatattctatccaaattgatcatgtctaaattcacagtactacgatgtatttcgtctagttctaggtggttgtatttaggaactgaggtagtaaatcatatgggttttgttaaaccttttaaagtttgaaaccaagtttgtaaaaaattagcagtattttgatatacgaaacaagcacactataaaaatatatttaatagttgatttcaatgaaacttatggttggtgttgtacatattgctgcgttttccaataaacttagtaaaagttgaagtctgagactattataatatggaatagaggggtagtattcaaatgctatatattgttcataattgagggtgtatatgcaagaacattttggaaagattttatatgcacaacgtcatggatattaattatcttggactatatctcttgaacatgtgtgatcgatgtgtaagtgtcacaattgtggtagcatataaattaatgtgacggtacgtctttcgtagatgtcacttcgtgtacttttttttctatgtttaatgtaaatagttaagatagtttgaaaaaaattgattgtatacgaatatagtaatatctaccactccatcaaaaatctcaaattcaacatatacattaggaggaaaaaaaaccgggtatgaatagtacaactactatttatatgctgaatttgttttttaatctcactgtgtgagttgagtttgaaccttatattggttaatctttagacaattcgaaaccatttacgaacttgagatttacaatagcagacaaggcattatactaggggtgtgttcggcacccaattttctcaacccatctccctcgttttccgcgcgcacgtttttcaaactattaaacggtgtattttttacaaaaagtttctatacaaaagttgcttaaaaaatcatattaatctatttttttaaaaaatagtaaatacttaattaatcacgtgcttatggactgctccgtttttcgtgttactgtttcgagttgggaaccagcatatgcgaacacaccctagtatgtgttcacaatggcagtactgcagtttgccaggcatgtgtacatgcatgtttgaaatttatgcaccacattaccagctacagtcatctaaaaaagaaatagatctgtagatgcaggagtactgttagaactgtgtattaaatcagctatgatcagtagaccgtctagtctgatttactaattacaagtccaaacgaatcttaattcctgttcttctgacctcttaattattataccaacatgctcatcaaaactcgagagtccgactgatcagatgcaaagattaacctcaaggtgaatgtcaaaaagaacaaaatcatacatgtagattgctatcagtacatgtcaaatcaaagagtgtgtacttaatttttaatacagtattaatgggtggatcttagagtgttaacggtaattacctggtacaccaatctagtccatctctgacaagctaacatgtaggcggccgggttaggaaactgagggagatctagttaattcagaggcgacgatgcgtgtgcatcacatgtgttttagccgtccatgtgacaatgcatcaagctggaataatcgattggctgatacagctaatacaagccaagaagtcgatggtttctagtgttagtctttctttttaaaattttgagatgagttttggtcattttgcttggcgttaattccctaatcacgtgatcttggagagacgagttagagcaggtacaatagcaggctataagccggctataatcatatatcgagaagaaagcgggctacagatttgtagccggctgtaatacggacttcaagatgttatgtgtgtatgagatgtgggaccgggtattaatggtgtagtatatttttatagttaactattgtatgaatgagctattagattggctatagatgttttggagccagaagttgtctatactattgaccttgctcttaggcgtactaatgaaggcattaactaaagttcttactagtaatataaactcgcacttcatgattttggtacacgtgagatacggcccaacacgctccccgaatcccgctccggcccattcctggtaatccccgttccggcccaaaagaaggtgctatatttagttgggccgtactcacgacatctttttagggccgaggaagatttccttgtccgcactcactccgcacgtcgtcgtcttcctctcgccgctccaaccccaggacccccaggtacgcgcggcgcgcctcctcttcccctccgctagctcctctcgaactggttgcgccgctgctttccccatttggttgacctccgcgcggcggctgaccagcctccaacgcgtcatgccggggttgttttttttttttttggtgggggtgggggtggtggagg

SEQ ID NO: 35914 - DNA, 2890 bp, Oryza sativa
gggggttgggggtggcttttcgttatgtttgttagctcactagccgtgtgattggatcattggaaatctgtaatagcagtgtggttagcatatattttctgggggattttgtgccggagtccgccattcggctgttggttgcgcgtcaatggggaaatcagtacattggctagtactccggaaaatttggcattgaagagagttttgcgaattggttctggacttcccacgggaactacaagtgatttcatcatgatatagagtagtaccaggatggccggatgggatggttaactctaccatgaagttgccaactgctagtaaatttaggtggtgttttcagacagtgaggagttgggggggattcggagatccactaactcataaaaaaactcgaccggcgggggaatgaccgtccccgtggcttttcattaataagaacaggcctcaaccaaactggatgagaaaaggcatgaaccctgcaccccccccctccccccaacaccccacacgcggactcgccccctatggattggtccttaacctgtactttgaggctcctttcttgtacacaaggcccgctctccataggtcgattcataacatgtgtttttacgagaggccagcgagtaacattttttttaagtaggcctaaaattcgctctcgaggaaagtcgaacccaggatctagaggtgctacttgagcattgtgaccgctagactacatgccctttcacaggcccacttgctcatgctagaagagtcgttgaacgccttcctccttggtttgtgtcttggttctactgtcttgctaaaatcccagtgatttcactgcttcaatgaactattaaaggaaaattagaagttcgaataacagaatggtgaattggtttaaatcaaggtttgagatttcggatttgtgagtgggtcccagcagaaaatgtctctggccaaaaattccaagtttgtatttatttagcgaaaagttgttcaatttgaaaaaaaaaatctgaaaatttcgtttaacagttgcttgcattccatttaatttttcattgttatgtgattttgcaacatccatacaagagtacttagactcaacaccttacagaacggctcacttcaccagtaacttaggctcacaaccatgcacccacagcattaaggatacttgcaacaaaagctcataaaagagacacaaagcattaaaagttcgagtaacagaatggtcaattggtttgcctcaatttttgaaatttcggatttaccagttggtcccagcagaaaatgtctctggcccaaaattgcaagtctatttatttagcgaaaagttgttcagtttgaaaaaaaaaatctgaaaatttgtttttgcggttgcttgcattccgtttatttttttcgttctgaaatgtaaaaaccctggtttactagacatagatgaacgtgatagttactaaccattactccagtatacagtcactaaattattcagataacactattaccatgcattatactagacattctatgagtagctggcaggatcatattcttccacaaggttttgtagaaatgccggtattgggggcaacacgacatctcgagtgccctgcaagatatgaactatctgctgcattgttggtctatgagcctcgttgtcctgaatgcaccaacatgcaaccttgcatgctctctccagctcttgaacattcgtgtcatgcattctatgatcaaatacttcagaaatgtcaccattgcttatcctgactgcagcccagacaggaaagtactttatagttttactctccatcaattctgtgttccttttgcctgaaattatctcaaacaacatcattccatagctgtagacatctgcttttgacgtgatgggaagacctgcgatccattccggtgcaagatatcctattgttcctctcatagttgttagtgcccgactaaaattccgatccataagcttagcaagaccgaaatctgccacttttgggctgaagtccgcatcaacaagtacattttctggttttatatcacaatgtatgatgcattcatggcattcctcatggagataatgtaatccttttgcaacacctagaataacttggaatcttgtgtaccagtccaacaccttcacattattaaaaaggtgacaatctagagaaccatttgttggcaacttttttgacaagtcgacgagcacgatcgcaacacctaaacgccttgcggtgatatggagtcgccaaccacctcgatctagccaaagggccaaattaagatgggtttcggagaaaaacaactaaggccctctttgtttaggcttataagccaacttataagtcgaaaagtctaagccaaaacaaacaagcagctttttcatttggcttttttaagccataagccactctaacactattaagccaaaagctaggttggagaagctttttttggcttatatgagatagatgtatgactctaccattaaacttaggacattaaatccactggcttataaatcatataagccaataagctgacttaaaagtctaggccaataagcctaagcctaaacaaagagggcctaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacagcgcaaaccgacaaagatggactaaactagggtaaaatagaaaacatagtaaaagaacgattcaagtaaattgtattcgggggttttacaatgaaccggcggccttgtcccttaaatagggggttggtcttgccct

SEQ ID NO: 35915 - DNA, 8118 bp, Oryza sativa
gcggtcagaccggccctactagccggtcagaccgcccacacacctgtagtctgaccgccctgtgaaggaaacctgtcactttccaaactttggcaatcttcccctatttcgtccataggtgccaaatttgggtgtaaacacatgcccccctgcctttttggtgaacatacgtgaacctaaaagcatagaacatgttatctcagggcgataatccaattactggccataggacttcctaagcatcttgccaaatgctcgggaagcatttcttcaagtatttcccattaattgatatctgaaaacaccatcttgaagtgtcttcatctccttcaaagtcttcaaacgctcgtcgatgacatcttcaaaaattgcttcccatcaaggtcttataatcttcaaccgacaagtcgtcttgcttgaaataccgaagagagccaagatttacctcaactggcaaaacggcaatttcaacaatgttttattactcgactcggcttatccattaacctgagtgtaagaactcaacaacttaatatcataagattcggcaatacttctcacttccttggacataaaagaagctcctttaacgtttgaggaataccgaatctatgaacaatatgcttcaaaatagagtcaattacctccgtacaagtaatattctcgagcggcacggcttcggcccacttagtaagtaatccattgcaactagcacgaaccaatgctcttttgatgacgaagaataaatttgaccaatgaaatccaaagcccaacctcggaacggccatagtttaatgataggattcaacacaacggtaggcgctagttgaacattgccaatccgttaacaagcttcactccctctatagcatttgaaacaatcatcaattattttcggccaatgaaaccccactctcctaagcaaccaatttatcttacgggccgattgatgaatttcacaaatcccttcatgtactactctcctagcaacttcagattgatcattatctaagtaatactccatctatttttcggtgatataatatttgaacgcttgccgccgaatcttccgatcaaccttaagtgtaggatctttcaaatatctaatcaaaggaattctccaagctatttctaactcatgggcacaaatgttcgaattcacaattaatttggccttttaatcaattgtaacgtgccccccagcctcctgtctgggatcggtcagaccggccacgcaatgccggtcagaccaccctgtctgcccggtcagaccggctatgcagagccggtcagaccgccggtaccaccggtcagaccggccgtgcaatgccggtcagaccgcccttggtctatgactttgccaatttcgtccaaacttttaaaatcaagcatcggcctttagtatataatttttcttcacataatagccagatgcttggtgtatcaaattattggaccaaaattcctcctctctagacatatgaaaaactataacatccaactaacatgtctagatgaatactaattcaaatggcttttgaaacaataatcatcatggcatcaaaacacttagccaattgaataatgaatcaccaaagtcatatgcctcacacacatgaattccaataaactacaaatgtaagtaatcggcttgagcatgtatgcaaaatattaataatgccaatgtttctaaagaaaacaactctagaataaatcatcacattgaccattgacattagccgaattactaataagcaaaactttcatggtgcaataattataaaatctatatcttatatggtgatccataaaaacacatacaatttggctttaaataaatatcaaagactcgtgaaccaaatcatacttaaaacaaattatatgccaacctaccaattccactacttagaactggcatttgcaacatgtatgtataatatcaatttgataagcaaacaacacacatgtgctagatagtaagcaatgttctaacatggcataggcatataatataatgttaaacacaaaaaaacccataccttgccttagcatccgacaaacggcggctcaaagatgtgatgttgtatccatcgccgttcatctctcttgatttcttcataagcatattaatgtcttgccccccgagcaaaatcggctttcttgattgcacgatttcaaaggcaagacgaacaccgcaccaacatccatagcatcatgtgaaggagacttatctctaatgaccgatgattcttctctcatcatattggatttatcactactttgggaaatcaccgatctcttaccttttacttctttaggtctccacactcgcttaggtgtcgttcgaggctctaaattattacatgttttgttctccacatcttcggcctccttttctttttgacctatggcccgaagacgctgaagcctcctcttttgagagcgagataagccggaaggtatccacttcagctgtggttgttttccaggagccaaatgatgattcttcatatttttggtcgaagtggaagctcctgtgttgctctcaattttctcactcttctctaatgccccccggtcagaccggcctctaggcccggtcagaccggctacaaaccgtcgatcagaccggccaggaaggtcggtcagaccggccgttgtctggcggttagaccggctagctgttttggtcaagccgccgatgttgacagtaacggcgtcggcttcagtcttctccgcttgtatagttttcggcgcatctccagtaggtacatgaacatcttaagattcctcattgatagcaacgacctccggagctttggcttctttcctcacccacaccttcacctttttcacctttgatccaccggaccgattcttttgtgggaaacggtcttgtcttgagttagatgaatgacttgatgttgacctaggtgattccttccactcttggtaatacggcataggtggttgatgcatccaaggcatgtaatacataaaaggataaccatatagtgacattggatatggataccatggcatcacaaccggaggtttgtatggagttggtatagttgatggctccgattgctttggtatttgaccaaatctcttcctacaagatgatcttggtctttttgaatcactagtttgattatcaagtcgttgaccggctaatcctttattgtacttagccataagcatctcaaaagtgagcttcggctttttggtcctttggaaactagatgactcatcctttgcatctttatgatcttcggccttcgcatttttgatcctattcttgggccgaggatccccaataataacacgtctccctttctttttgtcaacatcaataggactaacagagagaggatcactaacaactccggtcttaggcatagatgtaaccgaaataatttcacaagtgaccgatgaatcatcaaccggtcttttctccatcaagtttgcatctttaaaataatcatgaaactcatgcttcatttgtgaccatgtagaaattgaactaggagcaagcaaactataccatgtagatgcaaagtttgacaaagaaagagaaaacaactttaacttacgcaaatcatcgctaccggccttaccgcattgatcaataaagcggtcgatatgctccattgtagtcatagcattctcacctgtgaatttcgtgaagttgggcacctcaaatccttgcgggtatggaactgaatctacatgttcaggatacggcctttgatatatatgcatggctactttggattctatttcactactatcccgcaagacattgtcatcatcttttccaacatctacatgaccgatttgtgactcggtcttaggtgacaatgctatttcactttcgcttgtaatacaatccgaaccgtcatttagttcggctatatcttcaatgatgctattctctaagctagcaatacaatccgaaccaccacttggttcggctattccatcgttgtctaaactagtaacacaatccgaaccaacacttggttcagctataatggttgttgcattattttccaagctagcaagacaatctgaaccaacatttggttcggctataatcgttatggcatcattgcacaaatcattaacacaatccgaaccatcgcttggttcggctatacatgatattgcattatcatctaaactagcatttaagctattgtcatccactcggctttcctgagccggagcttcatgcaacacatgatcaacatcaagaaatatctggccattcaacctctctttaatagaatcaagcaatccatcatatgcaatgtcggccaaatctttgtcagttattttcaagctataacatcggtttttaacatctctaaacctttcaatataatcagcaacagattcattgtatttgtgcctaaccgatgttaaatcagacaacctaagctcagtctcactagtgtggaaataatcatgaaatttttgttctaattgagcccaggaaaaaatagaatttaccggtaaagaagtaaaccatgtaaaagcagtaccggacaaagataaagaaaacaagcgcaatttaaaagtatcactattagcctctccacattgcgctaaaaattgacctacatgctcccatgtggtcctactatcctcaccactaaatttggtaaatttgggaactctataaccacgaggatatggcacattatcataataattaggatacggcttttggtaaaccttagcacgattcctagtttcaatcccaaatttatccctaataatctcactaattatctcctccatattatcaggcctatgttgaattggtggtggatttggtggcctaataggttgtgtttgtggcgcaatatgattatattggccttgcctagtatcgtgagaatatcctctagcaacatcattataagtattaggaacatgcgggggaacttggggattagttgtagcagtagatacaggaggatcaaatgttctaagatgatacaaataactagcattagtcattggatctatcccctgaatcggtatgattgtgccggtctgaccggtccagggctcggtttgaccgacatccagaggcgcggtcagaccggcctgagtcccggtctgactgccggggtaatatccagtcggaccggccgtttggccggtcggaccgacggtgaaatcgcggtctgaccggccatcaggttcggtcggaccggctatatgcgctgctccatcggttccactacttgtttgatctataggagcttgactagcagtggtagaggctttatttttaaacatgtaatcggccataagagggccgaatttaaatcttaaaaactcatcaaatttaccctcaaaagttgcatctaacttatctttaaaaacagtcatggatgaatctattgtagatgctacttcttgttggatagattgtgttaccttcggtgaaactgcaacttgaggtagcggcacgtttcctttcatgacgtcttgatcggtcttgatgtattgtgtagcaatattgttgaaccgttcccgctcgtcatagttaatgaagaaattccttgattaaatccggccatatagctcatagccgaaatatttgaccgaataaattaatacacggtcttggaattttttctctcgcgatgagcaatgtgtgcactaattaattccaccaaaatcaacagataaactttgctttgtctctctgtagatcggctctggtatagcctgatctttttgatctatgcacgtatacagtaataaaaggaaacaatgctcctgctgcttgtctctcggcagatcggctctagtagcctgatcttttcctctgttgccatgtgaaacaaaaggaaaggaggttgccgagtcagctactgctccctgatgatgatcttcagtacacacggcaagtgttcagatggattcggtgacgaccaaataacctcgccgccgattagattaatccggcgatactagattaatttcggccgtttagccgaaacttggatttgacgaaacggtagctactagattaaacgaaattcggccgtgatatggccgattagatcgttccccagtggagtcgccaaaaatcgtgttggcaacttttttgacaagtcgacaagcacgatcgcaacacctaaacgccttgcggtgatatggagtcgccaaccacctcgatctagccaaaggccaaattaagatgggtttcggagaaaaacaactaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacagcgcaaaccgacaaagatggactaaactagggtaaaatagaaaacatagtaaaagaacgattcaagtaagttgtattcgggggttttacaatgaaccggcggccttgtcccttaaatagggggttggtcttgccctctacaggcccttctccacgtccaactcaggatagaaactaaaggaaacatgaaacatgccttcccgagcaaggaaacccgagacccgacgaaaacagacttggactcggaccctgcctgtcagaccgcccatatacctgcggtcagaccggtcctactagctggtcagaccgcccacacacctgtggtctgaccggccctgtgaaggaaatctgtcactttccaaactttggcaatcttcccctatttcgtccataggtgctaaatttgggtgtaaacaccatttaccataaatttatataccagaagcctttcagctcctcaagcaaaacccctcgaggcaaaccagatttgtgtggtgaattcgtcctaaggccctcacctcagtttgaaattgcttctcgcgttgcctcattccttgaagcttctttacagctatcatttgagagtttgggagtgatcctttgtacactgaaccaaaactaccttgccccaacttatctgagaaattctttgtgcagtgctgtaaaaaagagtaactgtataggatgagagaatcatcattggagaaagccttttgagttgcattcctttttcgaaacgtccaaattattgcaccaaaagcacatagtgcaacaaaggtacttcccagcactgcaattagcctcatatgatgtgtcttatgttcattgtattgaacttgaagatcagatgctgcaagacgtacataaatatcaatagcatcaacattaccagcagacaattgtttaagatcccggagctcactattccaaacaatgcattcatgttgatgtgcatatgcagtacaaatgcagttgttcaggcatatggatctgcactcctcctcgctttgaacattcaattgcattggattgcctggaactttgatgttggcaatcttgagaaatgcatgcttctcttgttggccattatgtttattagagtcaacacaagagatatctgttttcctaacacaaccttgattccatgctccaagatcccagctcctcgaggaaactggcctgaaacctggcaggcaatagcatttctcatcaaaacctgttttgcagactccaaaaggcccacagactgaataaacagcacacagagctgcaggtagagaccattgtactatccattcctctgatttgttggaccatgtatggcattggagttgaccgttaacggtaagaactattcttgtgattatggatacatcctttgtggtgtatataaacttgagctggtgactattattaatgaaaacataattgtattcagtatttagtggcattccagggatcgatgtgaatgcttgtcctgtccagttcccagactgccaataaactttagattgattccagagagagacatattggttcaatctaattagatctacatggttggagaaaggacctggtgcaggatcttctggatctttccaagaaacacgatcctggtattcaccggtgatcttattgatcccaaatctctgcccactcagtattgtgtctgttgggtgatcaaagctttgccagattacatcagaagagt

SEQ ID NO: 35916 - DNA, 6575 bp, Oryza sativa
gaaaagaaaaggaagaacatatcttccacttgctgggaggggccatcctttttgcatggaaattggatgtgtggtattcttctagttaatgcaaatgccacaaggtagagagttatttcttccctctattgtcatccttctcatttgacttgtcttccaaaataatattctttttatgttgttagtctagtttcctgtgaattgacggatgctattgtgccatctggaacaagcacaaccatgtgtgagcacttgataagagttagacacgacttgttcacaaataagtccagacacagaatgtgaaacggacatcctcttttttttgactaaagaacggacaccctctttcaaactctgaattcttctcctagttgcttctgttttactgctgttctggtgattcaaaccaaataatgtcttcttttaagcatcatatatagcgatataactcacctttagtaagttatatatcatatttgtcctagtagtaatatgttcttcaattgcaacgctgttttggccattgaagcatcagatgtttttggtggttcatcttgttattcaagtgtaaaaggcagaagcatgataaagctgtgcatccccaggagcatagatggtttatttggcaatcactttttttttcttttcatgtaattgcataaaatctgctgtgcatcatgctgtagtttcgatttcagttttacatctttcttaatattgtttttcatgtgattatgcatctgtagtcatcagtcagtacaccggcacaggctagtatttttattgtgattttggaacatcattatttatatttatgaatattttaatttgatatattgagaaaactctatctaaacaacaagaaaattccttgccagcacttttttaaatcttctgagaatacagtacacttatatttttcctctttgccaacgaagttattactttgggtgtggatacttttgtaatttgttgcagcatgatgcttatatttagtatggaagtttagtttttaaactctggaaattaaaacctaataaatcttttttttcatggttacttacagcctaagaacatttttaagacaagattagtatgtaagctagctacatattcctctaggtatgctttagttgtatgccttaattcatactgattgggcagatagtgtaaatcaacttgattagaacatgggaatcgaaaataaatctaattattctgtgtatatttatatgttcagaccttgtatacatagagttactatgaactgaactttgatttgtttttccaggccatgtgcgcccaggaaacagattcatggatgccttctggttcttatcttcatattgggtgcaatgcatggaacgcatgcttctgagttttgactattactttaaaaactactactactctgatacttattatctattgcatgtagggtgtagatgaaaacattaaatcaaatttgacggtcatggtttccttttttaaagattaatgtgctcatgtttagccatttttttattattgtgtgaatttatttattttagaatttttaagattaatgtgagggcttcttattagtataaacaaagcttcagccgggattcttctactggcctgccaaaaaactattttgtaaatttacaggataacaatggtgtaattactcagatgatggcatttggcccttaagaatttgaaaaatatttaaccagtgcagatgttaaagaaaatatagctactccctccgtcctaaaatataagcattttttgaaccttgacatggtctccgagatactactttgaccaacaatatctataaaaataagatgttttaaataaaaagagttgcatattatgattgtttgtttaataataaatctagtaacatcaattttatatgattgctcttttttaattttttttttgctattagtggtcaaagttaaaaatgtttgacttgtcactgtgctaaaaatgctttatattttgggacggagggagtatttattctcaagtagctcaagattaccaaatttaatctattcagattgttatgtgcaagcagatcataacacctgaattgaagcacatgttgggactctatcaaatgttaacatgtgcagtcaggcctcctcataggtaaacataaaaattctaatacatggtggatggctcaatgtgttagttcgtgatagctcaattatgtgctattaatatacagaaggcatggaactacagaactacagaaaagcatagcatatgtacaacatgagtcactcatattactctcaaatacgtaaatgtctttccctaatcaaattcaggattttctgatttatgtgctctgaaattgtgaaccacctgaagtagaactctttgtctgcgaagaagctgtgctattatgcatctgcgaagtttgacttgatgaaacatctgagaaaaaatttatgacatcagggctttcatcaagaaccttcagtgaccttggaacaggaggcatgttgacatcaaggaatccctctaaaatttggacgacctgacccattgtaggtctgccattttcatcatcttggatacaccagcaggcaaccttgcaagcttttgtgagctcatcagcactggcatctccattcaacctggggtctaacaaggtctgcacatcaccttcctggagtttgtttacagccaaagttgggaagaaagaggactttccctcctcccctagatcagcattccttctgcctgatatgagttcgaagagcatcatgccatagctgaagacatctgccttaggagtaatcggcacaccactgatccactcaggcgcaaggtaaccccttgtccctctcattgttgtcaaaacacggctgaaatcccgccctaagagctttgctagaccaaagtcagacactttgggtacaaatgactcatccaaaagtatgttatctggcttaacatcacagtgtattatgcaatccctacatttttcatgcaggtaatttaggccccttgctgttccaagtgcaatttgataccttatggcccagttcagtgccgttgtctcaccatggaacagctgcaattccagggagccctttggcatgtactcatagacaagcagtcttcttgatccttcagagcagaaaccaagtaggcgaaccagattgacatgttggatggtcccgatggtgcttacctcagcacggaattgcttctccccctggctcagtccatcaagcctcttcactgcaatggctgttgaatctgggagcttccctttaaatactgtgccaaaggcacctccacccagcttctctgagaagttgctggtgacatgctgcagatcactgtaccggaaggcaatcagtgcgccccctgtagtcttggatatgcgaagagtcctgtctcggcggcatttctggaatacgatgaacaacacaattgcaaggattatcaaagctgcagcaactccacctacaactgcaccaatgatcattttcttgctctttttagagtctggaagttcagacgctgcaagcctgaggaagagtgtgcctcctccattcccattgtattggtcttggaggttaatcaagtccccatgccaaacaaagcagccactactattgtaagtgtaagcattacaggagcaattattcaggcaagcaacctgacaggcctgagaactagcggccactgcactctgagcattatcaggtagcctcacactaaccatggaatagaacttatcaggctgagtctgtgcagagcttgagttggtctggcactgcacccgtacgtttctcttgcacccaccagtaaaatcctggaggtcccaatcactctgaaacttctggctgaaccccttgatgcagttgcagaacggcaggacattgaggttgcaacttccatatgcgccgcagagcccgtacacctcacactgcgtccgtggctgggaccagaacaagatccaattctccgaggctggtacccatgtccactgcttgatctgcccattcacatcaatggtgaaccgcgagatgatcgagtcatccttcatggagtatatgaagtagctctccgagacattgttaatgaaccggaagttgtagttgtagccggccgtcatctcgggcacaagactgaagatattaccgttccaagggccgctggtccagtaagtgatggagtcgttccactggatgaagtactgcgttgtgccgttgggatccagctcaagggagaacagcccaggggacgggtttgcattgttcctccatggcacaagccgctggctcacaccagtggtcttgttcagccccagcttgccgcccggaagccaggtgtttgtcggatgatctatgctcctccagtagactatggatgaattggtggcatccatgaggtcgaggctaccgccgtcctggatgacggcaacggtggagttggaggccacacttacgttggtcgaccacagctgcctgttcttggattgatcaaggaggacaagattgccatcgctgccgatggacaaggatgcggtggtcgggtcagacaccggcacgtcgctgttggccgtccacaccgtcgtctgcaacggtatgttgttgtaccatatagctatgtagtagttgccggtgccggaggcggtgttgttaccttgtggcggggtgtagaatccaagggcgaacctgccgcccttggagacgatcttctgcgtcccggacagcggcgtggtggagttgatggtgtccactgcggtgcagagaaagatttggctgaagaggaggaggaagaagacaggagccatggatggatcttggcagagcagccagggctgagaacctgggacgaatggaagctgagcttggcctttggagtaatttgattatggtggttggaacctgagaggaaggtaagcttggtcttataactcatatggacagcaaggctccacttcacgagatattgcagaatgaacgctctttgacctggcacagtagagggttctgtggaaaaggtacatacccgaagacctggtgtttgtttatagaagaataatcaatatgaaatgtaatattctgtttaaagttgtggtgaattattaaatggtgggttttattttgtttttttgcaggaggggtgcagaaaattggttctacagttttgcttgcgaaatagtactgttcctagtattaattaattttgctgcctgttcaactaatcaacttgtgttctaggattgaagatattcgtgtcccctcttagtaatttattagtattcacatttgtgaacagagacgccaacatctgctatgatgctatcctcttagtaatttattctgttgcgaaataaatttaaaaactaagaatagtgtgaagtcaaagaaaggtgttttggacttgtggcttgctggtggcagcaaaagctccgggggctctgcgttgacttggccttagtttaacgtggccggtcgttcagagaaactcttttaagacttgctagtattatattttgctgaggtttcaaaattctctgtgctaataatttcaaactttgatcaggaccagaccatctccctttgaagatgaccaaaatcttgaagttggctgccctgttttctctcatgtgggtttctagagaccgggtaagaaatgttgctgcaagaaaattagctggtcatgttgatcggcgaatagcactgtcagtgttagaattgcctgctgatctgttgaaatgttgagtgttaccaagactaacagtatttataattttggttcatggatatctgttctttccgtaaataactttcgtgtttctcattgcgatcaatatagaaaaagcttctgctgaacagctggtgtgaacgttgtcttcctacacgtctgtctgctgttttttcttcccgtcagatttttgttctgctttgtttttgtcatattctagtttttgtacacatctattccttcctgattgcaaatttatcaaattagttggtcagtccacattttgaagggctaatctggtatgatataaatcctatgtttcagaaaattgggtgatataaatcccaaatctgggttaaacactcgttgccatgtttttttataatactgttgttgccatgtttgagaacaggatttgttgtcgaacttagtggcccaagcttgacgatgacttgaccaatgaccagtttccttccttagttcctgtgtcgaagcatgtctcagcatgttaaatgctcactcattcatttatgaccagttctctgatatgatgctgatatggaccgagagcattgaagtggcattgatggagagcagatggatgaacactgatcaccatagtgtggaggggagagggccacagacgcaacaaggagatacaatcatacagataatggtgattgaatctcatgaagacgaagacaaagacgaagataaagattaagtgtttcacgcaaaataaggtggtaataacgtgtgattaattaagtttgaattattacaaacttgaaaaatagattaatcttatattttaaaacaacttttatataaaaagtttt

SEQ ID NO: 35917 - DNA, 10422 bp, Oryza sativa
atttagcagttctatagatccgttgttcgagatgaaaaattatttaaaagccaatgtgtaattcgtattcatccaaatttctcttggttctctgtgtattctctcttccaatgatatctctgagagtccataaatatatttttccaaggccattattgcgcccatggcgacgacgggtgcaagttagtactgagtaccttaccaggtattggatgaaatgctatactcgcaattatctaagaaagaagactcagaaataatcatattatggttttgttagttatgcttcagcaacgcttcttaagtaaactggttgtctatgaggtaaacatattatattatattctctctgtcccataatataagacgcggtcaaaattgacacggtctccaaagctaatctttaacttatattttctcatatacaataagaagatttgtagcaacaaaattataaccatatgaaagtaaatttaaatttcaatataataatataatttttaacaaataaaatttattccatattataagtgttggttaaatgttttaaagtttaaatcttgaaatacgcgcgccttatattatggtatggagggagtaggaaatattccccgattgctcagcaggcttgttgacaggtacgagacacacctcttctcaaactcgttaactggttttatactcaaatcaattaacagtgacatgaacagcacaaaaatctcaagtcttgtcctgtgttgcaccatggcagatcattatgtctacttgattgataaattggtcgatattgcactctgccgaggagttgaggatctggatctgacaacaaaactagaccaaatatatcaaagatctgacatagcttggtacaaatttcctttatccttgttcaccaatggcaagggattatctctgttgaaactcaaacttggccaatgcacccttagtattcccactggttttgatggattcaaatgcacatttctgatgacatgattcagacacttcttgaaaattgcccaaaattgaagagctttcacctgaaccatttttggggtatttggagctcagggacatgatgatatgtcattgctttcatatcaaatgtatcgagcttgttgctcccaagttgcagaagtccagatatgcagggcgatgcataacaatggtgtttgcctcaatcccgtccattgagcatgcctggctggattttcatgatcacgagtatgctggctcttttgagtacttcatccgtcctaaaatataataatctagaaccggataagatattttctaacactatgaatttagacattttctgctgtgttattagctcaatgaaactttgtttgagggttttggtgtaactattggctttctgttatggaaatgctatcacgtcagaattagggaaaacggcactccgtttcgtactatttttctgtttttgagaaacaatgtttaccctctagttgtaacttggatgattgcatctcgagtggacctaggggtgaaagcagtacataaatttacgagatttccggttgactttttcagtttgcaccgaccgtttcagtctgtatcggtaactaacggtggtggaaatgaaaacggtaatatcttccgaaaatggtagcggaaatgggatggaggtttttccaaccgttttgtcggtaaccatatttgtacgataatttccgtcaaaatttcgaaagtttcctaggagctcagctagcctaacccatcagaagcccatgaaagaagaaagcctggtaggcttgcagcccataaaaaaagagaagtgactaggtaaaatggtattaaccctatgatgtggcatgtggattttgctgaactttggtctccttaacttatcgatgttgaagtattgttgaactttgtttatattggtcatcaaacttattatcataccattaatcatcatgtaacagtgttatgtggagtgtgatgatgtaagaataaagttaaaaagtcatcttcgtgcatagttaaatgtgtgctatgccatactctgctgattctgttgacttccgaccaatatcggtatattctgttccgacggtcccgttttcaatataccgatatcattacagttttcgggtctaccgtgccgattccgttttctataaaaaaaaatgaaaatgaaaatggtataggttttcctgaccgttttcatccctaagtggacctatccttttgtcaattatttttttcctgtggtgttttttttcctgggtacacttttttcttgtcgtttttaattttcgacttccaagttctaaccctgtactgttaggtttgcttgtaactttcgtatttacgcgtttaactatagtgttttatttccatagattttgtttcatttaaggccccattttaattaagatgtaaatttttactcggttttcgttagtacaatttttaaactactaaccgatgtatttcgcgtgaaaactttttatatagaaattacttttaaaaatcaaatatttttttaatatgtaataattaaaactcaattaaccacgtactcatagctttatttcgttttacatgttctaactttaccgacatcttatattaattagaaacaaacaccaccttatttcagtgacatggttggtggttaccagagtccagactccagaatggatggcgaagtgataggaagctcggacaaagtcatgagaactgacaattaattgacccgtaaaaaaaaatgtcgtcagcttattcagctcgcgggtcaaccgtgccatattctgcaccaatccaagaacaagaagacgcctcgaacattggagctataaaaaaaaatgctgacctcgcgtcacaacttgtgggggtgggttagtacgacgttgtcgtcatctattatctactccggcttagccgccgcgagtcacctcgccaacactgcatccatgcacctgaacctcatcgccaccgtccatgtctccaccaacggccgccgatcttcgccggtctccatgcgccagcgcccctccggtccatgtgcttttcgtcacacgcgacgcctaaaaagaaaatgttatctccgtttttaagagaagaaacatgttttatcattcgtttttatttaaatttttttctacataattattatttataaacatttaaagatggttttatatcttacgtattggtttaaatgttttaaataagacgtataattaaacgtgtgtaaagccagcaacatcatgtattatatgtaaaatggaagagtataaacggagtcgcaactcgcaaggcaacggcaaggcaagcaaaagctgctgacacagcactcctatctgctcaaccacttgcttggcttcctctgctccggcgaccgggcggccggccggccggcggcgagaggtagcgccaggtgatccatccatccatccatccatctcctccccccttcttgtgatcaaccgttaatcagccgccatggcccatgggtttgagttgatgatcgatggagctagcttcccagattcttgcagacttttgtgttctcgcctctgcctccttaacatagatgatggctgggcagtggtatcaagtagctcaagtttgtgatgaattctgtgtgagatgctgaaatgattatagcaagttctagctatgcagaaattgtattgactctccatatttatgggaaattttttgctgtggcatgcacgttgactttttcgtcatgtactgtactgcatgaacttgatgtccttgcacaaagaaaacgcctctttgaaatatgctagctgggttatgttgattttgttttttaaaaaaattatgcctagttgaattgggatcttgagagatgtattcaccttctgctttcaggggcacagggctgcaattggaacctgaacttgaaagcaagttgtgcaagaggacagaaaagaatcagtctgaatatggctgcctcaaagcttcaggccttttggaaccatcctgctggccccaaaacaagtcagtggcaaccctgtttgccttaattttagtgtaaaatggcaattgatattcccatagacatgattagggaacagaagctagcttacacatgtcattacacagtgagaactacttcccagcttgtcaattattaacagatgacatgattagggaacaggctgatgctgatggttccagcttacagttcagaatagtatgtgaaatcagacagcctggtttgatcacaagccagtttacaaaatactaaattactgaaaccgtcagaacataaaaacaacagtgtttaagactccctccttcagatagctgatgtgcttcattcttcaattgtctgatgatccatttggtttctaatttctagtagtagccaagttccatcttctcctcttcttctgatctgatggatgtctattggatgaaacatttaacatattcaatcactgtcatctgaactgttgaggcttccatctgatctttgttgcagttcatttctgggccccaacattcaaatggggtatcagtattgccaatgttgctgactttgccaaacctcctgaaatgatatcctaccctcagcaagttggtaggtttagttgtcagttaatcttattcctgacatcagtttatcatcaattcatgtataatgttgttgtgcttactctgatgtatgatgtatgatgtatgatgtgcagttgtggcttgcagtggagtaatttgggcacggtggggcatggtcatcacacctgtaagcccctgatatttagccatacatacaatcgtttctcgttattatggaaaaatatttggaattttggattgtatatctcatttgaatgcagtctaaacagcaacttttttgcgcaatgtctagtacgattctctagtgtaggttagtgcggtgtactgtaaaggagtaactgttttgaaactgaatcaagccaaagacctgttttatgactgttgtacttggatagactgattcagatatctgttttatgactgttgtattgttgcagataaactggaacctctccagcgtgaatgctgcaatggccgtgacaggcgtgtgccagctttcccgtaagataaggtctgttactgcaaaaccaatcctcagcttgctgatttataattccagatgtgatttctgataaattagcaactttcgtgttgatctcttacgattcgatatgtgatttctgacaagttaacaactttcgtgttgatctcttcttttacaggcacgattacttctctgatgagaagagtgctactgcgtcgctggaaggatgataggaagaagaagaaattgttgtcatggaatggaacactaatttcattatcagtcgaccagcacagtgttcactgtgaatgtgtccgcttccatgataacaaattaacaatcccatgtgtgtgtatgatcattatgaattgggctatgggtatgaaatgtttttataccctttggtatacagatagtaagcgagtctgaacttaactgaaacggacttggtttgagttcagctcgaagtacactcgaattaaacttaactcgaacggccttaactgaaacgagagagctcccttcctctgtgccatacaatatgtttgcaatttcggtttgaaattcccgaaatttcatttcggacttccggcacgaaactatttcgcctgaaattatattttctttctgaatttggtcaaattttattcaagttcggctaaaatttcttcaaatttcaaaaaaaaaaaactattcaaccgagaaaaaaagctcctggaagaaggaccaacagggagaggcacaaaagcggtgaaccagagcacgtaacttactccacaaatacctaaccaatgttccattcttcctctcatcttgattttataacttttagacctaacaaacattattcattaaccaacgctgcgtgttgctttgccctctgaaactactggaacggcaaatagcagcaattgcctccttcttcttcttttttttccccctcctaacaacacggggaaaatgcaaacgctttgcccggaaaactcatcataactgatagcggagagctgcgaatatatgccatcgcgttagctttttccaccggagttgtttttttctgactcctctcgcggcgaaagacgatgccatctgatttcagtcgctgcaggccttcctgccaagtagtagcttttgttgcgtttttcctatcaaacggcagtaaattaagtaaaaggctggtaattattaattaacgtgaggcggcaagactttgttgtgcaaaagcaaagcggcagaatgttaactttgggtaagtttcgaagtaaaatcgtgggggcatcgatctacagggagctggaataaaagaccatggaaatgatggaaaagttggaaggcagcagcacatgatcagacgatttggtgatatggacagcaggtgttccccgatttccacccatgatctgtgtacagtacgtatgcgcaagttccgttaatttctcacgcatcagttacagcctcatcttttcgcttatacttatatacttatcaaccaaaagttaaattttcaatcttaaatttagacttgattttgagattttttttcatcgaagtttatttttcagcttttacttttatatcgctaagaacacgtatataaaagctttattcataaattatttttcgtttgcatatatgtcgtttggcttattccatcgataagccaaatgatggatgaggctcaaaatgatccacttagatggatgagactcctctcacataaagttagagggacatggctactgacatatgggcccatgaaggtgggccccatatgtcagggactcatgtccctctgactttatgttagaggagcttgctcccacttagatagctagtttggtaaataggaaaacatgcaatccatgaaatacagatagatactccctttagactccagtcataaatattttaacgtttaaaataagatttgatatatgaaactttaatagtcaatagtttctcaagtgctgagcaaaatggtatatgcaagggcggatctaggaaaaattaatagaagaggccgaataaaccatacaaagttatagccccatcttctaataaatgtatgacataaaattttagtgggggcttcataggggctcttatggttgtaacatcggtagtgaggcttgagaccccaaagccctcatggtagatccgcccttgggtatatgtagatttgccttcgaaaatactattataatattattataaacatattaaattttatgaacttgttctaatataaaattagtagttagaattttaaaagagattgtctaattctcagttgcatgaaaataaaaattaatccaattttggactgctcatattgtagcgagatttgtgcatgaacagtaaaaattatctctttcaccccgcttcattcttctattgtaacacacaatctcctctcgttctctccgtatcacaagcaccaagccaccgccgctccaatccctagcgcgttgcttcaaccacctatccacttcggatctaacgcccccactgctaaaaccttgcgtagcacaagcaccaagccaccgccactctaatccctagcgtgttgcttcaaccacctatccactttggatataacgcccccactgctaaaaccttgcctgccgctcccctccaaccccactactccggtggagggtccaccacctcgtcacatgactatgtccgccactggtcttactaacaccctgcaactatccctctaagtttgagaaaaccctcttcttcccctccctcaaggctccctcctacatcaaccacaaccctaaactttaattcatatatctttcacccgagttggagtgtcgctagcaccgcagaagacagacatcgtcaccattgtcgttaagttacctctccttgtccctcctccctaccgtaaagaagattgttaggttgaagatgactgaaatccctagcaattttcagtgacatgagatatatcaatccccttacaaattttcctcaacgttactacatatttatgacgggattcctgcgattcatggcactgtgaatctgtgatggcaacgctgttccaagacatgaaactcgcgtgccaaatactgagcataataattaaagctagagcgtctgtcaatcgggtctgaccggcgcctctttattatattattccattattgttaacctccaaaagccgcggaatcgatcatgttttgcaattttgcaaaccgagtaaggccacgtacgcgttccggtctacttaaccagatcccgccaagtcaaccaaaccacaagtactacgtccccaccacaccacgtacgtacgcgacagcgcgcgaaacagcatccgtccgtctcgcggtcgcgccgtttcgcctgtcctgtggctcgctcgcggcctcactcccaatctccgactcgattcccactcccactcgcgacgtatataaattcccccacgcgcccgcgctctccgacccatacaccgccacacgccgcgccatctcttcgaaccaacgcgacacgacgcgacaccggcagcagctagccgcggtgatcgctacgacgatgaggttcgcgtgcttcagcgccgcggccgtggccgacgaggcggaggccggggctcgccaccaccaccaccggagcggcggcggtggcggccggcggcatcgggggacgtcgtcgtcgctgcggagcaagttgtttggcggtaggacgacgaaggcgggcagcaagaagtactcttcggcggcggcgctggacgatgtctacgacgcggcggagtggtcgtcgtcgtcggtgccgtggtcctcgacgtcggcgctgtcgctggactcggcgcgctcgtcgtcgtcgtcgtcgtcgacgacgacgacggcgccttgctcccgctcccgctccttgtcgtcgctgtcggacgcgctgtctccgcctgctgcgaggcgcgcgccggagaggagggggaggacgccgcggccggcggcgggcgtggccgcggtgatcgtgtgcctcgtgatggtgatgctctgcggcagggtcggagccacggcgctcgtctcggcggcgttctaccttttcccgcggcggtggcggccggtgggtgccatcgaggcggcggagagcgcggcggcgtcaccggagcatgactggccgtcgtcggcgacggatcaggagacgacgacgaagaggaaggtggttaaggaggggttcttggcgcggaactgcaagaagtgatccatcctttttttttcctctcctttttttttgaagagaaagaacactaatttccttcaaattttttacctcgagagttgttgtaattatagaattccagacacaaatcaaataatcaatcatcaaagtatcaaactgatcaaacataattgccttgtagtgcgatgtatttttgcccaagggaaagatttggagatataataatatcttagcttgtctcagtgacgcaaagtttccttcttgagtttaccacagtgagagatagagaggtcaagaaagcaactgatggtcttctcgatttttttattttttttaaaaaaaaagaggaacaaagaaaaaaagcaacgcatgcatcgtgcatgcacatttccattgcgggcgccaacaaattccttcatgcgtacgtgctgtatccatggttagctaattaagctagtggatcgagatggaactttatccaactttgcaataatgcaagaacctaaatagtctatattactcctatatgtaagagtaactttggggcagcttacaaatgattggcactttaaatcattattgtattcatcttgtatgttatatagtctgtatgtcgacagaggtcacagttgtaaaccattttcattattaaaaagagtccaaatcacccctttgaactattgagtgagtacaaattaccctcatggacccgaaaactagatatctttaaccctcgactattaataccggacaaagaaccccctacccccaagcattgttctgaagcggttttgacctgagattgcacacatggcgtcagcgtggcaatccaatcagctaaaaaatagaaaggaaatccatggacgcacttgtcatctctctccctctatatatcccctcccctgccttctctcccctggtctctctctctctctctctctctctctctctctctctctctctctctcggggaggcatacccggaggtgggggagccgggaggcattcgcggcagccggggagctgggaggcatccgctagcttgagctcctccgcctctgccgctcgagttacgccccgccctgtagttgtgcaaaggcgcgtgcgtccgatgctcgcctatgccatcgagtcctatcctccccgctactaga

SEQ ID NO: 35918 - DNA, 2270 bp, Oryza sativa
gggatggagaagagagaggaagtgatgagagggagaagagaggatgagagactgacaggtcgagcccaccaatttaaaagaaattgtagaccagattactatgtacgatcaaaactattatggatcgagtcagtgggataattcatctggttttaatagttaggggtgaaagatatctggtttttggtatgaatggggtaattcgtactcactcaatagttcaggagggtaattcagacttttccctaaaaaatatagttcgtgtttgccttgtgatatctttttttttttgcaaagatatatataatggattattcgaaatgataggtagtccctaatcatggtaaaatcatgttgaaagaaaaaagaaaggcaacttatttttgtgtgtgtgtgtggaaaaagaaaagggcatatgttctcccctttgttcatttgtccagacaatattgaacgggaggctttttattataaatataaataaacagacccctttaaatcttgctacctttttctagaggaaaataataaatcttgctattttcacaagttggtttgttaatttaatcatgtacttatgttattgtggcgcgcaccgaatgatgtgatgttgattgtatgctctatgattttggaacatgttgtatttcggctaccagcctagtggtaggagtatcaatatattcttgaaagtaaattgttgagttaaatcgttagcttgttgatttaacagctaccgccaaaatttcaattttaaaagttagattttgagttttattcatcgtagtttattttctagcattagtttttaaatcgctagaaaaatatcgatgtaaaatttttatccaaatattattttgttgcttcgttcatttttttcacaagccgaggagagaacgatgagaggttcgtttgctgataatacataactccgatagtccgatctatacattttcttgttatatctgaataagatgggactacacacctcttataaaaataaacgtgaaatttgcctcgctgtaacggtacaagactagatttggcacaggtgtttcatatttatggctaattactttttcagcagtaaatgatgtattcgtcgacggcgagacgtatgtggtgattttgttaacctcaaaatttaccgatccagttttcgaagatattgtgtgcatgtatatgtttattggggtgagtgtacatgcacgcgcttatatgagctttcatgtttgtactatatatgtttaaaaaacaaggcaattaaacaatatatatatatatatatatatatatatatgtatttatgtctaatttggatttaaattggcaccggcagacgccagtccaaagcagggttagatgtgggttctcatgaacctagtacgtacgtagcttcatgccttcatacacaaagaaaataatagtatacacactgagtccttgttgatagctatgaggttttggaaagtggccatctccattttcatagctgaaaagctgctttattgcttgggcaatgataccaggaggcagcattatagctgttataaccgtagcttcgttactaagaaatggagcagaggttggattgcattgttaaaccctaaaagccatggccctcgaagtattaaactaaagccgttgttttctgagcttcagcatccatccatccatgtgattatttatagattgccaaagttagaatatacctgatgagcatgatcaaccgtaaagatggatcagcctcgtggaatgcatgccgtacagctaactagcatgatcgtttacttatgggttgagatgttccaaacatgcatgattctcacgtgatcaatagtcacaaatatacctaagcatcttgcaggtttgtcaagcatgtcctatctcaaaaatgaaaggtagtcaactaattcagcttggttggatctacagctgtattcagatgcaatatatacctggactaattagactcaagtcgtggttttgcccatgatgcggaacaagcaacattaatttcttcatctgaatcgcatctcttcatgaattgtagagaattctagcggaattggtggcatgcatgttttgtgtaacatttgttctaaaacttagggcatctttttaacgcaggaattttacgaaatttacacatgagtgattcaaattcctataaaattccacaggtcttaacaattttttgaatttactgctatgaaagaaagcataagtgagactaattaacattatgctgatcatgagaaagtgctact

SEQ ID NO: 35919 - DNA, 27969 bp, Oryza sativa
  unsure (1)..(27969): unsure at all n locations
caggtgtactgtggatggaaatcataagtcagattagttatagtgcaattgtacttgtttctgacagccgaatgcaaaagtttgaatcccctcacaaattttcggcatttaaatgtttgctttttcccccccttttgtttatgtattttatgttagaaaactaattataacttgaagaaaataagagtaacaatatgtttaaccaagaggttaattagcaattttttagctgaaacatcactcaagacagtaaaaccaacatcaattgaggattgagcacgttctgtttccattcatgagaaggacctaacaacagttgatgacatttcatttgattcatgtcaatttgtccctgaaagttggaagttgaaacactatgtaacagccagaaaaatttacacttggattcatcataagccttgagcatcatgatataatatagataccgacttgagactaaataaaaccaaatacacgatgagaactatcacctaagtttacaacaacccagttgcacttgcacctatcacccacatatggttgctgccagcgccaatacaaattttcaggcttgatacaacaaacaggcctgtaattgcagtacagattattttcttgccggacagtccaccaattctcttgagaattttcaccatttcaattcgaatttgtgcaaaagggtatatgcaatacaactgccaactgctattatcctactgctctggtagatctgatgggacgagtggttcatgctcattagcaccatttgatgttctgtccatgccacacacctcaggagattttataggcacaaaagaggacttgtgtagagcagcaaaagccttatttccttcaccgttgcttcctaaacaaatggtatcaccccgcccatgccagacaccgcactggacattatttatctccaacgtccgagcctcctgttcattcaatgctagaaactgttagatcaataggtcaaaaaaacaagtaacgcatgttgaactgggacttcagaggggtttcaagatatataacctggcatagcgtacagcaaggacaaatgagatggagaacacagtcatctagactgctatcagtgccctgtatcaggaaaaaaaaagtcaaggaaaagaaacgaaggtgcacaatcagcttaatcacaaaaaaagacagtcaatgagatggctggattttctccaaactttgtgcttggcaattcctaaattgaagtgctcatatttatatctacccgtatgttgacaacataactatggcaggtattccaaagtccaaactatcaagaccagcaggatttagttttcatttgtttgagttaagcattcatagccatactgtgtgatgcaaatgaaaagaagagacaaccaactgcattaagcagttaagcactaatactaggctgcacaataacaacctgtttcaatgctttaaatgaaaaatggtaatgccaagaaatacgtaccctgatattgaactgcttcctgattcttcttcggaagtaaccagtatagattgctatcaagagaacagagctaagtcccatatacaaatatatattatgccttgtgacagaaaaggcgattaggctaaccagaatagccactaaagaaattaagtaaaccatggcctgaaacaattttaatcttctgtcagatttatgaacaaaggataatttcaagaaaattgatgcacatatgtaatatagagtgatgcaataaattccaataacattttttacataagaactgagatagcaatttatatttagtatttcaagactgaaatggctattaaatgagtaaaatattggcaagtccaacgtgcagtctgattcacagtaccatataatataagtaaagaacatctcactagaacttatcctatacagaatgaatcacaatttgaaataaaaaaagcatgatgcttatcaggctgactaggtttaagacatgccacagacatacataattgtgtaagcaaatgtagcacacattgacaagtcaaacatgtcctgcattaacaactcaaggataggactatggaaaggacgactttgctgataagggcccgcatttcaagaaactgtcagtggtataacaagagaaattacaacataaacctatggcttgtagattacatgtaaactaaagaaagaagcaagaaggtaaaaatacagaaatgcacagttcaaaatacacaagtacacaacaaacatttttttctcagccctaataggcaatacatcagtgatgaaaaaatctattcggtgtaataatattcaccagtggtaatggtacattctaaaattgactcaaagcatgttccaaataggaggttttcctagttcctatcaatagcaatagcaagtaacctcaggtggttttacatgtttacctcgagagcagtttttgaccagaatcttttcaaagaaaaagtacaggtagaaatggacgaatatggacatatgatggtgagagtgttatccttacctgaaggaagcaagatccaagattggctctccgcatgttcttgccgaacctgtagcatgggcagctgcagatggtcgcaagcaaacgacttcaaaaacatcgctcacgcaaagtttaatggtaaatatttaaatgtacagcataaaagaaaaaatgaaatattttgcagaaattagatcagaaccacagaataggcaggatgcctcatttttggggaatgttccctgacaatttatcatcccaaatatgcctgattccgagtttccaactacagatgtgcctaagattttttttttcaacagagttaaaattcaccaaactgtgacgctggtttctaattcaaattaatcgaaactgaaactagagagaaaaagtaagacttcaagcaaaaaatttcctccttcatctccatgaaccttacaactccaacgggaaaagcccaccaaattagagacaaggaatcggatttgaagctctgtcaaatttgaatagtgcgatttccagcaccgggctccccttccttcttttttttttatgcattccgaacaaaggcagcgacctttctttcccaaatccgcacaaaaatcagtcaatcgacatgaaaaattcccgctaaaacactaaatcccaagcttccccgtcgcgcccagcaaaaaccagattccaatcaaacaacagattcacgaaaacgaggaggaaaatagtcacagctccacctaccacgcggcctcgagcgcgattcgcctgtcctccaagcaatccagcaccacgtccccttcccacatcctctgcacccctcctcctcctcctccgcctcctgcaccaccggcctccaccgtggccgccgccgccgcggacgaatccttcctcctctccgacgccagcgccaccgaggcgcacagcatgtcgaagtccagcaccgtcatcacctacttctcctccccctcgctctactgccggctcctcgccgccgtcgacgcctactactcctcccgaccggcgtggccattctctctccctctctctctctctctctctcctttctctctataaagccgcttccgtttcgtatttgcctcgggtttttaacggcctaagcgcctccgattaggaggagaagcgaagggagggaagggaagagatataacacaattcgattaattaattaattgattgattaataattaatcacgggtgcgcgttagaattttttaactaactgattacatgacaggtgggccataggaaagcgtggttcgcgcgaggctgccactgcggggcccacgagacagtgagataaggtggggaatacgtgggtacgcgtaggtcgggctgccttagcaatcggtggttaaaccgggtaattagtactagtagtaattatgaataattaacacgagggggatcgctaataataatggcgcgtgattgggtggtttattagtggttggatcgggcggccaagcccacccgccagggccagactggtggtgggccatgtgggcccacgtggcagtgggagtaggtggcggcgttcctatccatcggctcgccggcgctccggggcaccaaacgtgtacctgagaatttgcgtcatgaaaggcacgtttgttttttttaagttcagccgacatgttttgcttgcgtatcctgaacaagaagttagttcttctgccaaatcaaccggaaatgaatgttcttctatcttggaggtatctttgtttcgtggttttttgcatgttcatgtgattaatagtatgcgtattagatttttcaccgaaaaagctgttttggtctgtagattactaaaactacaagggctgtgtttagttactttctaactttcaaaatttcttcacatcaaatatttgaacacatgcataaagcattaaatgtggacgaaaaaaccaattacatagtttgcatgtaaattgcgagaagaatcttttgagcctaattacgtcatgatttaacaatgtggtgctacagtaaatatttactaatgacagattaatttggtttaaaaaattcgtctcgcagtttacaggcggaatctgtaattttttttgttattagtatatgtttaatactttaaatgtgtgtccgtatacgtcaaaaaaaatttggaggaggaactaaacacggccaaaggatgttgcttttgcagcttgccttgttaattattagttttattgttagaaggtccattctgccaatcatatcttgacactgaattattggttcaaccccccctccccccccccccaaccccgaaaagaaaaaaaaagatgactttaatttgatactgcatcattgaagtctaatgtatggttcagagcgatacaagttcctgtctgtatgatcgacccgtaaaaagtgagatatgatttgccacgatctttaaaattttttagggttatgctttcaaagttgaaattcggccattaataactcatagtgcaatatattactataattaaaaccatgattatttgaaaatttcacccaaaaaaaatcttcctatatgttgcctaccaagctattgatacaaaacatagaggtgtgttgcatgctggaagacacttggggcttatatattcagacagggcatattacgtaccgtgattagaggaagtacaataacagattataaaagtaagctataaacacatattgagaagataacagatttgtagcgaactacagtacagactctaaaacacaatgtgtgtatgataggtggaacaatatattaataatgtaatatatgtttataggaaactattgtataaattgactattaaattaactttagatgatttaaagctaatagttagctatactattaaaattgctcttactccaattttattatggaagtaatgactcaagcataagggcagtcacaaccctccacctaggatggtgtctatagcattaactatattgccatataggacttttagcttatgtggtactatattaattaagagagagagagtgaatagaggaagaaactggggccctgtttggaagattagcccagggctaattttaagagctaatgtttagtcatgaattggtaggctaaacattagtctagggtggtatgtttggatccatgggctaattcaaggctaaaaggtggagagagagaggagagagaaggagagaaagagctgctttttgatggtccccgcacaaaattagccccattagcaccccttggaggggctaatgttttgaggggggctaattcacattagcttaaaattagcccacctgtttggattcttgagagctaatttgaggctaaaaggtgagggctaaacattagcccatgaaatcaaacagggcctgggtctcatgcaagacacaacttcaacacgagaacctatgcactgaacactatcaagttttgtattgggagataatagtgtcttcataatagatgaagaataaatatgattggtagagaagagaaatgatgtatttattaatggcccactttaagaaaccataagttgtaaagtgtagtttctattatgatgtcttattgacatgacaccatagacactttttatggatactatggattgtgactgctctgagcctcttggctcttgcacaccgcaaaacgcgcaacgagaggtgcacgtaattaatcaatcagctttaaaaccaagagaaagtagcacacccaacgcaacgcttctcccatttattttattttttcactccatggtgttgcttgctttcgcacggtatataatggtcggcaagcgagagcacgagtgggcgagcgcgatgcgatacgggtgaagcaaagcaaaggaaagcaaagggatgtcgtgcgcgtgccgcacgccacgaacggaaaattatgggggcggaaagcgacgccatccggtggatcctagccgtgagcgcgaagtgcctcgcttcgctgtgggcctgtggcctgtgcgcaccatccgtagtgcagcggcaagtgggcctcgcgcactttgggttgcggcttccgctttgagccttacacgtgcacggatacgcatcacgcgagcgagctggcgcaaagccgagagccgatcgatcggttgcaaacaggttgggaaaccacctcggccggggttaccatgtcccggtaatataagtaaatttaccacgtggtaactgtggcaaaccatttaccgtacaaagcgtaataacacgcagttactagcggtttaggaaactctacacttgcaacagccaaaagagttgcaacttgcaacctgacagcttgtattttgctggtactttcgttgtacgtagcaggcttcaccattccgataaaaaccggttgaatttcgcggaaaaccgatgtttcgatatggctcaaaagtagaagccatatgaaatttcgacatggcttgaaacttgaaagtagaagccgtcttaaatttgttcgaaaaatactggctttccactggatttcgtgaaaatcatcataccgtcagagcctggaacggaaagttatctcggaatcgcaaaccctggtgtgtagtataggtgagaaatgctcggtcccaagttaagggtaatactccctttttctcgttataagtcattttttactattttactagttaaacattttaagtttataaagaaatgcagtgacattttcaataaaaataaatatatttaacgtcatgtttaatgaaactaatttgattacctatgttgttaaatatttttaaaaaactgattaaatcttaaaaagtttgactatgaaaaaaacagaacgacttatgatacagaattgagggagtatatgataagcctacgtctcataataaaccaacttagaatatgaagatgaaggaagcagtttggaacacactatttcaataatatttttagggattttaaggattaaataattttatatataaaccggaaaaaccgggtgtttcgacttccaagcacttgttttgagtgatagatgtgaaattaaacgtgtgccaaaggatgtaggagtaggtgtgtatttgtagttgtctaaagagaaaaatggagagcgttattgggccgagttaactgtaaagcccgatgttccttaaagggctggcccaggtgggcgaaattaacaaaaatccatatctggtggcgagcgtccgcgcgctcgcgcgcacggcggggatccagtcagccgatggtttccgccgcggcgtgcgtggtgctgttttcgcatggggctcgaaaatgctagttcgcgggcgctcgcgtgtccgcaagtgggcactcgcatgcgcgactgttggtgcacgcattgctccgccttctgctcaacccgactagatacaaggagaagaagaagcggggaaatagaagggaggaagaacaaggagaagtggagttgataagtgggctccaccatattttcatttttactgctgtcccttacatgtgggacccacttctatttttaatttctttgatgactaggctgacagcacttttggaccaagacaattacaacattagcaaaaacgcttctcaaaccgctaaaagagttaatttgcaccggtctttaaagttacgagaggcattatactcgattttgcggttgagacaagcaattcaaactagggacggcaatgggtcaggtcgggcacgagtagagcaaaatcatgcccgactcggcacccgaccttgcccgcccgaaccctgcccaacaggattaatgggcaaaactccgtgcccatacccatgcccgacaggcacgggtatgcccggtggatatccattgggtatgccttccgccttccgcctcccgtcgccggttcgccgccctcgatcgtcgtcattgtcgcctgctgccgccggctcgtcgccctcggtcgctgtcaccggctcgtcattgtcgccctgagccgccgtcgccggctcaccgccctcgtcatcgaggccctaagctgtcaccgccgccatcgtggccctgaggagccgccgccgccgtcgccctgcgaggttacgacgccatctcgcgccgccgctccctgccgtcgcctgcccgcgccgccactgcgctgtctcttgcttgggtcgccgctgtcgttgctaatccgtgccgtcatcgctagcctgcgccgccgccgccgccatagggattagaataggagaggggagtggggaataccggaataggagaggggattggaataggttagggtttctattagttgagtatatatatgtccatagttagtgggccaaatgggccaaataaatggatataaggaataagagataggccaaaattaggtcatatatatgtatgagtcgggtatggactatccgcggacaaaaaacaatacccaattattgcccacgatgttctcgggtttcggacgggcgtgcccaccgacaaaatattacacccatgtccataccaatcgggctgggtatccgtggatatctggactcgcgggcaaaattgccatctctaattcaaacaagggcaagatatgtgtgaaccaaatagactttttttttacttggtcagtgactcagtcccatggagcaaaggttagctttgagtcaagagtgtgttcggatgccccttttctcaacccctctgcctcgttttctgcgcgtacatttttcaaaccgctaaacaatgcgtttttggtttttttgcgaaaaaattctatacgaaagttgtttaaaaaaatcaaattaattctttttttaaaaaaattagctaatacttaattaatcacgcgctaataaacctctctatttttcgtgcgttactgttccggttgggatatgagatagcgaacacaaagcctttttactccacaaaccaaaccaaccaccctccctgggactgggatccataagtcctaaaccgaatttcctattgcgcgcgtctgcgccagcgaacgaagtcgcgcgcggttccggcccagcccactacacgattgcgcagtgtcgcagtgcaggaaggtcagtaggtggggacacgcacacgttcacatgcgcagataagattggattagcgtaatcaggttttgactaatcacgatctgaattatggtgaccattctttttttcttttcgcataaaggttgttttctttttattactacaaatttcaaaaacttatacataatatttaaattttcaaataaaatttaaaaccttctaaaaaaagtcatatccaaaatttaaaacttttaacttgaaagttgaaaattttcaacttaaaatttaaatgctttcttctcaaaatttgaaactctccactcaaaattggaaaacttccaacataaaattcaaaattttcatctcaaaatcaaaaactttcatattgaaattcaaaactttcaactcaaattttaaaaacttttaactcaaaattcaaagttttcatctcaaaatttaaatactttcaacttaaatttgaaaactttcaagtcaatatttaaaaaattttaaattagattttgaaaactttcaaatcaattttgaaaactttcaaattagattttgaaaactttcgactcgaatttttattgttgtattgtgaaattactgtagcgtgtgattaaatctaattaccgtgattaacgctaatctccgtgattaacgatgggatcgcgacagggttcgttctgcagctgaacacgtggaagtgcgcgcgagtaactgaaccggcgcgtacgcgcgaattagtaatccccgtcctaaacctccttcccccggctggcggctgcaccgatggccggcgacgaaatggcctcgccgtcgccgccggtggcggcgctcaccaacgacctcatcgcggagatcttcctccgcctacccaccccggaggacctcgtccgcgcctccgcggcatgcgtctccttccgccgtctcgtcaccaccgaccgctccttcctccgccgtttccgctccctccacgccccgcccttcgtcggcttcctcgaccacaggggcttccacccggcgctccctccccacccctccgctcccgtcgccagggcggtggccgacgccgcggacttcgccctctccttcctcccctccccagccggcagctggatggtccgcgacgtccgcggcggccgcgtcctcgtcgaccgagataccaaggccgagaccggaggcagcgagaagccgttggtcttcacggagatcgccgtgtgcgaccccctgcgccggcgattcctcctccttcccccgatccccgacgacctcgccgcttcggtggaccgccctgtccgcgtccacctggaccgctggtgcgagcccttcctcgctccccacatcgaagaggaggaggacgatacctcattcaaggtgatctggatggcgcagtgcaaggccaagattatcgccttcgtcttcaattcgagcaccggtcaatggctagccggtgcctccccgagcaccaccgatctgttcaatggcgccggtctgtcgccgccgccgtcgtcgtcgtcaccgagcctagtgttttcgtcaccgggtcgagtgttctccagccgccgatacgcgtgcggctgcttctgctgggggattttgaggaccatgttgctggtgctcgacacacgactgatgaaattctccattgctgaacccccaccagtctgccttgggggaccgaccgccattgttgaggcaggggaaggcatgactgggatctttgctctccgggggagcgttggtggcacgtttgatctccactacagcatttggggaaaagaaggggcgactcgtcgcgagcagatggagaagataatcccactggatcatggctaccggtattacattagaggtgcgatggagaagcacttgctgttagccaggtcgcgaggggaaggcgaagaagatacaccagaggagccagatttggaatgcttttcactggatgtcaagaccttgcagcttgagccggtgtgtgttctgaagtactacagtttacgtactgacatatataccaacttcccgccttcgttgtcgccagaaataatatgagatggtaaatttcctgttgtatcctgattatgtctttatttttcggcatagttatctcgtggcttatgatatatatctgcgtggatgatgcttgatttattattgcaatatctgctccttgtttaaacagttatcatagcgattatagtatgaaacatttgtgtggtatggggaaaatatataaaggaaaggacattagagagatttgcttgtttgttgcgcaattatattgtacaagaccgattaagataatggggcaaatgaaggagatgatcctgctacgaactgcttagtgcttatcgtggaattcaagtagccctaagttatcatttctcttccttttagttgctttgattaggagttcgatatacttatggctgatttattttgcccttcaacatgaagctactaattttgtatgacctgtgtttggtggttatttaataattataatattcagcttttttgtctagtactctagctaggtgttccaacttatatattgcaaaccacaatgacaaacacatagctaggtgttccaacttctatatattgcaaaccacaataatgaacacgtagtggtgagtgtttgtcgtgacatgtttcaattaagttgagaatgtgagatttgatataatcaattggtaagggctaaaatgagttctgaaggtgggtttttcattcattttatagatttattttgaattactaataactatctcagctatctaacataacatgttttttcctcccctgatcaatttatgaagtgttacatgtagcctattaatagtagtttgttcctttctggttcataagtcttgaatatgtgcaatctggtctgaaaggtcttattcaatatctaatttcttgggttatttgtgtcagattcagtgttcacggtgaaagaaacactagtggagaaaccatctttgcccggtcgaccaaaaaccacaatagtctcggatgcactaaaaaccaatactaaagatggtttttagtcccggtttataagtagaacgggaactacgtgatctttagtcccggttggtaacaccaaccgggactaaagatgatctttaatcccggttcacatgctgtcaggtgttgtcaggcccctccaggatctttagtcccggttggtgttacgaaccgggattaaagatcaaaacgcactatataatccctgttacttatcctcttttctcgtccactcttttctcatccacacccactcctctctccctccatctctaatcttatctcttcccttcctccttatctcttttccttcttatcccttcccaactccccttcccaactcgatccagtgtgcgcagcaggagggggtgggcggcccggccagcggagggcagcgcggcggcgcggcacggagggccgcggggcggcggcggccggggaggccgcagccggctcagccggccggcggctttgcttagtttttttttctttttttttcaaagaatttgtgatccatgtgtagattgagatgaagaatctgtggttcattgtatggattgagatgtataatttttttttgaatctcatggtatggatctaagatgtacatgatttgtgtatgatttgtatatttgggacgtttctttgatttgggatgtataatctgtagtgtatatgattgatttgtgtatttgggatggtacgcatcccacctaatacccgggactaaagatgggagtgggcaatagtttttttttatttacttactatttaatctctaatttagtcccacaccaactgggactaaagatcgatctttagtctcgggtatttgaaccgggactaaagatagggatctttagtcccggattcatagtcccggtataaaaaccgggactataggagggttacgaaccgggactaaaaacaatttctccactagtgaaacattgcagttcttcgagctatagtgcttagcgtgagccgtgagattggtgaatgaattgagatggtatgccagattttcatattctcattgttatattgaactgcaaagcaatatcgtattcttttggtagaatgatagctgctgtggagtttccagttttagggcccctttgaatcacagggttaaaaaaatggaggaataggaaaaacacaggattctgataggaattgaagtgtaaaacagaggattgcaaaacacaggaatggtcgtttgattggagcgcaggaaaaacacaggaatcggatgagagatagactcaaaggaaatttttcaagaggttggagctcttgctatatttcctccaaaatccacatgcaatgtgccattccataggaatttcatgggatttggaaagcttcaatcctttgaatcaaatggacaaatagaaaaattttctataggatttgaatcatatgaaaatcctacataaatcctttgattcaaaggggcccttattgcatatctgctatggttattgaaactttgtatagctttgatatttatgtgtacaagatatttaagctaataattgcatactcccttcgttccaaaataactcaacctataattggatgataggatttgacctatcctggaacaacaattctggacaagcccttccgagctaggttatatcctactctaggtgtgtgttatggttctaagttactccattttggaacagatggagtatctgttatggttattgttatggttattgaaactttgtatgacttggatatttatgtgcacaagatattaagcaaacaattgtgcaaggtctgtactgtttcagcagtttgaaattactcggctgtatgcaccgatgacgctagtcatcttcgacattcacatatcgcctctaccattttttttaagtattctgatgtttgtctacttacttggcttgaatcgggatgagttcttaagtattctgatgtttgtctacttggcttgaatcgggatgagttcttaaaatctactctctccgttccataaaagaactaacttctaactactccatcctttcaatattactagaaaaatgtccgtgcattgcaacgggtgaatgctattttaattttattattgttatacggtttagttatgttaaaattcactataagaatttgcttagattttttttaaaaatacatgaattgtaattcggagtccgactttcatcttaagttagcatgtggagttttttaaaagagattttcttatacgacttcttttgtagttccaaaagcaaacgagcttaaaatccaactcaaacacagatatgtatttccaaaagcgaacaatcttaaaaacgtgggcttcggagcggtggggagctggcttcggagcggtggggaagtcggcagcggcggcgagagcgcgagcgatgggagcggaggggtgcggcggctgggcgggctcgaagccgccgaggtggacgaacccgaggaggagaggcgggtggtagacggagcggtagcagcggaggaagtggcggccggcgatgagtcggcggaaggagacgtaggcggaggaggcgcgggcgaggtccgcgggagagccgatacagaagaagatctcctccaagagctcgtcagtgagggcgggaagctgacgcggccatgaaattaataggatgccacgtcctcatcctagatggaacaatcacatcatctcacgggtgaatccattcatcgatagtatggttttgtgaaactaaactaacaaaatatatgtacttaagtgccaagtgtcaaaatatgtgtggttttctgcatcttaaaccatagaacatgtagttttgtgaaatttactcttttaaatatgtagttctatgataactttaatattaaatctatagttttataatacataatattaaatatgtatttttaataatgttttgtgttatgatatattcgagtaggcaaaatctaattcgcgcgcgctctctgttttgccttatcgcgcgacacgctcatcagccgtctgatcccacaagcactggtgcgtccatacatggcctggtgattcatggacgtggcatcatcccgaggagtccaaattggaagcccatacgatgctctacgctacgcaggcttcaaaaataattttctcttaaactaatcacccgatctacgattcgattataccgttgtgttcgtaagaattgaatctttataacaagatcttacatgattatattttaatgaaaaattaaaaattacttttataatatatctaaattacttttagatttcactaaattacttcttagacccataaaagtaaattcaataaagcttaaaagtaatttacatatattataggagtaacttagaaaaaaaagaaagcaactttatcacgacaaagcaactttctaatttcagaaaagggctcatcattacttaaactgtcgttctcttttctcaacagaatagcgaaaaactggcagtgtgtactacaacagggtgtgtttgggaggatctccggcacgtaaaacaaagcatacattagtacattattaaattactccctccgtttttcaatagatgacgccgttgactttttctcacatgtttgaccattcgtcttattcaaaaattttatgcaaatgtataagatataaatcacacttaaagtactatgagtgataaaacaactcataacccaaaaataaattataattacgtaaattttttgaatgagacgaatggccaaacatgtgagaaaaagtcaacagcgttatctattaaaaaacggaggtagtattagcttaaaaaactttaaaaatgaactaatatgtttttaaaataactttcttatagattttttttaacaaagtgcattgtttagttgtttaaaaagtgtgcagtgaaaaaagaaggatgtgaagttcgtaaagtagacttaggtggtatttggatccagggacttaactttaatctatgtatttagacactaatttagagtattaaatatagactacttacaaaactaattacataaacgaaagctaatttatgagacaaattttttaagcctaattaatccataattagagaatgtttactgtagcatcacataggctaatcatggattaattagacttaatagattcgtcttgcgaattagtctaagattatggatgggttttattaatagtttacgtttaatatttataattagtgtccaaacatccgatgtgatagggacttaaaagttttagtcccatctaaacagggtcttaagaacacaaccctgatctgctactagtacacagcaagagggttatccatataaaaaaaatatcagcacactagcttatgtggtcatatgaaaagggaacaaactaccacaaatatgaacatttaaccaggaaatggaagtaaatatgcttattggatgacccttatcgtgtttaatcaaatttgtattagttttttttttgcggggaaatttgtattagttggctgttggatgggaagaatagatgatttgctcaatgccaatgagataattgatggatcatttgtgattgggtgatgcacaaaataagttagcagggataccgtgctaattaaggcatgtatatagcttaacaacatcacaggctacaattcggtgtggcaaagtcagtatagaaacagaatggcagcattccaacattaagagatactaacacaaataatgaaataagggctcgatagtgtgatgttgattgatgggcatgatggccgattttaactatcgctggaagaaaccctcgcgcgcgcgttcaaaccccttaaacggctgaaaccaaattaaaccgtctaaaccgggggtatccctgggtttgatcggtttgctgcgggaacccggcccaaactgcgtatgaataggctgaataaaaagggctaaacatagactatattaaagagggattgttgatgcagttgcagtagtacgttccttagaatgaaaggtcaaaaaagacattgtaaacctctagtaatcccctcataacacaaattaattttcatagttcttgcaaaaagatatggccaggaaaagagcaagcttaccgcttcatatgcttggtgatgatagagatggcgggtagccaacatacaggaatgacagcgaaggtggaacaccactgatcaccctacggacagactcaagatacttgcaacttgggtttgtgctgaactccagcgaatagcacccgcgcgcgaaactcggaggaactttcaagaacaactccctgctggtcgcacccaggatgccgaattcgtcgaaaggcacgaccatggcagtctcaaaactccatttgccggcagcagctttcccttcattttgcatctttgcagaatagatctggagtgcatagcctgcgatgtaattacggaaagcgaacatcccaatcttgccttctccttcctctacgatggcgcattccacaatgtcatggccaggcgcgctcgatgggagctcgagaactgagaaatccatcctacgcatgtcgagcacaagcagattcttcactgagtcacccatcatccagtagaagcagccgtatgcgtagctgcgccgcgacatggagcggcaagcggggcgcgagaatgcagggctcagatctccccagcagacagatgcagtggctcgccattgcccggtgactgaagagaagacgaaggcgacgagtttatctgcgcactccgcaatccagatcaccttgaatgacgtctcagccaccgccgccacgcactcttcttcaccgatcggagcgaagaaggtatcgccgcggcgcgattgacggagggcggaggcggcggctaggtcttgaggaatctgggggagaagcaagtgccgccggaacaaggggtcgcacacggcgaggatcctcgaggcggcggcggcgccttcttccacgacgtcgcggtcgagcaggaagcggccgccgaggacgtcacggacgacccagccgaggggatcaggggaagggaggaacgagaagccgaagtcggcggcgcggagcacgccgcgggccgcgggggcggacgggtggggcggctcggcggggtggaagtggaacccgccggcgccgggtgaggcgccgcagaacccgaggagcgacggcggatggagcgcgcgcgcgcggcggaggaaggcccggtcggtgacgacgcggcggaaggaggcgcaggacgcgcaggcgcggccgaggtcggcgagggacgggaggcggatcaggacctccgccaggaggtcgtcggggagggcgtcgagctgacggtgcgccggcggcgaggccatcgcgacgctaaggctagctagtagctacccaccggcggccgggttaattaggtttccgaggaacggcggggattgtggtgtggacgtttgggtccttcactccttccttccgctttattatccccacgaggccacgttctccacgaaaatagtcgaaacgttgcgttgcgttgcgttgcgccttgcgcggcggaggacacgagcgatctccacgaaaatagtcgacgaaacgtttgtgttgctcggtggcggcggcggcggcagcgcacgttcttaagagcgagtataacagtaggctataaatcggctaaatgatgacgtggagaagagaagagaggagagagaggggaagcgggttgtaaacttacagccagcttggatactagaactaagaaactctgtgagagagacaagtggaacatgtattaattgtaaagagctaagagtatcaccaacagtcctcctataatctccccccaaaaatttgtttttaggtttcctaaactgaaaataggaagtaaaaaaactcctccctccaacagatagcctaaatttaatccccgaaaactaaaagtgggtccttctgttgaactaccaacagaaattttcgtttttcccctcccacgcgcgcacagaaagagatcactatctcagtatctcccacacgcaatagccggccgattctccactgcgcgctccctgccgctacgccgccggccgatctctccacgcgcgccgtgctcatcgccgatccctacaccatccctgccatctccccctcctctatatcccccactggtgctgcccatctctcccttgatctactcgcttggccgcctctccctacacaccctcgtcgtgttaaagaaagagatgagtcctccaggcagtctcgttaagatgctattggatgatgagtcttcgtcggatgacgacgatgaatttatttttgaggcggtcgaaacaattttcgatgataacaatgaagaaccaaagcgaggagggtctgtctttggacatgcagtgattaatcgggagagattggctggtcattggagactatacaatgactatttctcagaagagcctacataccttcatgttcaatttagacgcaggtgggtaatagtgaattgtatttttttttaatcttgatttgaattagtgatgcatgtattaattttaattgctaattatttttcaggtttagaatgaaaaggacgctctttttacgcataatgaatgctgttgaagcgcatgatgattattttgttcagaagagaaatgcggctggtatcattgggctatcatgtttgcaaaaggtaacagcagtgtcacgtatgttgtgttatggaatagctgcagatgcagttgatgaatatgttcgtattggaggtagtaccgttattgagagttttagaaggtttatcgtagctgtacttgatgaagtttttggggaggagtacatgaggacaccaaatgagaacgatatagctaggttacttgcagttggagaacgtagaggatttccaggtatgctgggttctttagattgtatgcactgggagtggaagaactgcccgactgcctggcatggtcaatataaagggaaagagggagttcctacctcagttttagaagctgttgcctcgcatgatcgatggatttggcatgcgttctttgggttacctggaactcataatgatattaatgtgctccaacgatctccattgttgctcctaaagttaattacaccattaacggacacaactacactatggggtattatcttgtagatgctatttatccttcatgagcaacactggtgaagagcatccagatgccacaaggaaataagagaaaatattttcaaaagcacaagaatccgttaggaaggacgttgaacaggcatttggggtgttgcaagctcgctttgctattgtccgtgggccagttcgtttttgggatccgttgactatacgtcaaattatgagatgttgtgtaatcttaaataacatgattgttgaggatgagcgtgatgacgaggaagatttacattatgatgagatgggacaacaggcggatggttcccatgaacgtacggctgaatttaacgagttcctcgcaaattacgaaaaaattaaagacaaggcagttcacaatcagctacaagaggacctcatcgaacatttaattgctaattgatggaatttaagctaaatttatgttgaagccgaacgacgacttaaaatactagtcttgacacttttatagtactcttgctcctcgattgacatcgcacttgtatctagcctcagaagtctatcttcttctatcatcctcttaaaatccaacttttctttctccaaattaatccgttgttgttcaagtgcaagtgcagctctgtacctctcctctctttggcgctccttctcagcatcggcctctttcttcttagcccataaatgatccaaagcatcaattttggattgatctgagcgttgacgctgtttttctctctttcttcctccctgcaggtcttcccgaaggctgcacagcatcaactgcaatagggtcctctttctcttgagggacacagttctgaggacctgaaggtgcagacgtagcaggtgtagactgcacattggtcttctgcttcttatttgcattattttgacctgccttgtgaattcaccaatcaatccactttggctgatccttcaaatatttgtagcaatgcatgaactgaaaagtcctgtttttttcgtcttccttcgtatacaacagcccagcctgcaaaagctgaaaaaagaattgcaaaacaaagttaggctaaaaagttaacaaataaatgattactaacaataacatataaaatagattaattttcaccttgtcctcagcattggcaccactttgaggtctattctcgatacgacttacacaaccagcaaacgtattgagacactcttgtatagtggaccaacgatgcatgagcgaattttgggagcgatctgaactaaagtatttgtttgcatgaaaaaaatcacaaatacggttccagtacgcactccgagattgatcggcaccttgaatagcatccatactaacattgacccatgctgacaccaacaagacatcctcctgcatactaaaattcttggaccttttttggttaggtctcgcagatgcttccccttccccaccttgatgcactggatcttcgggtaatcgggttggctaccttcagcactccaattgaaagtattgccaccctcattcatcaagtttgtaaaatacccatcctccatgcttcctgttcatggcaattaattcatcacattactcaatatgtacttcgattagaaatatacaatagaatttcatgaacaataggcaccatgtaattgcattgccaaacatatgcagatgcatgtgtggtaaacgatgacacactgaaattttcattttctgagagcatgaagttatattagccacaatgacagtatgaaattattttagccacagtgatagctgcaaccaaactgctggagaactaaagaaattttgtgagagtatgaatattagtttgacagacacaaagtgaaggtcatttggcagattgctacattttcatcaatcagcattcttggcaaattaactcccaaaaatgtcatagcaaaatgatttgtatttgtagttctgatcaaacatttaaaaaaattgcattaatttttctatacagcatgtacattccaagaaatttgcactagtttgtcatcaccaatcattctaatataatacatggatgccacactttgtaatactaaacaataccagtgattacttgcaacaagaactcaggcgatagagcatttcaatgtaattcacacaaggacaatttcatgaacaagcatacggtattagctatcaattaccttgagcactgacaaaattagtcacgggcacaccaaagtagcttccacggttgaactcctcttcactagcagataatccgtggcccaaatcaacactggccgagtcgacctcgacaggatccgtcccatcggcgtctgggatggtcacctcctgcacttcttcgtcgatctgctcactgggttgacgaggcggatgggtaggacttggaggcgcaaaccctacaatggagggagccatcaccggggggcacagaggagaggccggccagttcatcccgtacggcggcagataaaaacgtggtggcggcggaatcagggaagaggaggaaacagctgccgccggacgagccgccggcgggcgcgacgccgccggccgtgacgtcgccggccgcgacgccgccgatcgtgatgccgccgcgaggggctgcaggtacaggcgccggcgggcgaggcgccgctgccgggagaggcgctgacgggcgacgcgacgccgccgggagaggcgcaggcgggcgcgggcgcggagaatcgccaggcgggagcatttcgccttcgcgcgggaacgagaggagagaggcgggagtgcgagattgggagcgatattcgcgagaaaactctcccctacataagccgagcgaggaatcgggagaagggagttccaaaactttggcaggagagtaagggatctgttggagctgttttttagactaaaatatctcaaaattagttttgggaatcagataggtggactattggtgatgctctaactattactcccttcatttcaaaatatttgacaccgttgactttttagtacgtgtttgaccattcgtcttattcaaaaaatttaagtaattatttattcttttcatatcatttgattcattgttaaatatactttcatgtacacatatagttttatatatttcataaaaaattttaaataagacgaacggtcaaacatgtaagtcaacggtgtcaaacattttgaaactgagagagtatatgaatagactaaaagaaggctaacaatagccaataggtcagctgtactgttacccttactctaactgtgggatgtgggctgccgatggtcgtgctctcaaaaggcccaactctttccggaatggctgggttttgggttggaggacgcgcgcgcacgaatgaaatggtccggtggctccgcagtccacacgagtacacgacacgaatagacaaactcaccatacatcaaccgtgtggtgcttgcctctgctgctgctccttccgtaaaaaacacaaaataacggaatgtgacccccttacaatgaatgtaatccagattatttcatagcttgattttcttttagaatgaaggaagtacaatgtaacaactgatggaccaaacctaggcggtggtcattgagcagggtagcttaccttgatctactttaaactgacatctaagagcaagtttaatagtatagccaactactgacttcaaatcatctatagctaatctaatactccatccgtttctaaatatttgacgccgttgacttttttaaacatgttcgaccattcgtcttattaaaaaaattaagtaattattttttttctatcatttgatttattgttaaatatactttcatgtatacatatagttttatatatttcgtaaatttttgaataaaacgaatggtcaaacatgggctaaaaagttaacggtgtcaaacatttagaaacggagggagtagctcattcatacaatagttaactataaaaatatactacaccattaatactcagtcctacctctcatacgcacataacgttttggagtccgtgctgcagctggctataaatctgtagcccgctttcttctctctcttctcttttcttctcgatatgtggttatagctagcttatagcctgctattgtacctactctaatggaagtactctctccttgctcgtaaagaaaatcattttggaaagcgacacggtctccaaaacataactttgacttattgtttctataaaaatatttattcaaaagtgatatatgtataattttatgaaagtatttttcaagacaaatatattcatataatttttgtattttcaaacttaacaacttgagagttattcataatttatattcctaaggtttgacttaaacattgttctaaacgacttcctttacgagtatgggagagtacaaaactagttgcaatgatggttggtttctagccatactttatcaccacttgtcaacaataattatgtcagtttaaagtagaccgagctaagctgccctgcttaatgatctcctaggtttgggtcataaggctcaagaactgatatttatattatgtcattctttatactttggtatctaagtttaaaaaacacgtgcgttatatattttaaattgtatgatttgtattattatcatgttattgccgtagcattagcataggcgtattactagttgcaatgtagtagcagaggcaagcatctcattgttgatgcacgcgagtttgtctatttagtcgtgtggagccaccggctgtcgcgcgtgcatgtgcatcaagtaaaccgcatctgccgggtaaaactggcggcgacctatgcggcccacacgcccatttaattcgcatgcgggggtgtcctccagccgccaaacctcggggatttcggcagacgatctccttgtgatggcatctgccttctcccactcaataacacaactgttactgtatcgcaagcagcaagcgctaaaagagaaacaagcggagcggtggcgggacctcgggggcactggcggatggtgtcctcgtggcggtgctgctccttccttcgccatggcccgtgtgcgactaaggccgccgatagcacgtcacgttggagggagatgaagagaggggagagactgacaagtgggtcccacatcatattttacccagatcgttacacattggcatgttacatgggcaaaagtggtaagtagttaagaaagtatatctttagagtggtaaaagaaaatattaagagtaaattaaaaaaagcatttagataattggccatgccaaatagttaaatttccccacgtatagttgtcacgggctctcggtgcacggcgccaccactgcctcctcataactagagatggcaacgggtgcatatccatcagtttctcttgccccacccacacccacgatggctaaatattctcactgaaatacgcacacgcacacctgttgcgggtaaaaaatcgtcaccatacccacacccgtgcgagtatcgggtacccatacccatataattgacctgtagcatttatagttttgtattgtaatcaaccatattagaagtataaaccgtcgatattttcttttgtaacaatgttattaacattagcgttcaaatacgagtaagaaaaaattatacaaccacattacataatcaagaaatcaaataataatttcagcttaagatctaaaagaagttttatgttatgataagagttagaatatgagcagcagtaaaaacctatcgggtgttgaatacttgaatatcgggtcccattaccatctctactcgcaacgcaaagtttcgactattttcgtggagatcgtgtggcctcgtggggagtactggagtggaagaacccaaacggccacaagaaaccgaaaccggcggtgggcagcgtcgcgatggcctcgccggcgcggcggtccgggcaccgtcggctcgacgacacccaggagttggccctccccgacgacctcctcgcggaggtcctgatccgcctcccgtccctcgccgacctcggccgcgcctccgccgcctgcgcctccttccgccgcgtcgccaccgacccggccttcctccgccgcgcgcgcgcgctccacccgccgtcgctcctcgggttctgcgcctcgcccggcggcttccaccccgccgagccgccccacccgtccgcgcccgccgcccgagccgtgctccgcgccgccgacttcggcttctcgttcctcccgtccccgctcagctgggtcgtccgtgacgtcctcgacggccgcttcctgctcgaccgcgacggcggggaaggcggcgccgccctgaggatcctcgccgtgtgcgaccccctgttccggcggtactcgctgctcccccagattcctgaagacctagccgcctccgtccgccggcgaccgcgccgcggcgtggctcccaacggcagattcgataccttcttcgctccgatcggcgaagaggagcgcgccgcggcggcggtggctgagacgtcattcaaggtgatctggattgcgcagtgcccagataagcttgtggcctttgtcttctcttcagtcactggacagtggcgagccactgcatctccctgctggggcgatctgagccctgccttctcgcgccccgcttgccgctccctgttgcgccgcagctacgcatacggctgcttctactggatgatgggtgactcagggaatctgcttgtgctcgacatgtgtaagatgaatttctccattgtcaagctcccatcgagcccgcctggtcgtgacattgtggaatgcgccatcgtagaggcaggagaaggcaagattgggatgtttgctttctgtaattgcatcgacatttatgcactcgagctctattctacaaccatgcaaaatgaaggaagagttgccagcaagtggagttttgagagtgcaattttaatgccttctcgggatggatttcgcgtgctaggtgtgactggcaaggaattgtgcttacaagtttctcctatttgtgtgagcggatgttatttgctggagttcagtacaaatccaagttgcaagaaacttgagtttgtccggagggtgatcaggggtgttcgaacttctctgccattcctgtatgtcggctacccaccatctctatcatcaccaagcatatgaagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35920 - DNA, 3018 bp, Oryza sativa
atacatgagtaaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcaaaggacatatgtcccaattgacaatgttttagaatcaatttagcctcctcttcacttgtgctagctaacaaagcactacatagtgctttgtccgtccctcttctatccagataccacaacccattatgcctaacaccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaataaagtcgccaagcactggtgttttcttcttcactttctgaatacttccccttatttcatcaacttcttgagccactttctcaagtatttgctcaactccttgaactacccccatggaagaccaacctaatcttctaggatactagccaaatcaattaataggagtaacaacactactcctcagtttctcaccaaaaacagaacagcaccagtagcactacttcctcccagcagcactacttttcagtttcgcccaaaacagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaacagctgcgcgtctctcagccgctgtgctccctacagcttgtgctgcaccaaatccttgcgcagctcaaccagcgagcgtgcgccctgctcctccttcacgctgctcgcgttgagaacctctgcagcagcagtcgccgcctccgccgtcgacactgccgctccgcctccgctgtccgacgtcgccgctccgcctcagccgtcgacgtcgccgcagaacccctctggtcacaacgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacaggtgtgccaaggaagattattttcagagaagcgggctctgcgagctcatcctcgataggggaaaagagggatctgctgcacccgacagaaccaccggtaagaattgatacttttgatggctttgagtcaagagagagaaaaggggatgaaggtgtggatgcccaactagcagaacaggccaaccagatacgcgtgtcggacatgaatagttcccagcataaacccataaatactgataaggggctctctagagatttgattatggctgaaagagggggggagctgttgccaatcccttcaaatgagatgataccggctgtcagggatctgagcgcttatcaggactcgttggatgaaggctctatggatgaaacaagcagtccgagcaagaggaaaacaggcagtttgtcagatacaaagaagacaggcattgttcagcaagctttgttggagtacaaacagctagaggagagcacagctcaaagcaagaaggacattgagtccataggacggtcgctaaagagactcaggaaggatggtggagcaacaggggaggtgactggcttggaagctaccagcgctggggctgctggttcactggcgagacctagcagggtcccgccagggacaatgagttgcttggcttggaactgtcgggggatagggaacccctcgacagttcgtgaactgtgtaccttagtcaaggacactagttcccagttagtcttcttgtgtgaaacaaggcagcgagttgagaaggtaagccgcctcagtaaaaggttgggtcttagaggttttactggtgttagtagtgaaggtatgagtggtggtttggctttgttctggcacgaatctgtcattgttgatattaaagatgtgaatgcaagatatattgatgcgtatgttcgtttgtctccgattgatcctgtttggcatgttacttttgtgtatggcgaacctcgggtggagaatcggcaccatatgtggtcgtctttgaatgcccttcgacaatcgtcaaactttccgtggatggtcataggcgattttaatgaacccttatgccaattcgaacacttttcgaaaacacctagaaatgagaatcagatgaaggcttttcggaatgtctttcagatctgtggtctaagtgacctgggtttcaaagggctaccccatacttatgataaccgt

SEQ ID NO: 35921 - DNA, 2717 bp, Oryza sativa
  unsure (1)..(2717): unsure at all n locations
cctgcagcccctgnggaaagttaacaaagctctagatcgggtgatggcttcactgcgttcttggagtaacaggaaggttaagaatataggcagggagtcagaaaaggcaagaaaaagactggcggctctgttagagaatggagctgatagttcagttgttcggcaagcttcagaccatatgaatgaattgttatacaaggaagaaatgttgtggctccaacgctccagaattagttggttgaaggaaggtgatcgtaatactcgattctttcacagccgggcagtttggagggctaagaaaaatagttcaaattggtcccctgaaggcaccgggccctgacggctttcctgctcggttttatcagaggaattggggtgctgttaaacaggatattgtacatgctgttagcaagttctttcagacaagcactatgcctgatggggtaaacgacacaacgatagttcttatcccgaagattgattaacccatggagctaaaggatttcagacctataagtttatgcaatgttatgtacaaggtggtatcgaaatgtttggtcaaccggttgaggactatacttgatgagctagtttcctgtgagcaaagtgcattcgtgccaggtcgcctaattacagataatgccttgctggcttttgaatgcttccacaccattcaaactaacagaagacagaatagagcaatgtgtgcctacaagctagacttatcgaaagcttacgatcgtgtggattggcggtatctggaaatggcattgaacaagttgggtttcgctcaccgttgggttaactggattatggcatgtgttacctcggtgagatactctgtcaaatttaacggaactctccttagctcctttgcaccctccaggggtcttcgtcaaggagatcctcagtcgccattcttgtttctattcatagctgatggtttgtctatgttgttgagagaaagagttgcacaggggtccatctctcctattcagatatgtcgacgcgctcctggtatatctcatttgctctttgcagatgataccttgttatttttcaaggctgaacaacaacaggcgattgcggtaagtgaggttctcagtgcttatgcagctgggactggacagctaataaacccagcgaaatgttctattatgtttagtgaggcttctccaccaggaatacaggaagcaattaagagtattcttcacattgagaaagacgaatttgaagaaaggtacttggggttccctactcccgaaggtaggatgaagagagggaaattccaaagtcttcaagagaagatatggaaaagaattattcagtggggggaaacattcctgtcctctggcggcaaagaaataatgatcaaagcagtcctccaagtgataccagtgtatgtcatgggaatcttcaaactgccagagtctgtgtgtgaggatttgaacaaactcactcgtcaattctggtggggatctcaggatggacggcgaaaaactcattggaaggcatgggatgtgctaatgaagtcgaaacagagtggtggcatgggtttcagggatattagatggttcaaccaagccttgctagctaggcaagcatggcggttgattgaatctcccgatagtctctgtgctcgggtgttgaaagcgaagtattatccgaatggttccctcattgatactgtttttggcggtaatgcctctcctggatggaaaggagtggaatatggtttggtacttctgaaacaaggattaatttggaggataggaaacgggaaatcaatgaaaatttggagagatccttggttgccgagggagtttactagaagaccaattacagtcaaacgacattgtcgtctgaaatgggtttcagagctaattgatgagaatgttgcttgggatgtagataaggtctctcaatacttttggaatgttgatgcagaggaaattttaaaaatcagactaccctatagggaaacggaggacttcatatcctggaaccccgacaagaacggccggttctcggtgagaagcgcctatcaccttgcagtgaggctggcatccaaggatgagagctcttcatcctcttcaatttgtgcaaagaattcttgggatttaatctggaaatgtgaagttccacacaaggttaagatcttctcctggagagtagccacagacagtttggcaacgatggagaataaaaagaaaaggaaactggagatgagtgattcctacaccatctgtgatagagaaagagaggatactggacatgctctatgtcgatgcagtcatgccaggaatctttggatggaaatggccaaggcaggaaatcttgtatctgacattaattcgatcagagggggttcttactggttcttggactggttggggagagttccagctgaggagcaccctatgattctcatgatcctttggcgaaattggcaggttcgtaatgatataactcatgggaagccggctgcccccgtgtgggcgtcaaggcggttcctggaaagctatatgtcaacaattgtccaaatcaagcagaatcctggtgcaaatttgaagaaagggaaactggctgttggtattgctaagcgggctcctgccccttgctgctctgtcaaggatgtccccgtgtcgtgggagaaaccacaaacagggtggatgaaactgaatatccatggatccttccatccacaggaggaaaca

SEQ ID NO: 35922 - DNA, 2370 bp, Oryza sativa
ctccagtggacgattctcccatcgtcatagagacagattgcttgacagtggttaatttggcgctttcaaaagaccaagatcgatctgtcttctcgcatattgtcagcgagattaaatgtttgctggaagatgagagaggagtcaccataaagaagatacagagatcccagaatcaagccatccatgttttagcttgtaaagctcgtggtgatcacatctctgatttttggttagaaaatacttgtagcataatatctcagattctctgtaaggactcctctggttgagtaatatatctttgctcttcccctcaaaaaaaaacaaacgaacttaaaatttgactcatacacggaattatattttcaaaagctaacgaactaaaaaaccaactcaaacacggatgagacgtaccaaaataccggcaaaaacttcttcaacttttataatagtagagaaaaatgtgaagacttgaatttgttctgcatgacattttgactttaagttctcaaagatctttttagcgaatttatgcatataaactttttttattatgcagatcaagatgagaacacatgatctatgtaccatacgtccacaagtgtactaattttaactatatggacactaaactctatttttaattttattatttttattctagattttaattaattccaaattcctatatacactctatacttttcttctaatatttatttttttaattctgaatttcttttactttttaattgtatttctatatggacacttatacttttcttctaaaattctttgattgtaatcccaaatgttagttgtttataaatggtatttctatatgactctaacctcagctttgaattttatttgttttcctaatttcgaattgccattagttctaaataatatcctggtagggactctattttcctgggtcttggatgaataggagaatttctaggccgtgagaactaacatggagattcttttttctattactttaataagttaatagatttgcaattaagccccgtaaaactatagaagaattcataaaattaactgcgcggcggcagggtacacggtggcggataccccctcctgctggcacaccgagggggaagctgcacgagatggtgttgaaggagcaggaggagagctccaccgccttcgtcgagtcccccctttatcccgctgacaaagctgggtccaagcctcggcatgtgctcgtcgcctcctcgggattctccgtcaacgcgagcggtgccgactccgacaacggcgaggaccggagcagcgatagcagccagcaggtcctccactgccatgagcgcccctcaccgccacgactcctcgccctcttcctcgcactcagtggcaggcggtgatggggtcgaaggggggagagagaagagagagaagggagggagcgagaaggaagaaggagcgaggagtggatgacgtgtgggtcccacgtgtcagtgggtccacaattttttgtgtgtgaatgacaaatgggtcccacatatatgtttttaactctaatgacacctaagtgtcatgtcaatgccacaaaccaagtcaacacggccacgtagatgccacgtcagcgaaaccgtcctccaaaaacactgagagagtcaaattgcatcggttttaatagttgaggggtcgagatatctagtattgtgattaaaggatacgaatcatatccaaatcttattccaatttaaattatggccttgctcggttgtacttgctgcagctagctacagctcattccgctgcaagcagtaatcgttggtcttgtcacttgtgtagttgtgtttctggcatccaatgaaatcggccaagctgtggggctttgaaactttcctcataaaaatagaactatgaatcttcaattcaaatttagcatattttggctggttattccggccggtgctgtcattggcttcgaactgattactaatattttgaacgaataatgggccaccaccttataataaggccttattgagaagcgcttcagtatagccttcacaaatgcatggcctagattgctttatgttatcatagactcacaggtaagcctctacggaaaaatcagtagtttccacatgtcatccttctctctactttcctcccatacctttctcttcacctttcctccgtctctcttacctacgggcgactgagagacagcgacaagcggtgatgcaaaggaggacgcggcagtgggcagcgcgatggcatggcggtgcagaagtcaatatgctctccacaaattcatcgatgccgacgcagaaggaggatggcaagtagacaacatcgagaggtgggggcaaaaagggcggggggggggggagg

SEQ ID NO: 35923 - DNA, 881 bp, Oryza sativa
tgagcttgatcggatctttacaaaatttaattacagtatttttttttgtgaaaagacgagctgaaagttgaaaccagtgtactagcttgctgctgtgctggtcagaggggaacaaaaaacaatttttatttttttaaaaggcgagcaaagagagcaccggatacgcgaagctgactggtgtacacagcccaattgtaccaacgcagcctccggctcgtacgaccagctcgcccactgatagtaactgagatattccatctcttacggtcttacctaaccttgtcagttgccagtggagttgtttaagttttcctgaagaaggttacggagtaattagcataagtaaagcgagaagtctgtacttatatatatatatatatatatataacatataactctgcgaaccgctttctgtttctacaatatttttatagttgtctacttgtctatttatagttaacttgtttgttctaggttttttatatgcttagacttctttccactcagatattatattatacaattgcttcaggaatacatttatgtttgggaagtgctggacattgcaggagttgtgttccaagaagggactgaggaatgaggataaatccaatggagatggtcggccaacggcctctatacggcaaggtctgcatacaccatgcagttcaggggaaaacaagatcagagtccgctattctcatatagaaaacttgggcgtcggccaagcaaaagttctggccaaagagcaagaacagaatatggacgggggatcgattacaatgccgaggctggctaaataactatttttgccaactgtgttttagaaatctggaaactgtgcagcacctcttcaaggagtgcctcttcataccaaggag

SEQ ID NO: 35924 - DNA, 702 bp, Oryza sativa
tacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgaccatgatgacgatggtcgggatcagcagaggcacccaccgcacggtgtacaggtcggcgaacttgtcgccggagctggctgccgtctgcttcgacgtgaggcggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatcacgtggatcatggcgatgacggcgacgaggtagaggaggtactcgccgaacggccgctggatgtaatactgctcggagatgagccacatcaccgggaagaggttgtagaagaagatgaacacggtcacgatcgggtaggtggacatattgaggtaggcgacgcgctgcagcgggtggaggcggcggccggcgaggagcgcgttgctgtgggagaagaacatctccagc

SEQ ID NO: 35925 - DNA, 6603 bp, Oryza sativa
ctagaggaatagttctttcgcagcgaaagtatgtattggatctgctcagtgatacaggtatgcttggatgtcggccagcttctacaccaattgaacaaaatcataagttatgtgctgaatctggagatccagttaataaaaagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgataggaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttcgagaggaaaaatcacaaaactacacaccaccactagggacagctttcaccctgctcactctgcgttcaaacggtttcaggggagaacaccggagttctgaagaaaacagcattggctctccttcacctgagattaaagtcgtacaagaaaatctctaaaaaatttcgtttgtcaccagagttcgtttgtttttggaaatataaaatgaatcgtacaagaaaatctctaaaaaaacttgtacgctaacttgagattaaagtcagactcctaattgcagctcatgattttctaaaaaaaatttatcaaagcgaattcccacatcaaacttcaccctagttaaaccgtataacaataataataataagattaaaatagtattcatccgttacaacgcatgggcatattttctagtaaaagaaaaattcaagtatcacccaaggggccgagtagcacagaatagcaagtatgttagaattgaacgtaagctaaaattagcgcacttgacttttagatctgcatgtatggtggtggatgtgtgaacgtctttcgtttaatgagtaatactgtaaaaggtctccgagaatttagcgtcaagatatgcacactggacaaattcaagtcttcatatttttaaaagaacaattaaaatatcaccctagtggcagagtagcatagactacaaatatgctagaattgaacttaggctgtgtttagttcagtacgaagtttggattttggttgaaattggagatgatgtgactgaaaagttgtgtgtgtatgacaggttgatgtgatggaaaaggactgaaatttggatccaaactttggatctaaacacaaccttaagctaaaagtagttcacttggcttttaggatttcttgcaaagtgttgttctccctccatatttctatatagttagcaccgttaattttttaagttacctttgattatttatcttatttagaaaactatacaaatatgaaaaatagaagtcataattaaagtattgtagtgatgagacaaatcataaaaagataagtaataaatgttttttaaaacgatgaatggtcgtatgtaagttaaaaaatcaacaatgttaaacattatttaaaaagagagtacaatttttatagaatggtaatatttacccaacatttgtatccaatcggatatatgcatctttttaaattggtaaacaaccaaacttgaaattcgctcttatggatatttgaactcaggatcttggggtgctactcagatcactgcaaccactaagctaaatgccttttagcgaaaaaaaagtcaacgtgttaagaatccaaataaagtaatatatgtcgtaaaagatatccgagcatataaagtcaacatatcacaccggagaaattcaaatgttgtcatttttcaagaagaacaattcaagtctcacacggatagagcagactagcataatcagccgctctcatgacgtaacaacataatagaagtaacaaccagattattgcacaagaaaatcatcaaatactcaaatcaaattcaaacccgaaccgtccctacccagatggcccagtcagcgatgccgccgccactttaccgagagaagcagcaacacctgacaactcagcttggtacggtgcaccgaaggcgacgtacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgaccatgatgacgatggtcgggatcagcagaggcacccaccgcacggtgtacaggtcggcgaacttgtcgccggagctggctgccgtctgcttcgacgtgaggcggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatcacgtggatcatggcgatgacggcgacgaggtagaggaggtactcgccgaacggccgctggatgtaatactgctcggagatgagccacatcaccgggaagaggttgtagaagaagatgaacacggtcacgatcgggtaggtggacatattgaggtaggcgacgcgctgcagcgggtggaggcggcggccggcgaggagcgcgttgctgtgggagaagaacatctccagcgagccgcccgaccaccggaggatctggtagaggcgctcggtgaggttgatcggcgccgtgccgcggaacgcggcgggctccactgaggcgtatacggagcgccacccctgccggtgcatgcggaacccggtcaccacgtcctccgtcgcgatgttgtacacccacccgacgtctctcccccatgacgtcccgtcctcatacgcgcacgccgtcagggcggcgaggtcgccggcgaccgactcgtcgagcaccgccagcggcgtgatcgaccgttcttggttggcgccgtccagcatcgtgccgacgaacgacgtcgagctgccgaacttgttggcgatgtccatagccttgatctggctcgccgccgctccccagcgcggcggctccacgccgtagagcgcgacgcggcggaacatggtgccggtgccgaggtaggagggcccctggaggccgttgagggagagcatggtgccgtcgaagaagacgcggttatggttcgcgtaccggtccgtcgggtcaacgtcgtcgaaccgctgcgggaactggacgaacgccgtgttctcgccgccgcggccgcggccgtcgagcatgaagcacatcggcgccctgaacgcctgcgagttgttgacgtagtggtcgccgtcgaagttgatgacgaacggcgcgttcgacagcagcgcggacacgcggagcatcacgttcatggcgccggccttcttctggtggttgtatccgggccgcttctcgcgcgagatgtacaccagcatggggagccgcacgtcgacaccgctgaaatcaaccggattctcagcactcgccgccaatccaagcctcggtttacagcttggatggttcagtaaaacctatcaaaaacacacaaaaaccattcactctgatacaatttgcccggacaagattggaaacagaaattaaacatgtgtagtgcgcaaatacctgaacaattccagcatgtttccctctctggtggttgtcagccggctcaaaccatgtgccgggccaatgtgtgccatcagccatccatgtcgcattttcgccggcatgtttggcgttgtacacatcagatcgctggcgaatggtgctcgagagggagtcgatcctgaccttgaactcctcgtactctcgccgcacacgccggtgatcgctcatcagctcgccggggacgccgcctttgtacgcctgcgtcttcatcgcgaagtagttctccggcgacctcggctcgacgcagtgcttccggcagaagggcacccacagctcggcgaacttggcgacctccaccatagcctcgtagtggaccagcgtcccgccgtcgtcggagaggtagcaagcgtacctgtccaccgggtagtcggcggcgagaatggagaggatggtgttcacggtgtagagtatcggctcgtcgacagggtcgacggtggtgacgaagacgtcgacgccgggtaggtcgccggagtgccggtcggcgagggcggcgatgtccgggacgcgcttgatggggctctgcttcggtagctggttgagcacccacgagaagccgaaccagacgtcgccgaccatggacattgtccacagccacgcgccgtcgcggttcttgtgacgtatgcgccacgcgaagaaggcgacgatggcgatcagtcgcgccaggatcaagaacctgtaaggatgaaggatgctgcccttgaccttgtacgtctggaacagcggcggccggccgccgccgtcgctgccgcgggcccccgacacgtccgcttcgtcgacggccacccacacatcgtccttgccgccgtcgttcacccgcgtagccgcgggcgaccagcatccgttagtccagcttgtcaccgctgccgccgcggacatcgtggaagccgtggtggccgccgccaagcatgcaatgcacctagttagctagcccctccttgtccatggcaaattatttcacgccaagggggctttatgcctttatgtagcgccgcaaacaacatgagtttcatgggtctgtttgagagcttcttgcaactactgtactgcttcttctaaaatcagaatctcttttaaacattattttttaaaattctatgaatccaacaatataaattagaaaataactaccaactagttaattattagaattttaagcttcaccctaaataatgacatgtctacctaccaagtcaatttgctactattgctactatacggcctccaccagaccaccacactagcgcaagctgagcattttactttctccgtaccaaattattgctacctagaattagagaattttggtgagagagtagtgatttctatgcccacggtttctttatcaccaacactatcatactcctagttgctgcaagtttgataaaagagaggacaaaaaatacatagctcgagtatagtgtgttggctgcaggaagctactacctccgttcgatcaaaatatcttatattttgagacagaggagatactagtcgagtatagaaacagaaactacagattaattcttgttcttcgttgactagcagatccaagtcacgtcttcaaagaagaaaatgttactacgctgcacgcctgcaccagcaagttttcatgttgttttatctaaactagcatggcggcccgcgcagattgcgcggctagcattgttagattttttttctcatacaatagtttaaatattttcatattttattattgacaacataattttaaattcttggttgaactaacaaatgtgtgatatttttattgtattgtatatatgtgatagttatttataaattatatttctatatggactcaagaatcatattttaacattccttattttaaattttgaattttctttgttcataaattatattcctatatggattctggactactcttccaatattcattttttcttagctctgaattttagttatttataaattgtatttctatatgaactctaaactcttctttcaatatttttttttattttgaatttcaattattagtaaaccgtattcctatattgactctagacttcttttctcaatatttttttaattttagttatttctaaattgtattcctatatagatgctggacttttttttcaagatttcttatttgttaattttgaatttcagttatttataaattgtattcatatatagactatgacacttctcccaatcttactttttttaattttgaattttattaattctaaattgtatttctatatggactctaacttctaattttagttttcctattttttaattccgaattttaattaattctaaattgtatgcttgtatgg

SEQ ID NO: 35926 - DNA, 601 bp, Oryza sativa
  unsure (1)..(601): unsure at all n locations
cactcttatggtcttattgtggatgccctaaacagaaactaaaatgcaataactctgtctttagatgttggaaaaggaataaattctcgcttcatgcgtacgttacgtacctgaacaatcccagcgtgttgccctttccggtgattctccgccggctcaaaccatgtgccgggccaatgcgtcccatcagccatccatgtcgcgttttcaccgtcatctttgccatccttcgctctgttgtacgcgtcagatcgcttgcgaatggtgctgaacagcgagtcgatcctgaccttgaactcctcgtactctcgccgcacgcggcggcgatcgctcatcagctcgccggcgacgccgcccctgtacgcctgcgtcttcatcgcgaagtagctctccggcgccctcggctcgacgcagtgcttccggcagaagggcacccacagctcagcgaacttggcgacctccaccatnggccttcggttaaggttgggggaaccccaaggcccggttccccccccgggccccccgggttttcccggggttttttccgacaggtagaggcgacctgtcaccggtagtcggcggcgaggatggagaggatgga

SEQ ID NO: 35927 - DNA, 171 bp, Oryza sativa
cctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgtt

SEQ ID NO: 35928 - DNA, 452 bp, Oryza sativa
tttctaatcattagaggtttgtgtactcattattctatttctctttctttccaaccaactgatctttcattccatccttctttctttcctcttcgatatccttgagtgtctattttttcccctatcatctaattcataataaaaggtgaaatagaggaagaacccctatggaaatcgacctaatccagatccaataggaattaaatcaagatatccaattgataacaatatgctgcatcgaattggatatggaatccgattccatatatcggattagataatgaatctaacttgggaatatataatatcccatatcaatttgtttcttctattttgtttgtgtattttctcattttctattgaatcggattcaaaaaaaattccttaaagtggaaacccatacaaaagatgactgaacttatagacataaaggatatagatctagcctgact

SEQ ID NO: 35929 - DNA, 1847 bp, Oryza sativa
  unsure (1)..(1847): unsure at all n locations
tcgagttagaataaaaagaaaaaataaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaacgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagtaaataaaaccgtaaaagatccataatagaataaggtatataatggctcaatggctctaagtaagaaaagctttatcagattctattttccggagttgcacatactactattcattgaaaagaatcctactcttatgggtaaatgctcaaggnnaagtgggcttacaaatttgatcatgatcaattgctttgtgaattgtcttgcgtctcttgattaggtggtatttatcccccccaatattgcaagtttcttacgtccaaacaaagtatttacttgttactaataaaaaatcaaaaagtttagcatacgttcttccttagatcccttcttttactcggatagtattgcagatcgcaatcgatgcaaagaaaatgaatgcatttccatactataataaaaagtaagtgtaataaatagagaattggatcatgtcacatgacttatcccatttctactctatgggatcttacggagcctcttcatggatgacatggttgaggtatgatcatagaaaatattctcctcaagtgaaccagcctatccttactagacaggggacttacgtgttgattggatatggagacacctttggtcgtgaattctaatgtggcagatccaactctctatctgcatggccaaatcaataattcaagtcgcacactcccataatccgccttcttttctttcgtaaaattaacttcaactatttgtattatttgtatcacaatagttcggagttgaagagaagtatctaaatgacatgtcttattttagaataacccatgtttgtagcaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaata

SEQ ID NO: 35930 - DNA, 722 bp, Oryza sativa
ttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaatacgctaaatgattttgactttactttttttgattctgaaatcgccttcgccaactagatactcctgtaaaataattg

SEQ ID NO: 35931 - DNA, 480 bp, Oryza sativa
aaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctct

SEQ ID NO: 35932 - DNA, 700 bp, Oryza sativa
ttatatcttctaaatatatagaatagaggaatcccgatttgtcaagtctcatgatcgtatcgaaatggatttaaactcggctcaatcttttttcagattgagccgagtttaattgcaatcaattagaagaaaaaagaagaattactgcattttcttactgatttttgatcttttctatttctcttcttttttatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactggaccagcgtggatatgatctcccc

SEQ ID NO: 35933 - DNA, 1131 bp, Oryza sativa
ggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaagctcatgggt

SEQ ID NO: 35934 - DNA, 875 bp, Oryza sativa
atttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaac

SEQ ID NO: 35935 - DNA, 1542 bp, Oryza sativa
tagaggggcgtactatttgtttacacccattagtgtgtaaaggtttccatgcagacttggatggggatcaaatggctgctcatgtacctttatccttgtaagctcaggcgcaagctcgtttccctatgttttctcatatgaatctcctatctcccggctattggggatcctatgtgtgtaccaactcaagacaggcctatcgcactttatgtattagcgactggaagccgtcgaggtatttgtgcaaatagatataataggtgcgggacctatccgaaccaaaaagtaaattacaataataatggtcctaagtatacgtaagataaagagtctgttttttctagttcctatgatgcactgggagcttatagacagtcacaaatctgtttaaacagtcccttggggctccgatggaacctagatcaacgcgtcattgggttaagagaagttccgattgaagttctatatgaatctttggggacttatcgtgagatttatgcccactatctagtagtgggaaatagaaaaaaggaaatccgttctatatacattcgcaccttccttttggtcatatttctttttatagagaaatagaggaagccatacaaggatttagtcaggcctattcatacactatctaaacaaggaagttagattcggggatgcccctttcgaggggcattccgatttccctagtatcatcatttttgccgcacgaatccagattgagattgaggaaaggaagttaactaagttttcgaatcactgactcaggcccattgtcgaatcctactcagcaattgccgaattatactcagccgaaaaagggggtacttatttatggcggaacgggccaatctggtctttcagaataaagagatagatgggaactgctatgaaacgacttattagcagattaatagatcatttcggaatgggatatacatcccatatactggatcaaataaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatg

SEQ ID NO: 35936 - DNA, 1467 bp, Oryza sativa
  unsure (1)..(1467): unsure at all n locations
ttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaaaagaaggaaaagattccattaagacagttatgagtttgattgagtttcccctacttgaccaaacaagttccaattccgttatttcaactacactaaaagatctttcgaattggtcaagactctctagtttatggccccttctatatggtaccagttgttgtttcattgaatttgcttcattaataggctcacgattcgactttgatcgttatggattggtaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaactatgagcaagaattgctctatcaatcaccatctactttagacatatcttctgaaacttttttcaaatccaaaagtccagtatcttcctacaaattagtgaattaggaggagctnntgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaacttccgattttcaagaacgcgaatcttttgata

SEQ ID NO: 35937 - DNA, 4745 bp, Oryza sativa
ttttcttgtgcatcatcctagtagagtatttgtatctaagtcaatatccaaaatttggaaatggggaggggccagtcctatgcattgtacaaagaaagccctatttaataatatttaaatatcgagttaataatcgacattccttgccgatactataataaaaaagaaatgtattccattgaatcttaaacctattaataaaaaaacaggataaatactagagttagggaataaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccaaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatactttcttatccatttgaaccatagggatcgattaataagaattgaatgcattggttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaa

SEQ ID NO: 35938 - DNA, 1103 bp, Oryza sativa
tgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatatcgaatggtgatgtaggcgggggtttccgaggaatacaaataacctccggggttttttcagatttggcgagcatccggaataactagtgaattacaactctat

SEQ ID NO: 35939 - DNA, 251 bp, Oryza sativa
tattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactt

SEQ ID NO: 35940 - DNA, 340 bp, Oryza sativa
caagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggg

SEQ ID NO: 35941 - DNA, 426 bp, Oryza sativa
ttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttaccgggattattcgtgactgcgtatttgcaatacagacgtggggatcagttggatctttgattgagtaatatttcttttttgattgccctcctctctggtctggaggaggtcaaattggaatcgcaatttgttttgctaagttattttgccctgcttcgacataagata

SEQ ID NO: 35942 - DNA, 522 bp, Oryza sativa
aaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgtaggatccattccag

SEQ ID NO: 35943 - DNA, 656 bp, Oryza sativa
ttgattgatattgccgtaaagttgaaacttttttaggcttttttattaaactgtaatttcctctctgcaaacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattccgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgcgaaagtatgattcttatcatcaggagccttttgaacgtctctacgatgggtccagattctatagcagtccaatctgaaatgaaagacttctcgctcttgatcggagtcgtaaactaaaactacctcttcatcaaggttatagaaaacttcgtcatctagttctaccattttgaaaa

SEQ ID NO: 35944 - DNA, 4979 bp, Oryza sativa
gaatattgatttccattacatatgtgtttctaaaatagaaaataatgcactaaaattatttaaagtcgaaaaattaatgacaattacttcgaaaaattattgttgtctgtagtaaattaagtggataaaacgtaataagcaaatatatgatttaaaattaataaaaattctaataatcatatataattagcatatgaatgatattaaattaattgttaaaaactctaattaacatatgtaaatgccacatgtatgatttaaaacttttaaaaatcctaattatcgcatataactagcatatgcatgatttaaaattgttaaaaactctaagtaacatatgtaaatgccacatgcatgatttaaaacttttaaaaattctaattatcgcatataactagcatatgcatgatttaaaattgttaaaaactctaagtaacatatgtaaatgccacatgcatcatttaaaacttttaaaaattctaattattgcatataactagcatatacatgatttaaaactgttaaaacctctaataatcgtacgtaattaacatatgccatacaacaattgatttatatggataatcaatacatccaaaatagtttacatcgtgtatacaataattacggcaatacatcggcggtgacggttgaccgcacgtactatctcctcactattgttccctccttgtgatcgctacgtgagtaaggggtgtcttcatttgataggaggatgctagggtcaatcatcaccgtggaagggggttgcccatccaactaatcgtaatcctcgtcagtcttgtcctcaactccgacgatttttcttttgcctgggtgaaccacgtgacgcttcggctcgtcatgccctctacccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgccggttgttccatcgtgtcccatggcatcgataccaactgcgctgttttggttcatgctcttcatgtcttgggctctcgtgtagaatgtgtacccattgatctcatatccctggaatgtcgcgatcgacccagatggtcccctcgccaggaaggccagttgttggttgatcgtctcgttacccatgagatgttgtcgtagccacgcggggaaagtatcaatgtgatgccgtgtaatccatgcatcggacttaccgatgtttctagcgtgaactagagccaagtgctcctcgatgtaaggagctaccaatgaagattgttgcagaaccgtgaaatgggctttacggaataaattgttgtctaccgtcattattgctttccttccgagagttccctttccccgtagtctcccttcatggcgtgattcaggtaccctgattgggcgaaggttttcaataaattttacgcaaaattcgatgacctcctctgttccataccccttggcgatgcttgcctctggacgagcacggttacgaacatacttcttcagaacacgccatgtacctctcgaaagaaaacatgttgtgtaggtacacatgcccgagaatactgttctctttgacaaggtgacaaagcatatgcttcattatattgaaaaatgaaggtggaaatatcaactcaaaactgacaagacattgcaccacatcattctgaagggcttctaatctatccgggtcgataaccttctgcaaaattgcgttcatgaaagcacatagctttgttattgttgcccggacattgtctggaaggataccccttattacaactggtagcagttgtgtcatcaacacgtgacagtcatgagactttacgtttatgaacttcttctccttcgtgcttattattcggttgatattcgtggagtatccagacagtacctttatgctctccaagcattcaaacatactttccttctctgccttgctaagagtgtagctggctggactcaagtaatggcttcctttctcctttggttccgggtgaaggtcgccgagttgttccatatgctttagatcattacatgcttccaatgtatctttcaactttccatatacacctaggaagccaagaaggtttacgcaaaggttcttagtgaggtgcatcacgtcaattgcgtggcagacgtccaagaattcccaatagggtaactcccaaaatatagagttctttttccacatcgctgcgtgaccaccttcgctctctataggctggcttccaggcccctttcagaacactactttaaggtctttaaccatagcaaacactgttttcccgctgcgatatttaggcttcgtacggtggtccgccttatgttcaaagtgcttgcctttcttccgtaccgggtggtttgcagcaaggaatcgacgatgacccatgtacacaaccttcctacagtgcttacgatacgtactttctgtttcatccatacagtgagtgcaagccttgtaccccttgttggactgaccggaaaggttgctaagtgcaggccaatcgttaatggttacgaacagcagcgctcgtaggttaaactcctcctgtttgttctcgtcccacacggggacaccttcctttttccataacagtttaagatcttcgaccagtggtcctaggtacacatcgatgtcgttaccaagttgcttggggccttgaataataattggtatcattatgtacttcctcttcatacatagccaggagggaggttgtagatacacatcgtaacgggccaagtgtgtcacgaccggaaataacccaacgggcgttccttacgtgcgtgtattattccttgtcctaggaggcaaggtacaccaaaagttgatacaattcagagtttaacaagcggaagcgtaaataattaatttattacatgggcggcgaaggcccagcacacaagaagacaaacgaaaaacagcggaagactagggcgacgaccataggcgcttgacggcaggcacgagctagacaccaaagccttcatcatccaggaactcctcttctgggtttgggaaaaattgagcaagactgagtacaaccaccatactcaacaagacacacccacaagtgcagaataaatgcaagggagtacaagggggttataatatgaggggttagggtttgcagtaaacagcattaaaagacacttagttgctcaaagcttattttgtaaatacgatcctagagctatacaagattattaatcaaggccatgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaataggttatactctgatcagaggtgtacatctttacccacaagacacatcttcctcacgtgtaaccacatgccacataccaccacggtatacggacggaagatgtgacatagtttccaacccatcctagccatagacaagagtaccgacccaaccccacctacggccggaacctccgggacaggtaggcaggactgagcccctagcagcaggacaccagccctgtgccatgacatctcgactaccaggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaagcccgaagaccggtccttatatggccgaggcgctactatcaaaaccatgcaccccgagcccagcctaaaaccattttgaggattttgaatagagggggaggtgtgaatccaattccacaataatccaaccattccatagtgtccaggtgatatgaatactcccaaagtctagagttgtaaaaccacctaatgttgcctaattaaccagcgaagcatctacctaaattcatactagtggtaccacgcatagggtacccactagttggaggttttgtttagtctagggtgaacaaggtaataataataatagcaataataataaggtcataacaaaggtaaataggcatggctaaataaaacagtgataacgcgggaatttaaataaagcgataatgcattaatttaaatcaaaataattttataaactgggattcaatatgttcaaggatgatgtgacttgccttgctcgctttcccaaacgtcggcttcaacctccacgaagagcggatcttccgaagctgcagagtctacacgaccaatggaaaataaaaaggcttttactctaataaacttcatataacaagtaggaacaaagcacaaaaatgggttcttgacttcttaaggaaaaattagagacttgaacggtccaattccgagttcaaatggccaagttatggccatttgaggtttatatgctctttaaatgaatatttacgaatttcttcatttaaattttaatttaaaaatggattattgcgtcagccgagggggaggggggcgcggaccgggtccacgggagtggggcccacgtggcagcctcacggtccacggtggaccgggcgcacccgggctcgcaccggccggcgccgtgggccccacgcgtcagccgcacccgagcgcgcgggcggctgacggccgggccccacgcggcagccgctcggcgcgccccaaggcggccacgtcggcgtggccggcgggaggcggcgcgcctgcgcccctatggtc

SEQ ID NO: 35945 - DNA, 5505 bp, Oryza sativa
gggccgagccgacccaagagagggaagggggatttttagggtttttctttttataaaacatttttaactttgtttatttcttaacaattattatttgtgctctgaaaattccactaaaatttatttacacattttaggcttttaggaaatatacaaaaaatcctccaagcctttattgacttttaactttgcacattttaatttttaaaggctttcacaaggattttaattattctaggcataatttagaggatgtattttagggttgttttggggcgcgacaaagtgctatggctgctgctcatctctccaaaaggattcatgccatccgtacttaaaccaaaccgtatgtttcatgcgtccttttcaaagtctttaaattttttgccgatgtttcgccactgcgaaccatcggcggggtgtctcagcatcccgtcctgttgacgctcttcagcgtgccatcgcatcgttctagcattccccttattcctgaacaaatgccttagccgtggtattatagggaaataccacatcaccttatcaggaattctcttctttgttagctgcccgtcaacttctcctggatcgtctcgtctaatcttgtatcgtagtgctttgcaaacagggcatgcttctaggttctcgtactcctcaccgcgatataggatacaatcattcggacatgcatggatcttctaaacttccagtcctagagggcagactatcttcttagcctcgtacgttgtctcaggcaatttgtttccctccggaagaatgttcttgacgagtttcaataaatcaccaaatgccttgtcactaacaccattttttgccttccattgcaagaactccagagtggtatccaactttttgtgcccctgctcgcaacctgggtacaacgacgttctgtagtcctctaacatcttgtccaatttatgggcccccttttcactttcgcagtcctccttggcgtcctgcaacatctgaccaagatcatccgcaacgtcgttaccatcagcatccctttcctcctcgcccatttgatttccttcaaatccagcgtcctgactaaagtccggaatattatcgtcttccacttcatcttcttccatttcaaccccttcctctccgtgggatgtccaacagttatagcttggcatgaaccccgactcaaacaaatggaaatgaatagtcctggatgcagaatactccttctgattcttacacttattgcatggacaacaaataaaacccttatgcctgttagcttcggccactctcaaaaaataatgcacgccgtcaataaactctttggaccgccggtcagcgtacatccattgccgatccatctacatgaaaagaaaaaaaatcatacataaataattattcgtacaataatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttcccccacacaaattttctctctcatcaacttacaactaaattttggagacaaaaaagtgtgcaaaacatagctccaaatgtaatatgacaaaaaaaaacattggaggatgaagttactaaccttttaggcacctccgatttgtatataatcaccaaaataaattcactagaaattttggcatgacctcccctcttttttgaagaaattttgaagcttgctcgggcagctggagcaggaagaagacatatatataggggtgggactttagtcccggttggtgttatgaaccggggctaaagatccccgtgatctttagtcccggttggtaacactaaccgggactaaagttacgatctttagtcccggttggtaatccgggggaggcctggcaggccctgacagcatttgaaccgagactaaagatcatctttagtccgggactaaaaattaaatatgtccgttaccctttttaaccgggactaaaatcatctttagccccggtttttattgcaaccgaaactattgtggaattcggccgaccgacgaaagatggtttctccaccagtgtagaacagcctcctgtatccatgcaccatctagaccatcagtacactgaatagaaaaaagttaaaaattagttaaaaaagacaaatctagacaggaaatccggtcccgttcacagggtccagatgaaatgaaaggtatggacttacaatttggcagaagatggagtgattaataaaaacacacacacacaattttgcaacggacgaagagaagacatgtcatgatctgacggtatctcgatgtagtaagaaaagatcagagcagccaggcagaaggaagaattcttagaatgaattaaccacatgagcttgcattttttagataaaggattatcaaacccggcctctacacctttgtggggtatacacagccaaaatccgaacacgagtacataagactctccctaataaaagggtacaaaatgcatcaactgacctctcccattacataagagatgacagcacaaacaaaggttttaagaacaacaaacgaagaaaagactaggcttccaatcttcttctaaggttccagccatacacggagaagaattccaccacatgcttctccaacactttgcaatagttcttaactatttcttcatcggttcccttaagaagcaaagaccaagtccttgcccaatgtgttcccatgaaaatgatctgcaagaaagatgtaggattggagccattaaagaccacatcattcctatataatcaaattgcccaaagaaatacagctatgcccacacacaatattctcttgagcctaggttcaacacaattcagccaattcccaaacatttgagacatgctacacggttgcctaatcccaaatgtaaaaaggagcgcactccaaatatatctagccattgagcaatcaaagaaaaggtgttgtattgtttccttagagttacaaaaacagcaacttaggctacccttccaccttctctttgctagattatccttagtgagaattaccccttccttgaggtaccacaataaaattttgattttaagtggaattttgagcttccaaatgaaattcttcctaggaaccagcccttcatacatgaggaacttgtacatagattttactgtgaaaatgccttctttattgtttttccaaaagaagcgatctttctgatctgtcaatacagtgttaacaactttcgacactagctcataccaggcttccaagtttcttcccactattgatcttctgaaagacagatttaacggtattccactcattaccttggccaccaccttatttttatttctaactagattgtagaggttaggatactccttctcaaaggattgaactcctatccaacaatcctcccaaaatcttacttgtgagccatcttgtaataagaaggaaccgaacctttgaaaagactctttggctaatatgagactagcccaaaaatgtaagtcccctggtcttttttggacttgcaaaatggttttctttgtcaaatattttttcctaagcaaaatttggtcttgcatagaccagatataatataaatatggctgtatgagaaaacatcaaacaccacttcccatatttcctaattcctgtcattaacaaacgaatcacattacaacataacatgtataatttctaggtacatcaataatattagtaatataatcatctaaaaatattgatacaatgcaagcagtagaaatctgaagtgccgaatcagcgtggaaataattttgttgaataaccatccttgatttttatttgtgacgaacaaccaccttactgtattatagctctcttcctagtactatttcaattagtgtatatgaaaaaaaaaacaaatattcaattagtattcatacattgacagtagatcatgcccacattgttgtttgtgatgacattcttccttttgaagagaactgctcagtcaatgtacaggatgcaagtaaataattaaggagttagttaatgtcagcgttgattaaaaaaagatgtgaaggtgaacttttatcaatcatggaaaaaattgacctataaacagtggcaaaattatgaatagtgtatctggcatgtactaacatttagttttgtatggggcctatgggctagtagattaaatgagaagagtgcaaataccgtgttgtggcatgtacagaagtgaccatgatccctagccttcacacattacaataaccatccttcacatatgcgctgcaaactcaattcgtcaaacaaatacacgctgctaacatactgcatctggcaggcggtgttgttttccatcacctcgttgtcttcccctgttaaaaaaccctgacaaattaggaagaaaaaacaaaatagatgatggactgatagtctgatacagggagatcagactcatagtccctcataaatcaggaatcacaattttagatcatggactaagacgtacaggcagatcaggcttataggccaagtttgtagagctcatcgataaggtcgtgctggcgttgacattgaagtcagccaggctattgcaactgcaagccctcgacaacatcaccgatcctgtcctgtgaccgagatcctctccatcggcagcggccgaggctgcgtgtcagcctatgcagccaacccgatgggtgatggccggcgtacctcgttaaaaccttctgatcctgcagcaggaggttgagtgtaacgccccgattttcgttggggattaaaaatcaattagtaatgcattttctaggaattatattaaaatttaaagtaatttaatcaagggaaattataaaggaaattaaaattttctttaaaaatcattggccggaaatattttgaaatattctctgtgcctaaatatactctccggatttttctgtaaattttctaagaaataattttaatagcacaaagttcatttaaccaattaaataaaaagaaaaacaattaaaatccccctctttcctttcgggcctcctttcggcccaagttctcccttcttttgggccggcccagctcctccccctccctctcccgcaagtcctctttgcatccctccatcggcctcctcccccttctctcgccgacaagtgggaccgcgggcccactcgtcagcttctccccttacctccatccggccggctgcaaccgccatggctgccggtttcgccccacgatgccgcgcttcccgcgctccacctcacctcgcgagcacgtggactcgatccccacctcctcctcccccatttcccccactcctccccgcaaaatcagc

SEQ ID NO: 35946 - DNA, 1835 bp, Oryza sativa
tcgcttttccctccaccgcagccattgtgagcaccccgtccaccgctccatttccccaatccactgccgaaaccctaccgccaccacatacaaataaatcataatattcaacatataactatataagctaacattatcacctcacataaatattgcctagatatgtatacgacaatactagacatgaatatatcaaatataccaaacatagttaaaacataccgacgattttgttctagacaaggcgcggcactcactgcccatacgacgtgcggtacaaaatattgatgacaacacacatcgatggaacataggaaaatgagccacagtggatgaacaatgagcagtcgtgcggagcacttccaaatcttatccgccctctctggctaggtgcaggatgttaaaggcaactgttgcatatagctgctctcccggatgcccgtgcatggtggcgggcgtgatggagtaaacaatgagcaatggggcaatacaaaagagaaggcaattgttttcatgtaagttgcatatagacggcggtttggtatttatagagatactgcaacgtgtgatcaagaggcttgtatgatatccacgccacgcagcagaccatccagtgagtttaacaaacaaacatcggataattcgttaaatacaataaagcagagctatagaaaaaagcggcgtatgcgcgaccatttggagccccatgcctgagcccggcctgacgaggggtacgagcatgcacatttctctaattcttaccacattgttcaagtgactagacgtctactatactagaactaataaggtggtactataaattataaataataagatggcactataaatattttctatcaggtaggcttttaagatatttctacagattattctttctgtagactatctaataatctactaatttaggtcttccagcagggaagacattatgtttgttttccttcaataccagcatagaatggctccagcatagaatggctccttccataggatcttcgaaagaaatttaagcatcaatattttgttttaattgtaccctaaagatctagatcctctagaaatccttcactttttcttttttttttccaaacgagccctaaagcataacattacctggggccattagaactatagaggtctctacagtattatttcaagtaataatataaaggcaaattttgttacatgacactgctattgtgttgttttagccgtaggacaccgcccgaacttacttttgggggaaagaaactaaataaaagtggtaatttgccaatgtacaccgcaccgattagaataataatttccgattgaagaggagagagaaatcgcgtgaaagttctaaaatgcccttgggcccacatgtcatatctctctcccatccctctctatcccgtccatggcctacggttgcccacggccacacttccatggcgcgtgccgcgtgccgcgctgccacaccaccaccgctctctcatctctctctatctgtcggaaagctcgcggactcgcggtgtccgccgttgccatcgcggcgtcggcgtcgtcctctgccgccacgacgatttgacggcgctgcacacgctcagcctccacctcaatgcgctcactggtgcgctcctgggagaccttgcctccgccacggcgctctgcaacgtgttcctcaacgggaacaggctctccagcgagttcctgcagcgcgcgcgacagctgcgggttgaacagctccgccgcgcgcatcacgtgcggcgcgcaccccagcggccccgtccccatcaccagcacccgcctcgcccccatgtcgtacagcctct

SEQ ID NO: 35947 - DNA, 32549 bp, Oryza sativa
tgtggcaaaaccttcacacacgcgatcactgggataaacacaggaaaaccaaaagtgtagacgcgcgtgaaagcaaaacgaacagagatgaacacaagaacacaggtttttggtgccgcgcaacgtcttgcagcttttctggtttttttatctcatttattctccaacgattacatgcataacaaactaacagcttcacctattcagccgctatgaccacttcctccgcgccatcccacgaagtgctgatcaacgctgcattcttggcgagtcacgcacacacgcactctcggccatgacgcgaactctgcgcgcctctggctcatgcaacatgtaaaagagaaactaactcgtgacagaatccaatgacctgccacggatgcacaaacaaatgaataactaaccagctaaatgtgacaggcttagtctaacaaatcacccccctaagccttgtcaccttcacgttctcgacacccagcttccgccttaactccaggaatttgacacgcccaagtggcttggtgggtaaatcagctagctgaccatctgtgccaatgtgatcaatctgaaccttttcttcctcaacacactgacgaataaaatggaatttggtgtcaatatgtttgcttctgtcatgatgaacaggatttttcgtaagcgctatggccgacttgttgtccaccaacaacttgaacttcttcgctgcacctccaatcaagtcattaagcaagcgagatagccacagaccttgacacgcagctgacgcggctgcgatgtactcagcctcacacgatgagagcgccacgactttctgcttctgtgacgtccaagtaaccaagcttgctccaaggaagaaagctgcacctgacatgcttctccgatcatcgagatcactagcgatatcgctgtcactgtagcccatcaagccattatcagactggtcttgtttgcgatagcagcaaccaaatccaatagttccactcagatatcttaaaatatgcttcacggcagccatatgctgtgatgttggagcttccatatatctgctgactatgccaactgagtaagcaagatcaggcctagtatttaccaagtaacggagacttcccactatgcttctgtactcggttggattcacagctgcactgccatctttcttgctcaacttcagtcggttctccataggtgttgcacaagcattgcagccgatcatcccagacatctctaggatcttctttgcatagctactttgacacatggtgattattcctctagactgttgtacctcgatccccaagtaataactcaggagaccaagatcactcatactgaacaatttccccatttgagccttgaactcctcaatatcagtatctttggaccctgtaacgattaaatcatccacatatactccaactagcagtagatcatcaccagtctttcgcttgtacacaccatgctccatgggacatcgatcaaaaccaagtgacaccagggtggcgtccaacttggaatgctaggctcgcggtgcttgccgcagcccatacaatgccttgcgcagcctgagtactgcaccgccctgcttgtcgtcaataaatccgggaggctactgcacatagacttcttcctcaagatcaccattcaagaacgctgatttgacgtccatgtgatgaactgaccaaccgtcatgtgcagccaaagcaagtagcagccgcaccatctccaagcgtgccaccggagcaaacacttcatcaaagtccaccccctggcgctgcgcataccctttcgccactagtcgtgccttgtacttgacgatgttaccagcagggtctcgttttactttaaaaacccacttaagcccaatggctcgatgcccttctggaagccttgcaaactcccaggtttcatttccacggatggagctcatctcgtcctccattgcacgccgccaattgggttcggccagcgcacgttccacgctgtctggctcctcggcagccacgaggcaaaacccgctgaagtcgttgacgtccgacatcaccgtgtcatcgaccggcagcgtcgtctgttgaagattttccagcgaacggtaacggagtggcatcccttccgagtcacacgaacctcccatcggcggactgacaaactccacaccagtcgaggtggtcggcatggatggcgtggccggcggcggccgctccggtgtagccggcgactgctgccccggtgcgtcggacacctcttgggtgcctccgttggatcccaagctgtctcccatgtccctgggagtatacacaacagtgaacgtgccagaccagtcaggatcttgtctgccagtattggtttcccagttccacttcttctcctcctcaaacaccacatcacgtgacacatacaacttctttgcaaccggatcataaacccgatatgccttggcattgtcttcatagccgatgaacacgcctgggatggagcgatcggatagcttcgacaccccaggcccaacctttttcacaagagcagcacatccaaaagtacgcagataatgtaccttgggtttccgacgatacaacgcctcatagggcgtcatgccgtcgagagcgcgcgtgggcgcacggttcaggacgtgcaccgccgtcttgacagcctccgcccagaaatgtgccggcacgcccttgctcttcaacatgcttcgagccatctccaccaccgtcctattccgccgctcaaccaccccgttttgctggggtgtatacggcgccgtggtgtcccgacgaatgcccagctcgacacaatagctggtaaactcattggagttgaattctcctccacgatcagtgcggaaagctttgagcttcacgtcaagctcgttctcagctgctgccttgattttcttgaaacacttgaacgcttcatctttgctcctgagcatctcgacccacatgtaccgagaataatcatcaacgatcaaaagaaaatagcgtttaccagtagttgttgtcggcgtgattggtccacacaagtcgccgtgaactaattcgaaccctcgctccgcgcggaatgcagacgcgcgcgggaacggagccctgtggtgcttgccaagggagcacccctgacagaactgctcgacgtggttcaccagtggcatgccttcaaccatatgcttcagactcatatcacgcaatgagcggaaattgagatgtccaaaccgctcgtgccaccgccatgcttcatcatctgccttcgtcagcaggcacacaggcgtggccagtttcagggacagggtatacatcctgtttttgcgtggcacccacgcaagcagctgacgctctgcgtcgaacagcgttagtgcggcgttttcaaggacacctctgcatcctccttcctcaagctgcccgaggctgattatgttgctacgcaggcgagggatgtagtacacctccgtcagggcacggtgctcaccatttttgcactggaacgtgacggcgcccatgccctggatctcgaccacggagttgtcgccgaagcggacagtcccagtcaccttctcgtcaagcgatgcaaacatcgctcggttcccaatcatgtggttgctagcgccagtatcaaaataccagacatcatcaggcatctccttcggaatcacgcgttcctcgttgaggaacaccgtctggtgcacttcggtgaaaagcagcgccggctgttcattctcaacctgcaccaggtttgcctcctcccgccactcgcggcgaggcttgcgacattccttggaatagtgcccaagtttatcacaattgaagcactttaccttggacctatcccacgttctggtcgacgatgatccaccgccgcttttgttgtcgtggccgcggtcaccacgcccaccgctgcacggcttgtcatgacggcttttctcaccgccgccaccgctcttcgacccgctcgaggacccatcgtggtccttcagtttcatgcgggccaagcactcctcctcggtgagatagagacgatttccgcgtggcgcatcatcgtcgtcgtccacgttatcatccctttcggcggtcgacaacctcccgacaagctcctcgattggcattgtcttcagatcaaggaattgttcaagtgcgactgccacctgcttgtacctttttggaacaacacgtaggaattttttgatcatatgctcatcatcaagcacgccacccatgtcacggatgtccgtgaccaccgatgttagcctcaagctgaactcctccgcagtttctcctaccttgaagcgcattgcttcgtattgctgacggaacgcctgttccttcgcctcacgaacacgatcaacacccactcgcatgagtttgatggcatcccaagcggcctttgcggagtccttctttgctaacggtcgtagcatctcctttgagacagcttgcaaaatggctgctagtgcgacccgatcttccttgaactcagcatagcccggatcaactgctccccaaacaccttgtgccaggaggctgaccctcatcaacattgcccattcggcatagttggttctcgtcagcaccggatagcgcacggctacgctaggatccctcggtgctggttgttggacgatggggacttcagcaccatcagtgccagtgcctgaaccaccgccctgcttgctgccactgccgctgccgccgccgccgccggcgccacgccgccccggaggagtgtagcggccactgtcgctgtcggaagacatgttaaactcaggctctgataccacttgttgtggcaaaaccctcacacacgcgatcacttggataaacacaggaaaaacaaaagtgtagacgcgcgtgaaagcaaaacgaacagagatgaacacaagaacacaggtttttggtgccgcgcaacgtcttgcagcttttctggtttttttatctcatttattctccaacgattacatgcataacaaactaacagcttcacctattcagccgctatgaccacttcctccgcgccatcccacgaagtgctgatcaacgctgcattctcggcgagtcacacacacacgcactctcggccatgacgcgaactctgcgcgcctctggctcatgcaacatgtaaaagagaaactaactcgtgacagaatccaatgacctgccacggatgcacaaacaaatgaataactaaccagctaaatgtgacaggcttagtctaacagacctggaggattttcttgtactcggagatgaggaagcggacgtagtcggggagggcgaactgctgggagcgaagggagaaagggacgaggtagtagttggtcatgaagtcgttgccgccgagggtgatgagcacgagcacgccgttcacgatccgccgtgccctcgccgtgccgaccagcgcgcgtagcctctcctgtggtactccgcaaagaactgcagctgcctgctcatcctcacgatgttcacctgcaagaacaccgccatgaacgccatgaacgcatctcaccgaccgcgatcgatcagtgatcagtcagtggcactcacgaactggatgccggtgtcgttgaggatgccgacgctagcggaggcgaagttggcgccgacgaggagcttggcgccacgaaggtccgggctgaggtaagggagggtcggctcggcgccgaggtgctcgttgatgatgtccgggatgttgaggccattggagaacacctcctcgtggcgcggtggctctggtggtcggtgcccaagttcaagtccgcacagccaccaagcctgccgctctcgccgccaccagtgtcgccgtcgtcctacttcgccatcccactggggctcagccccaccgagctgctcgactcccccgtccttggtgaggcatggcgtcatcggtgaggcatcggctatggaagcgtgggaggggatagagagaagagagatgttagaaatatatgacatgtggactcaagggtattttagaactttcacgtgatttctgtctactcttcaaccaggaattattattctaatcggcgcggtgtccattgataaattaccacgtttatggagtgtcttctcccaaaagtatattcgggcggtgtcctacggctaaaaccacacaatagcagtgtgctgtcgcaaaatttgtctaatataaaatccctccttcgacgttttggtcattttaataataaaagtagtgtctattccctctattctaaggcgcctataatattaggaaaaaaagcaacatttgcatcatttttataataattaaactaactaactaactaactatatatatatatatatatatatatatatatctagtggcatgcatatgatatcatcgtattcgcattcgaaagcacattcgtatggtgttaattttgcagttgttgataatgtattacttcctctatcctaaaatgtagatattttttaggttgacacggatattaaaaaagtatgtgagaatgattggaggaagtgtattattgattaatgtgtcatgggtaggtgaaggagaatggttgtgattggttgagaggaggaggtaggtgaagaaatagttttattttgggataaggtattgtgctagaaatagctatattttaagacggaggtaatagggaaaattttgggactatctaaaaatattatagcaagttatttaattgaaaactttcaaacatatactctctatatatatagtatatttaaggagctcgacagtgtcattcctaatcaagcaaatacaagatccaatctcctcatctcctcctgacgttgttccttgtcgtgaactcgtgatcaccacggacgcttggtgtccaagccacccaaaccatgcccagctatctcacccatcaaaaggcctggacgaaaagctcgtggcttgttagctcgcttgactcgcgccaagctcagctcggctcgtttcatttttctaacgagccgagctggccttttaactcgttagagataacgagccagctcgaactggctcgcgagctgctcgcgagccttaatgagctgaggtagctagcccatgctgttgtggacttgtggcccatatgtgcttgaagggccatatatgcatcaaaaccctagctctactcctcatccccaatcccacacgagtcgccgccagccctcaacaccggtcgctcgcgcggctctcccccaggccccagcgcccgacgccgccgcccgcgccgctcttctcaagatggccatattggcggttttgcacggggaagagcggctccatccttatcaattgccctctccctctccatacaatagcatggataaatttaagtgcattttggttgacgtactgacgtgtttttatctatttgtccctcaacagtgagcaatgtgttgtaggaatgcaacatgacgtattgttttttccttttattataaccttccaagctattataatcatttttctactactcccctatcccaaaatataagacataaccattatttttttaatgtttatactaaaatataagacaactatttttcttatgtttcataataaaaaaaacacgcatgtatgcatgcaatgcaattaagtagcacacccgtctcccttaaattttgtttgtttaatcctcaactgtaatatctctagtatcattggctgctttcattgtatttattgaggtaatctagataataattttttcttgtttttttttacatttgtggagtaatttatttctgttattaatatggaacctcgcatcacgcggttcgttaaaaaaaaaaaggaaaggcgaccgaagacaaggactcgtgcgaagtgaaaagtgctcacctcactgctcaacggtccaatcccaccgttcctttgggggttcaccggcgggcggcggcgacctgcgtcgtgcgtcagtatgtgtcgcgggcctctgccttgctattcgccactccggtgaactccgcgcccctcccgtctcctccggcctcttcccgtagcgcgccggccgccgcccccactcctccggatccggatggcattgcagccatttaccgacgacctcctcgccgagatccttctccgcctcccgtcggcggcctccctccaacgcgccgcgctagcctccaagtgctggctcgccgtcgcctccggccccgacttcctccgccgattccgcgcccgccacacctcgtcgcctctcctcggcctgttcgtctcccacgggagctccggcctccccgtgttccaccccgccgcgaccgtccgctccgaccccgacctcggcgccgcggtactcgggggcgacttctcgctcatccgcgtcggggacggcgaggatccccgctggcaactccgggactgccgcaacggccgcctgctcctctgcggaggtagatccgtcgccgtctacgacccggtgtcccgccggcgcgtctccatccgccgcccacaggacgaccccttctcggacgcctacattgccgactgcttgctgcacgggcgcggcgacaacggcgcggcgtcgttccgcgtggtgtccgtgcagcgccatggccggaggatgcgcgccgcggagtacaactccggtactcgagagtggagcttccacccgtgggtggaaaacatgaggcggcctcgccggggccaggcgatgcatgcggcggggattatcttctggaaatgcgaggacaattttgtgatattgcttgacacgctcacgatggaattctccatgctcagtctccctgtaagcttgttccagccttccaagtacgccataggggagatggaggatggcgtgtgctgccttgtatgccttgatggcaccatggacaacgtccacatgcaagtgtggctgctcatggaggaggacggtggtggcaggaggtgggaattggagaaggaaatgccggttagtgaagtgcttgacaggcattccctggtgcgacaagtccgaacagtggctagtggattggttcttgtttcctgggatgaccgctatcctcaatttgccattgacctgaagaatatgaaggtcatggctgagtttaggtgcagcggcgagacttatcttttccaaacgccatggccacccgctttgttggtcgatagcggtaagtctttcacacatcacttaggtacttccaaatatatgagtggattgcttctttagactacgagttggaacttactgtggataacttgctatgagaagtgagttgatcttaattgattgctagtgtagttttggtcactgtgttggtagagggcgagcattccaatcacttcaacagcaacttttggatttaattcttaaagaattaaactgaattataactctttggtttcatgcttcctgaactgaactgacagaactacaaattggctaattttatctgtttaatccgaactattagttatgaagaacatgtacatgttttttgtaaagtcatgtttagactttagatggagacctgccaatggccgcatttcatggtaggcatactgggttcaattaggcatctattgttttggaaagtaatttagatgtctcataaaaatgctacccacacagctgtttagacatctcataagatttatgtggtcattttttagtggctaacaaaaagtaggcatcacactaacgaaaaattgacgttattgttttgttgcatttcagttggtttggcctaagtcaaggtcaaggttgattcattttcatcattttgctaaacaaaaaatatccactcgatgctgatccaatgcaccttaaaccacagtgaccttttcttgaggtgtcagacaagatgcagcttgcttgaatgtcctcctcccttgttcttatatactacctccgtcccatataaattgcaattctagtttgtttagtactccctccgtactcataaaggaagttgtttaggacaatgtttaagtcaaaccttgggaatataaatcatgaataactctcaagttgttgagtttgaaaatgtaaaaattatatgaatagatttgtcttgaaaaatacttttataaaagtatacatatatcacttttcaataaatatttttatagaaacaagaaatcaaagttgtgttttggagaccgtgtcgctgtcctaaatgacttcctttacgagtacggagggagtatatattaaggtttgagaagaaatactatgatgccccttattaaatggtgtataggtaagagtggaagggtagtggagggtaaaatagaaaaagattaaatgagaagtgattaatgagacctattagtactctattgtgacaattattttgggacaaattcaaatcctagaaatacaattattatgggacagatgtagtagttttcagcaatgttcttgtgattcccatggtgttaaagcactagagaaacttattacatggtagtaatgttagtgccaagttcagtacggtatacagtggcagtaggaggggaaggctggatgtatgactgagagtcaagtagttaagaatggaatagtatgctgttttcctgtattatattgatgctcaaccgtacaaaaatcattgtttagcttatttgtataccctacagaggttcaaccagcggatttggctattcctttacaatctgcagaatatgtggagccgcttcagatgatcgctactcagaacatgatgaaacatgttaatcttgctgcagagagaactgatgttgtgaattcagaggtaaagatcagcttcagagtttcctttgtgaaatttgtgttgttctgataatctgtaactagtaactacatatgcatgcagggcccattggatttggtattggaaccacatggcccactggacgcacaacaagctatggctgctgaagcggagaccttggtggtaacagcagacctgaaattagtcaggtctactgaagcacaaaaccagtcagtagctgaaaaacctgaggtatttagcaattgctgcctgatttgtttctctgtcaaaattgttactcaaagcattacaactctgcatattttcacaatgatcgaatcagatcatgaaggggcctgaagtcccagtttcgaaaaggagcatgtcacgtttggaaaaaagaagaggggaaagatatgagagtgctctccacaaggcaatggagaggaaagctcgttacatgggtggtgtggaacagcttagtacttctcttggaagaaactacagaagatcagagaagccaattgttgtggactctagttacgagagatactaccagtgtcgtcaacgtcgagagaagccaattgttgtggactctcgttacggtaaatactaccagcgtcgtcaacgacgaccagccgcaggagttcagggaaggtgaggcagggcgcagctaaacaagtttggagggaagtagggttgaaggagatttgtattcagtggtaggaagtttatttgtattcagaaattactaaccattaacaccattcattcgcctgagcactggtatatgctttcgataactcataacagatacatttttgtaattcatatttacttgaaatttgttttttttaaacacaaatgactttattaagcaagaacagagttaagggataaaccccagtacacaaccaaagatagaaattgaaagcaaaagtgacaaccctgaaaagagagggtgaaccgaactatggaagcagccttccagatgaaaccgaacagcagaaaaaggagcaagccgacagggagctgcagtgagccatgactactgcaaagccacgacgtcttaaaattgtgtcgactgctgccatgggcctcatgagaagtgcacaccgcttgacaaaccgttaatccccttcagttacctccacgggaatggcaccagattgaggttgattgctgagccgaagatattggtgtaagcatcaccggactcaacaaagaatccccacgaggtttgtcattgaatctgaggaactttaacaacagccctgtcaatcgaaattgcgcaggaggtccgagctcaacccgaatgacaaaccaatcgtggtttctgctgctagggaacagtagagagggccaaatcgtaatttgttagacagtctaggagagtatgagtatcattttgttgaaccatgtcatgaacgcaaatcatgaatagcctgagaaaaagaaccttatcacggtttctactcggcgggtaatttgcaatcaaaaattatggattaaaaatgaaggacaacaagataccaccagtgattgtaatcgggtttccttaaaaaaatgattgtaatcgaattaagcaaagcaacaagtagctatgggcccagagcaatgtagcaactagcaaccatctcacaaatggcaatgtgttttcaggaaacaactaaacattatctaactcatccatgcctcttgcaaaatacatgtttgatggatccattggtttagggatctctaataattttagaacgttttcttagggtacttaaggaaccatagcactagagatggctcccctttacatcttcctagatgcaccatcgagcgtcaaaaataggagccttcaaataactgtttttctaggtaaaatgtttttcgtagggcaaacaaaaatcacttctcagactcaatggtgagcgaactcttttgttggattgatagtccgttccaatgagaacttttccgctagcgtcatcgtagcttcgaagtgcctgatagtttttggtgctcgaagcaagcaaaagggagtacaaagtagcttgaagcctgcattcattgtcacatgctgattttctttccgaactatgttacacccaatcctataccatgccagattaagaaagccactagtagccaattctttccaagacatgatctcttaatgatttttactactaattgaagggaccgtctgttggtcgccagaaaaaaattgaatccgtcagtcaatttgtgtgagcattcgatctgcatccaacgggcgtgtgacaaagaaacaaagggagttagtgggcccgtagcactccttttgcggtcccattttggggtctgattttttattctccgtattgggcttttgtctttttctaggcaatgtgcaatgggcctgtatgatgttttattagtggaaaaaaaaatcaactttaactcccttaaagtaggctgaatctaactcgtatcccttaaccagaaaaccgggtagaacgaccctgagaaactggtataatttgactccttcgatggttttggagggcggtttccctgacgtggcgctttaacccgatccaactggttgactctgtatgtgggacccacatgtcagtgtcacattttcttctcccttttttttttctctttttctcctctttctagcccggcagtgtgaggcggccggcaagtcggcagcggggctgtcgctgacggcatggcgttcaagcacgatgttctacgcagtaacagtgatgcaggggtggtcgcgacgagcccaccaccaccgagtccaccgccgaagcacgtctccggcctagagtagcatggctatggccgctgccgtcatggagcttgacatcgaggcacccatggcgtctaagagcatggcgcaagaggcgggaggacggaggcaccagcgcgtggagttgggtggtctcctcgagttcgaactcgtcctcatgtccccgttgtcaccgagctggtgaagaggagagcatgccaccaccgccctccctcgaggcccaccgccggagctacgatagtgctgttgcatgccattgtcagcgagtcgagctcgagctcctagcacctcgccgacatgggcaacgggacacggggatagaatggaagggggaagatgcttgcggtgagagaagaaaggacgtgtgccgcccccgccggcttccgcgacctccaccgcgatccacccctatcgatctcgacacaacaggaggagcgcctcttggatctctgctccaagctgaccctgtccccgtccgtcggtttgggccaccgccgaccagctcctcttcgctccaccggaccacccctctgtttccgtcgctcaacagggaggagccgacctctccaccttgggatgttcgcattgcctctctcaacgacctcggccctaacctcgacgacatcgatgagcgctgcttttgctttgccgtcgcctctcccctctccccaacacgaagatgagcagcggcggtggcgctggctggaggggaggctgatgtagcgtcacctcgaggcagcgtcatcgctacgcatcagggcggcctagctgcagctcctccttgggccatgtgtcgccatggtgggtaaaagaagaaacaaagagaaagagaaggaagaaaaaaaatgtgactatgatacgtgggtcccacatgttgagccagtcggttggatcgggttgaaacatcacgtcagtgaaaccgttctccaaaaccgctgagagggttaaattacaccgatttcaatagttatgggagccatcctacttgattttctgataagggtacgaattagattcggcatacttttaatttctctgtgctttttttatatgtggttttggtctagttttgttgaaaaaaaatactgccttgtctcgtaagaggctgctgcaagttgtgtgaagtctaaaatgcaaaatgaaaccagcagttccccgaaaccatattatacattaataaagaggaactcgttgcatgtattacacgcatccaatatagtaatcacactgagccaaatttgatacatagccgtgagagtttaatttgcacaattcggttattagccaaacaattagccaaatgataaatattggttcactgtgatttggttagtcagcttctgatggttttcgtactgataagcaattagtgttaattgaccaaatgcaattagagtgttaattgaccaaagttaataagtttgcacaaattttattcggtcacatgcattgtgtcatatttgtgtacaggtttacatgcgtttaggattttctgtgtgtgatcaaggctgaaaggaagaactatgatgtgaagtaatcgcagaagatctcgatggccaacatctttgctgtcactaccgtgccactgccgtcacattttctatcttctttctcatctgcatgtgggtctcacctatcagattcatctttttcctccatccttccctcttgtttttcccatctctctccaccacctctcagcctccctagcaatccatctcatccgctcctccctccttaacccgatacgcatcaccatcctctcctgcctcctcacccggtgttgaagtcgaggccagagcgaccggagacggggtggtggcaaacggtcatggcgcacacaagggcgggcggtgcagcccggttgagtcgtttgctccctccgcccccatcgctcctcctccccctccaccaccgccgctggttgccgccgtcgctcccaccttcgggccgacttcctcacagccaccgtcgtcgctcctcctcctccaccaccgtcgctaccatttgtcacctacgctcccttccatcgccggtggtgcccccctccactctccacccctgtccctttctcttctctctctagctccttgtctcctctttagatctggaggccacatcccccgtgtcagcccgttgggtgaccgcgctctctgccaacccctcctgcctctctccctcgccgttgccagagccctcgcgctgacctcctcacagccgcggaggctgactgccgcaatcgtcacaaaactaccgatgtctgacgctcgcaaagcaagaagatgagaagagagaaggaagaagacggatggaaaatgtgatggcagtggcatggtttccaattttgcaaaatgtgtgtggcacgcggttacgaatctgtcaaaaatatgtcgaaaatctccgttaacctcaactgcatgagggacctagctgtcagtttcatcttcttcacttccctcccctctcttctcttttccctacctctctccggtctctccctccagcgacgcttctcattctccaccaccatcgtcgggtgcaggggccacggcaacgatggtgcttgtcttgtgcactgcgatgtcgcgggggcacgatcgttggtcgggggaggagaaggaggcgcagcgggaatggcgaaggcgccactgcaggcgccgcgactgttcaacatcgtgcacaggggctccaacgatgagcttcccgaggagacagtggtggcgtacatgcgcgacaaacccatccctggcggtggtagcggcgtgacgggcccacgcagccggccgtggttgccactgcccttgtcgccacgccagatctgaggcagccttccgcttcccggataacttgggcctcgtcggcagcgcggatggcgatggcttcgacgacatcgactccgaggacgacctcttctccaccttcatggacatagagaagatcgtcggcaccaactgcgacagcgccgtcgagacctcctccctgccacgccacaccaagcaccaccatagcgcttttattggcaggtttgtctttgggctggtgcgggtggcggtaggagggctcaggagtcgtcgtcgccatcgacctcctgtcatctgccgtcgcaccaaccacgcgccaccgtatcagcaacactaacctgctaagagaggaagagggaaggagagagacggaatttcgtgatggagtagtatggttccaatttttttaaatttcagtggcacacaaccgatatgttaaatagtagtaaataatagtagtatttttttttgaattggcatatttttagtggcatggatccaattaaaaaaaaaggactttccgatagggtaaggccatgggcttgggaaaaaaaggcctgctgaagaactgtccatgtagaaaaaccttccacactagtccgatagtgtgcacagatcttgaagcagaattcacgaccagagggagatggattacgaattttcatgcgagtgcaaaatagcaaagccgtaaaatgattcttgtattcggaagtatcagcctcatgattatgcttataagccaaaatttgaattttcaatcttaaatttagagttgattttgaagtttttttatcgtagtttatttttcagtttttgcttttagatcgctaagaacacgtatataaaaattttatttataaattatcttcccttcacaaatatgttgtttggtgagtcatatatggccttttttagttctcaattttttttcctaaaaacgtcacatcgaatattaggacatatgcatggaacattaaatatagataaaaaaattaattgcacagtttgcatagaaatcacaagacaaatcttttgagcctaatttgtccatgattagccataagtgctacagcaacacacacgtgctaatgacggattaattaggtttaataaattcatcccgcggtttccaggcaagttattaaattaatttttttattcgtatctaaaaaccccttccgatatccgatcaacgtttaatgtgacacctataaatttctcttttcgcaaaacacaccatatatatgtgtagttgaaagaatgggaatgtcaaggtcaagaatcgagaatgaagggaataacggtaagtgcccaaggtcattgcctgcgaagacgagatgaccgtgtcccagaatcagccgcatacgtaggcgggccccgcaagttttttgatttttccaactcgtgcgttcccacagagcaacccccctccccatcgtcagcatctttctttctcttcccatcccactcccttccccacacgctctccttccttccttccttcttcgcttcttccgacgccacttcacctctccttcctccctccctcgccgccgcgggctgcttcctccctccctcccgccgcgtcccgccactcccggctgattactcgagccgccgcggggcagatccgtgccgggataggcctctcgctcgcgcttcggtcccccgtctcttaccggcggataaaccctaaccggagaggaggaggagggggaggccatgagggggaagaagccgcacaaggagctcaagctctccgtgcctgcgcaggagacgcccgtcgacaagttcctgtagggtccccctccctcggttccctgggcctgaaacgtgctcttttttttctttttttttttactgtcacttgatttcgttttcctttgtgtgttctcctttggagcgatcgggtgtcatgaactttcgaggttttgcctctggtatagaagggcttctgtgtttttttttagttatttgttgacgattttggagttcagatcgaattgtcttgcatagtgtcttactgtgattttggggttagttatgaactgagatggagataagatttacagaagcgtaggtctacttatactgtctaactgatcttttgcttgaaatatctatgatctgagttgctgaactgactcttcaatcctcacttagagtggctgaaatgctattcgtggttccagatcgtttgttattttgtttatccatcagcctaatcgttgatttatgtttcgggagttcgtggtaaaatttaatagctgtcactgatcgctggtgctcctttaggaccgcgagtggtacattcaaggatggtgaactgcggcttaatcaaagaggtttgcagcttatatccgaggaaactgcagatgaacctgtgagttcctggtgccatggctactttttttgtttgttcatatctccctactgggttcatgtaaactgctttatcgtactccttatggtgacatgtaggttagtgtagaagcacatgtacaggttgactagttcagtcaaaccttatcatgcttctgttgattttcatttggctgattgaatgcaatactcacttgcaatgcatgggatccatgccactcatgcattctcgcaatgtattatgtgctgcaatagtgctaaggaatcattgtgtaaacatttcagagtttatccatggatataacattgttcacatttctcaatttctgtttcatctttatgtcttccagcagtcaacaaacctgaaggtggaagatgttcagttgtcaatggatgaccttgagatgattcaagtcattggtaaggggagtggtggtatcgtccaactagttcggcacaagtgggtggggacattatatgccttgaaggtaatttccattacacaaaatccatctagtgttccacactaattcttaaatggaaaatgtatatcttgtggctgcatcaggctgcgagtccttcagttgaactgtttctctatctttatgtttgtaatcatggaaagctggaagtcaatctctcagttccattttgaacatgtttatcataatcagattattctgcatcatagcatttgattgattttttaatcaatttggtagtgttggcacctattagtatgttccctgttgaaattaggtggggcattctacataaatggtgtagcagaagcatctgtcgtcagcttacgtgttgcatgcaatatctacattgaactctgattttcaattaatattgatgctaatgaagaacatcatgttatgatgttcagatcaatcaagaattctgtgcattgtccctggtattcatactgctgtggcatttaattaactagcattgcaattctgtccacagggcatacaaatgaacattcaagaggcagttcgcaaacaaatagtacaagagctcaaaataaatcaagcaacacagaacgcacatatagtcctttgccaccaatctttctaccataatggtgtaatatatcttgttctagaatacatggaccgtggatctcttgcagatatcattaaacaagtcaaaacaattctggagccatacctggcagtactttgcaaacaggttagcataaacttagccttttatttctaactttccctgttttcggaataagcttggaattttgtcgcatctatccagttgaaaaagtattctaacgtaaaaaaacattgcatgatattttgacaactcaggttttggagggtctactgtatcttcatcatgaaaggcatgtgattcacagggatataaagccatctaacttgttagttaaccgtaaaggtgaagtaaagattaccgattttggggtaagtgcggtgctagcaagttcaatgggtcagcgggatacgtttgttggaacctacaactatatggcggtatgttgaaataatgacctgctttatttatgtaccccttagtctatgttcaagacagtgatctgatctggaattcataaatttgttctcatagtttctacctttcttcctagttcagcctgagcgtattagtggaagctcctatgactacaagagtgacatatggagtttgggcttagtaatactcgagtgtgccattggtcggttcccctatataccttcagaaggggaaggttggttaagcttctacgaattattagaagcaattgttgaccagccaccaccctctgcaccagcggaccagttctctccagaattttgtgcatttatctcctcctggtatgataatcatctctctgaaattacacatgaaattagcttttattactgctttcctgagtattcccctgcatactactttggctgttttgctctatatttcaaagtcttgttagtcttttgtgtgtgagtccaaaaaaaaaaaaaactggaactgcaaaagaaatgtttggaattattgagaacgctatttgtaacttgtatatatgtgtagcaattccctcttccaggaagttgatgtattttctgtaccaaagtgttccttttgttaacctttgaatatgcttagctttattgttagcatttgtgatcatgaagaagttgatggacacaattagtgaaatccacaatccttttttttaaaaattttctacaaccttttatattgcagtcgatcctgcaatgttatccactggaaagttgtaacttcctgcaattttgtcagatcactttgcataccaagaggcttaaagtgtaactttgcagccaatggctcagtgggcaaaacatgtagcagtgggtttgagcaagcaacctttggtttacttttgtagaccatagttcttagcattttaacgtgatacctacatggccatattaaaaattgtattagtcctaaacgagatgcatgtagtctattaaggtcttaacttcatcattgcttgagcactgaggtgtccaggggctactgtcacagctgctgcctcacctaattgatcatgtaccactctttagatggtgagtctagtatttgccacactctggaacctaattgatttcttgccaccctttagatggtgttggtttaccaattgcctctttgaacttaattgcatctcctttcctattttgctcttgttcaatgctatgcttcaaaagaacaagtggaataactgatttgatgaagataagggagaaagctggaggtcagaagtcagcaaatctttcagtgtccatggtcaccctcaaacgttagtggtacttattgacaaaaagctgatctggagctccaacttgtagaacttggcaagctttctgtatctagaacagaagcatgagcaagaattttgcaccaagcaattaaaggttataatggatctgaatgactaaaacccaagaaagaatcttgcaccaagtaatattgctcgttcttaccacaaaggaatcaaatccagacaaaagtagtcatcaatgtgatgaaatcacaggagataagccaggtgagcttgatgcacttggttaggtcagaggagctctccaatgagtcgatggaagaggccatggtgctggggagctggagccctagctgcagcaaatccagacaaaagtagatggtgggggtatgcggcgctatgggtgtggaaggcagtttaggctattgctggcatctctgaattgaagaggggtggaaacttgaggtcagatgatggagtaagaagggcaaaatgagaacttgtggtggggattgtgtaaaaaaaaaaggtagatgcaattaggtacaaaatagcaatattctagatcaagcacatctaattggtggcattttatcaattagtttctagggtgattgcaaatcaagttatttaaagggcagcaaaatatctaggtgttttccagattaataaaacctttgctgtgagatagttacggactaaacagtagtatacccaccctggcccagtgtcccacatcatgactagtatcaatttgcgttgctgtcagattgttgtttacagaagtacttttgaacttctttgcttaagtcaaattatgcatgcaaataacagtgtcttgtgtgctcctatatctgatttcatgactaatctataaggatacaagcatggcttgagggtaaataacagtttcttccaacttatcattaaagattcatttcatcagcttatcatagtctaatcttatttattgttacattgctttgcagcatacaaaaggatcctgcggagcggatgtctgcttcagaactcttggtcagcattgccttctatttaataatttttgtagcgaacttaactgtaataacatctttcgaccatcttgttctgaactgtcatatatattcttgcagaatcatcctttcatcaagaagtttgaggataaggatttagacctgcgcattcttgtcgagagccttgaacctccaatgaatatatccgagtaacttgtcattgggaggaatgaggttttgtcggtctcttggtagcggcacatgttccctgcatgcgatgtagtgtgtatgatgttgaaaattcgggaggagttgcagtaatgtatcggtataatttttctttacctaaggcccttttgttgcctctttttatggtcctgtgacttgcgagcatgacaatagagggaatcatgatttcaccttcgtattgcatggtgtcttatcgtagttcttgctgcgagtaattggtccccaatgtccttttgatccgtggtcttgcttattgtcggctctacttttggattcagtaccgaaatattacgtgctgtttgaagaacacaacgtgttttaatgcagcaggaataaaaaacactttggcgctttccaaaagaaaaaaaaaagacgaaatgttaaaacactagtaaatttccctttgaactggcatgattgaaatttcaacattactttgagatcaaaaaaacatctggagtacaattacaggcgatgccatttgcacaagaggcagcaaagttcaatttattcaaactttgcaaaattataatagcatggtttcaatttaccctttattcaatgagacaacaaaaggaactgaaggtctccatgttgaacctctcgggcgtcttctgtttaccaatcacaaagactcaaaaagcatttaccttggaacaaaatgcatcaagctgaaaaccgttgccatgtttcggtcgaataggaggggggggggggggatggcatttgccccctgctacaacacacaaaaccgggtgaatcatttcaggtttttttttttttggaaaggggggggggtgatagactcaaattttcattccaaatttttgaaccatctgtgagggctcccctgcttcctaagccctctcatttcccttgtccccacctccaatggcagccaaacacccccatccatccccatcgctcccgacgcttcggcaccacccgcttatgtctaccacccaccatcggtccttcgctgcccacaaccttcccactaaacctaggaaaaccccatcttcctccgctcccttctaacccacccccaaccctaaagcctatctggtttggggtcgtagctgtcgctgtcattggagttcttcagggtcacgaagacgtacaaagggagaagctcatcacatcatgaatcgcaaagcaaatcttaaggtaagaaatttgcaagattttgccctcgatgttcactcgaatgtgtttagcaattctgttttattttcatgtggctcatggcaatcgtcttgaagccaaaatgtctattactgcctccatttcatattaatattagtcgctttataaatttagtcaaattttaaaaaaatgacttataataagaaacatggagttttttttttgaatgaacaacattttggagtacgaaatgcacatacaaacatttaggtggtgtttggatccagtgactaaattttagtctatgtcatatcggatgtttgaatactaattagaagtattaaacgtagactaataataaaactaattgcataaatgagagttaattcgcgagacaaatttttaagactaattaatctataattaacacatgtttaatgtagcatcacatatgctaatcatgaattaattaggctcaatatattcgtctcgtgaattagtttaggattatgaaatgggttttgttattagtctatatttaatacttctaattagtgtctaaacatccgatgtgataggacctgaattcaaactcatttgtggcgagaaagttcaattattcaacgaaacaccaaactaaaaagatccacattcacaacacagtttcactcacactcacacacatacacaccaaaacaggaaactgccatgtcaattagcgccgccgctgcaattctcctatcgacggtggcagctgcatgccgccgtgccgccgttccggtgatgcatgccatctgcctccacgaatccatgtcactcatagcgatcctagctcatcgacagcatcatcagcgccggcttcgagttcgaggtagtacgccttgatctcgtcgtgcttgaacttgtgcctccctttaccacccgtcgtcgacgctgccggcccgccgctgcaggcgcccttgccgctggcgagctccctgaaggcgcggccgccggtgaacttggagtggttggttggcttccgcggcgccctgatgaacccgccgttggccaccgtcgccggcgccgccaccgcgcccaccacgcggcgcttcccctcggggtcgaccagggcgcggtcgtacacgcacacccacccgcgctgcctcccctcgcgacgcatggctctgctcctcgctcagtttgctgtaggtttggtgtaggtgcaggcgcggccagcggcgcatttatagtctgcgcccgtgccggccgggaggttgaggttgcttggcagccacggtctcgttcgttgtgatcgtctacttggccgccaaggctaatcaacgagaattatttatagtaggtttgacagctttgacctgagctagctggaacgtacgggaggaaaatgagcgacaaccacgttgttcctcaaccgtcgagagctttgggttgaggtcgcatcattggagcttgggttgagtggttgaccgttgtaagactgaggacggacctgtttagctcttcaacaaaatttttcgcgctaccacatcgaatatttaatacatatatagaatattaaatgtaaataaaaaattaattacacagttcaccaagaaatcacgagacgaatattttaagcctaattacgccatgatttgataatggtgctacaataaatatttgctaatgacgaattaattaggcttaataaattcgtctcgcagtattctgataaaatctgtaatttgttttgttattaaactacgtttaatatttcaaatgtgtgtccgtatatccgacgtgacatgcagagggcaaaattttttttttgccaaataaacaaatgcctgaatgtgtgcgctgggatgaattaaggttttgggacccggcatgggaaatgctagacttgtcaagcctgatcctgaaaattaacccgttcttaaaatgaatcttctaattaaatttctaagtaacatagggaaaaaatcttccttttataactttctctcaagtttaaatttggaccgaatcaacccctaaacttttaaaattatgacaattttttggcaaattttgctataaaacaccgtgacgtactagctgtagaacaccgcagtagtgaatcttttgtggaatgcatcggtaaaaagtgaatatttgctactatttaaatgtttttggctgtttaggggagaggaaacttccaaaatgacggtgagtacccctggtttgcaaattgccctcgagttatccttccagtgcttctctttcaaatccggccactttgctcgccgggcgatgatagcaggaacgagaacaacaagctctcgttgcactcacctctccactcacccacgaccccaccacactggcccttgcgttcacctcgctgctaccgggacccacctagctcctcctatcgatctattcttcctcacagaagaagcaaacaaattgccgtcatccatgaagcttccaacacctgtagcttactactctccctcctttgcatttttttctaacaacccaagtcgagcaaaaaaaaattggtgtagaaaaactgatacaactaatgcatgttataccttaggccatgtttagttcaccctcaactaccctaaactttcaactttctatcacatcacatctaaaacttacatacacatataaacttttaactttttttctaaacttccaactttccttaaacttttaacttttttttagaaattaaacccagcattagttgcttgaagtcaagaaggcctcccaattgagcgaatgagcaaccgtttgccggagtgaggtggtggaaaagctggcaaactgttggcggtgagtgcatgtgctacttactacctttacatcatcctctgcagtggcgccagagatgccatcaaattgcaacgactagcacgaccccttagagtgtgtttagttgaggaaatgaacatttttgggtgttacatcggacgtttgaccggatgtcggaaggggttttcggacacgaacgaaaaaaactaatttcataactcgcctagaaaccgcgagacgaatcttttgagcctaattaacccgtcattagcacatgtgagttactgtagcacttatagctaatcatggactaattagactcaaaagattcgtctcgcgatttcctccctaattgtgtaattagttttttttatttatctacatctaatgtttcatgtatgtgtccaaagattcgatgtgatgtttttgagaaaaattttaggggaactaaacagggccttacttgattctaaatctgccactagcacgcatcgttttggcgaggcagaagatgaaggcaaactagatggaccggcgtctgtggcaaacaaactgctccagcacaagcttctgcttcacgtctttgtttgccatgggagctccggagagggccctaaaataggcgaggtctggacctccaatttctaatggtgcccccttgaaagctagaggtgggacaatctccgctcatataatctccgctcacatggtgcacgagaccgcatcagagcaacaaccacacgtgagaaaggttgctccaccagtcgctggaaaccacagggcttttaactatttgccacttttagatttggcaaataactactccctcagtaaaaaaaaaagacaacttctggggataaaattggacaaacatttgtccagattcatccctagaagttggttttttataggacggagggtgtatttgccacccctatctcaatgacatgtgggtctacatgtgtctatgatatgtgggtccagtgacaaaaagttaattgccacatctaaatgtggcaaatggttaaatatctcggaaacgactactagaaaaaatattttcccagacggccaaaatagatttttgcaggcggagagttggaccgccagtagctcaacgaccgtgaaaatcatcgattttcgcgtcggggcaacaacccgcctgcgaaaatccattcaaataaacaaaaaatatcacgggcggcggctcgccgccgccgccctcctctggcgtcgccgcgccgggcgggaggggagctgcgccgggcgtcgtcgtcgccgccgccccgcgccgtagccaccgtagtcgccgccgccggcctcccccctccctcctccggctagatctgggagggagggggaggggagccgccgccgggccgcatcgtcgtcaccgccgccccgcgccgtcgtcgccgccgccggcctcccccctccctcctccggccagatgtgggagggaggggggaggggagccgccgccgggccgcatcgtcgtcgccgccgccctgcgtcgtcgtcgtcgccgccggcctcccccctccctcctccggccatatctgggagggaggggggaggggagccgccgccgggccgcatcgtcgtcgccgccgccgcctgcgtcgtagccgccgtagtcgccactgccggcctcccccctccctcctccggccggatctgggagggagggagggaggggagccgccccgccgctttccgtgccgccccgcgcgcgtacccgccgtgggagtagggatggcaacggggcggggcggggccgggttggacaggaacggccctgcccccgacccccgactttatcctccgcccccggccccggtaccatcttcgggtgaaaagcttcccccgcccccaacccctacgggtccccgaccccgaccgaggccccacaagctatagagaaaagaggacaaaaccaggattgtagcagctaagatgaagtggctcatcgaggaggctagcatcgcggagatttggcggaggtgcagaagccggcgacgcgcgacgaagacaaaggcgaagcagccggcgacacgcggcggagttgcagcagtcggagacgcagcgaaagtgcaacggccggcgacccgcggccgagacggaggcgcagcagccggcctgggcagaggcgcagcctcgcagggagctgacgaggcgcagcagcttgcaacgactgcggtagcgccgatgcagtcgctactcgttgactgtatctttctttttttattcttttgatttgaaaggtcattgactcgatctggatggatggctccgtgactgtatgtatggctggggtagataagatgggataggaaaagttatttcacaacatgggcttgtttgggccacatttttaatttgcaatctacgcatgtaccatatttccgggtccccatgagtcacccgcgggtgaaaacctagacccgcccccgtccccgcatattttcggggccccacccccgctgcacccgcggggccaaatatagccccgaccccggccccgtagggtcgggtccccggcgggtacccgccctcgtcggggaaattgccatccctacgtgggagaggccggccgtggagaggtgaggtgaggagaggccagccgtgggtgagaggagaggtgaggttttgaaacttagaaaaaaatctactcctatccaaatctatttatattcaagtctattttcgcaggcggaccacttaagcggcgcctgcgaaagtggtccgcaggcggacggtaaatttcaccccgatttatatttttgtaggcggttatttggctctaagggttatgaccgccacatcgagaaaaatgatttttctagtagtaaacaatgctagttcaagcagcagctacgcagaccatctttctcctccttatcggggaagagatttgatcccttttcttctacccgatgcagctagtgaagacccctgctcgagccttcaatgtcgcccacatattggctctatcgtagccgcacaagaaaaggaggacggggacacaaatctgtaggggaggttgccattaccttctgcctcctcaactaccagcagtcgcaagggtgtgtggcgaaggaatgggaataacgaggaaccgctggtcaacacggggtatggcaggcgatggaaacctaatggaccttgacgtcgttatacatccacaatcctggaccatcctcttttcagcccataaacacaatatttggatcagcttcatgggctagctggaattcaacccagccgaattggtacgttcgaacgcaccctccatcgatggctcaccattctcattgcgtgtggctcttagtttttcatttgtcgaacaaccactactagatggttttactaggacctttgattgtcgacaatcatcgagggacgacgattagagcacccgcaatggtaaaataaggtgctctctataaaacatgtacatctcagcaataaactagattaatagtaaaccacctcaatagtatgtctacatgggtatctatagctctctaatgcattgcctcgtttttctctatagactatctccaggttagtagatagttttgctctctctcttcatttaatctcttctatgtagaaaaatatgctgacatggatatcttgtagagagcctataaataactattgcgggtgcctttagagaagtagctcctattatgatcgagaagaccgaccacagatgactaaatgaggttcagcaatctagatcatccataagtgactcatgtctattatctaaaaaaaaaaagtgactcatgtctgcttgtttttgcatgggatgcaattattggggcatgtaaaggcatggaatactagtgtgaagaggggagaggtggtgaaaaccatccgattcttctggactcgacaacatcgtcatttgtgtgtcatctccttattaaagacaccatctaaaaagttgaatgaaaatttccatctgattttggataacagcaagagaaatagtggatcctttccggaggcctttttttaagtagttgtatgctttttgttctttcatgtggatccatttctacaaaaaaaaaacatatcatgatttttctatgacgcgtcatgcgtgacggtggactaaacaacacaagttttatttttattaagtagttaaagataaaattaaatgtggtagatgagaacgtagtggaggatagaatggtgataagcaattttgtccttttttatgagatattatcttctctttgccaaccataattaataatttcggttgatgggagtagatatatttatgatgccatatttttaaataaaaatagttacttctctctgtttcaggttataagacgttttgactttgatcaaagtcaaactgctttatgtttgaccaagtttgtaaaaacaaaatagtcacattttcaaccttagccaaatttattacaaaaatatattcgaatatttatttgatgaacactaatttagtattataaatatcgctatatttatctataaacttagtcaaatttgaaacagtttgattttgaccaaagtcaaaacgtcttataaccttaaacggagggagtagattgtttatacgtgtaaattatgtaccttacattataattatgctataaatttcaaaacttatgatgtaataattgtaagtttcaatattgtaatttttataatatacaatgtatataagagaattgggattgaacacaatttattgtttttatatatagaagagggagcaattaaaatgaaagaaaagtgattgaaattaagtgaaaatgtgacgtcataattttagcaatccgatagtaacaatttgataatgctattttaagaaaaatataatcatgtttagaagtatctcaactaatcattactatttcagcccgtggtagacttaggctgagttcttatctctactttcttaactcacctatcacttttttcatgcgcacacacttttcaaactgctaaacagtatgctttttacaaaaattctctatataaaagtgacttaaaaaatcatattaatccacttttcaaatttattttagctaatacttaattaatcatgcgctaaatgttgcttcgttatacgtgctactcccgaacacagccttaggatgagttctaatctatcctttcccaaattctattatctcttccgtgcgtatgtttctcgaaataataaacggtgtattttttataaaaagtttttataagaagattgctttaaagaatcacattaatccatactttaactttttagctaataactaatggaatttttttcttcacccctaaagtatggggttggtctccttaacccctgaaacatgaaatctggtattttacccccataaagtatgaaaactgtctaaaataaccctcttgagtggttttttaggaggtttaactatgaacatgatgacgtgacggtggttttagccacatgtcattaggtggctaatgacatggtgatagactcaattaattttttttcacatgtgaaacggtttgagaatgatatacatttgtgctaatatatactgctatttcataatcttgccaatcagcgagagaaaagaaaactgttggatcaactttggtttagtggactgatcttcatgtcatgtaaacaataccgctaccacgttatcattaacatggcaaaaccacataaaatatcacttaaggagcttatttgagttggttaacttcaggagtaaaagacctgatttcatatttcagagggggaagtatatcaacccaatacttagggccccttttgaattgtaggaatgaaaaaacagaggaatagaaaaaacacatgattctgacaggaatacaattgtaaaa

SEQ ID NO: 35948 - DNA, 631 bp, Oryza sativa
aagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctca

SEQ ID NO: 35949 - DNA, 611 bp, Oryza sativa
tcggacggggactgcggcgctctggcggtcggcgagctcgacaagggggtggacggtgacggcggcggtgcggcgaagccggagaatgcgacgctggggcgggaaacggtcccggcgagcggagagagccggccgaaggtcgtcggcgacggaggagagagagggcgacggcgcgagctcgattccggcgtggagaaggtgcggcaaaagggtggaaacgggcgaaggaggtgcggggagggtttaaatggggttggaagggggagagggcggccggggaaggaaggaaaccggccgggaggtccgaccgccatcaatggcgccggcgagatttgcgggagcaaatccagccgtttgaatgcgagagagagagagaggggaaaatggggggaaacggggaggggatcacggggagtaattcccccctattgatttcacgcgggacgacgggaggcggcgggattcacggcggcggcggcgctaggcgcgggcgaggcggcgggagcggcgggaggaaggagatgacgggtgggccccacccgtcagcgagggtggcgggcgggcccacccgtcagcggcgcgcgcgtggggagaggccggatgggccgtga

SEQ ID NO: 35950 - DNA, 689 bp, Oryza sativa
ctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataagg

SEQ ID NO: 35951 - DNA, 758 bp, Oryza sativa
aaaaaatatctacattttaggatagaggaagtaatacattatcaacaactgcaaaattaacaccatacgaatgtgctttcgaatgcgaatacgatgatatcatatgcatgccactagatatatatatatatatatatatatatatatatatatatatatatatatatatatatatatatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccg

SEQ ID NO: 35952 - DNA, 699 bp, Oryza sativa
ggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactccccaaggcaaaagtacgataaatacaagatataggaaagaaggcaatgctttcttttttttcatttttgatctgtaaattgagttgttaatgaatccgctttattcgctgactctatatg

SEQ ID NO: 35953 - DNA, 744 bp, Oryza sativa
tgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggat

SEQ ID NO: 35954 - DNA, 408 bp, Oryza sativa
aatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggttccaaaatagaggaataaaagaataagtagaagaattaagttaagtcaatcca

SEQ ID NO: 35955 - DNA, 1848 bp, Oryza sativa
acagtagtccatcaatatagttttccttgcgacggccctggtcgcggcgggacttgtgatatttctgcttgggacgggttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgccacgtaatagtgcaccgacacgccttcatcgacgttgttttttgaccggaagacctagagctaactatcgagactttgggctatccggacacatacttcgagaaatggtttatgcatgtttgttaccgggtgcaacaagatccagttggtaaggataaaatacccttttgtatttgtatggatttctggaattgatgatcgtagaagagccctctttaccattctgtataaatggaatattctatttgtatagaataattgggttagtaagggtgcggtattcaaccccccttttatccactagttcccctctctttagtttaacaggatagaacagtttggtagctgacaaggctcataaccgtggggttgcggggttcgattcccactacccgctccatattccttctttatgatatatgcatcatacatttgtatatgcatttggttttctttcctaaaagagttttggtctaacagttttttctcttggtccgataaaaaatgaaaagaaagaagaaaatatgaaaaaagcgtccattgtctaatggataggacagaggtcttctaaacctttggtataggttcaaatcctattggacgcaatcttatttctatctattctttaaataactatactaaaaactaagaaaacttttttgcatgattcaaatgaaaaatctttctcaacgatttctcctctactacttctactaacaagagtagacgtgcaaaatttatgtttgttcctgaagggaaaaccgttcgagttgttcctgaatagcttccttcaaaaggatttccgcttcctcggtgaatgtcttgctagaagatataatttcttggaattgaggtttaatatcttttaggtgtttacgtaactcatccagaaatttctttacctgtccaatttctaaggaatcaagatatcctcttgttccgatataaatagtagctatctgctcttccactggaagaggatt

SEQ ID NO: 35956 - DNA, 1240 bp, Oryza sativa
aattttatgaatttcgtcgactcgaaggagttgccattagtgtttcttaactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaaacaactattcagagttcctagagctccttgtacggcttgttggaaaacccgttgtcggacctgattcatcgccctttgtttttcaaaataaagggtttcgtttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttatcgatatgagtgttctatatcagataaattctacattagctatttcctgtttaaagcatttggtactaatactaatatagttgtagaaagagtacccccttttgcctagacttcaagcagtttagctttaaccgtgttaatggtctcatattattggtctatagagaatcaaagttgatttgatttaccaataggtcgcgaaatgctatggttctttcatgatgaagtactt

SEQ ID NO: 35957 - DNA, 1014 bp, Oryza sativa
taggatggggcatgttggattttccatatccatagaccatttaaccttaagggttccagaaccctccttttttgctagttatcagaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcattcttagtttaaacactaagcgaagcaggggggtgt

SEQ ID NO: 35958 - DNA, 233 bp, Oryza sativa
ataaaaaaggaaaaagagtcaaagaagggatgggagatgtttcccatgtcaaatcaaaaaagagaggtgaaagataccaaagcaatgcggcctcagactggctgtctcctcgtagttggatctccgactttttggaatgttccaaattccacttgagcatccaagtgtggatcaataccagcaaaaacatctcggaacaaggttctagccccatgccaaatgtgtccgaaaaa

SEQ ID NO: 35959 - DNA, 100 bp, Oryza sativa
atcccttatctcaagtttttgatcaaaccaatccattgacacaaacggttcatgggcgaaaagtgagttgtttgggttctggaggattgaccgggagaac

SEQ ID NO: 35960 - DNA, 2060 bp, Oryza sativa
  unsure (1)..(2060): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattctcctcccacttcggcatagcgacgctatagccgcctgaccccaagtggtgatggtacttcttcttggcggcattttctttgtttctttccatcatcgcctacccttgttgacctgtcttatatgcaacgaactcgtcctagtgatcccttagctttgggaatgtgtcgaagttcggtgtctgccccttcaggatatatttctggtacagatctcccttgaagctctgaaacagttctgccattttctttagagtccaccttttcactttgtcctctgtacccgcgggaagggtgaatgtctcgagcattgtggtccacagcatctctttctccgaatctgggacaaagctctcatgatctccgcgtgcccttgttctgcgccagtacaccatactgacaggcacgttatcccgcacaacccaatagctgtgtcgtacgtagttcttggctgcttccgctggggcactaggtcggccatcttcgtccacttccgttatgatgtgccgaccctctagtttcttcgtggcacctcgttgcctgcgtgccctcttctgtccagcggagggttgacttccactagcctcctcctcctggttcccctccacatcccttctccacgttcccctcctggttcccctccgcttccctctccacgttcccttcctcgttcaagtactggtttggatcctcgttcccctcttcttcgttccagtactggctgcttccctccacgattgtattgtacagtatctgttcctcatcgcgatcagccatctgttcatacaagaaatatttgctaagtctataggtcatttttgctttaacaatcttatatgctaacaatcatatatgctaagtcaaatatactaagtctaactgtcgtatattagaaccctacacaatcctacatgctaagtcttattaaaaatctaataatcttatattaaagctctaataatcttatattaaaactcaaataatattgtattaaaactctaatagtcaactatgctaagtctaagtgtcgtatattaggaccctagacaataattatatactaagtctaattacaaatctaataatcttatattaaaactcaaataatcttgtattagaactctaataatcttatattaaaactcaaatagtcataaatgctaagtctaactgtcgtatattagaaccttacacaatcttatatgctaagttttattacaaatctaataatcttatattaaaactcaaataatattgtattaaaactgtaatagtcaactatgctaagtctaagtgtcgtatattaggaccctagacaataattatatactaagtctaattacaaatctaataatcttatattaaaactcaaataatcttgtattagaactctaataatcttatattaaaactcaaatagtcatatatgctaagtctaattgtcgtatattagaaccctacacaatcttatatgctgtcttattacaaatctaataatcttatactatgctaagtataagtgtcgtatattaggaccctaggtaatcatatatgctaagtcgtctaagtgtcgtacatttcaaacttagataatcatatatgctaagtccaagtgtcgtatattaaatctaatagtcttaattgcattaaaaatctaacaatcatatatttacatcacttgcctgcgcgaattccttcgagggttagctaccactccggcttgagggacgacgacgactacgtcttttctgcaacatacaaaaagatgtattaggataaacgcaaagtaacatatattgtatttcacgttcgcgttctcaccaagttcatgtttcattcacgatcgtt

SEQ ID NO: 35961 - DNA, 2915 bp, Oryza sativa
aggctaactctaatattagttcaacgcatagcattctgtaccattagcctatttacattccaacattcgcacatatacaaccaaaaggatgcttctgggacatggcggttaaaaaggtgcttagcagccattcatagcccttaacagtttcctctgcaattatgccacaaccaaacacaacagtgctccggtgctgattcaatcccacaaaaggaataaatggcagtttatacctgttggtcatgtatgtactgtcaaatacaacaacatcaccaaaagcttcataatctaaacgagattgactatccgcccaaaatagtcgctttagatgtcggtcctcatcggcctcaaatctgaagaaaaaatctggatccctttcctctcgtgcccttaggtgtcttaaaacagtttcagcatctccttctactattgtttcaatcttgtatctatgacagtaattatatagatctgtatctataaacccaacattctcataacctccatattgcttttccattatattcataatatggtgctttcgaactcttgcaatttccatctcgattatttcttctttttgcacatcactaatgacccgatgggaacggagaaaacatgtctgatctggggcagctaacggatgattatggtcatcaacaaagtctttcacataccactgacctatgtccttgtttagctattaccagtttggccttacaaccacaatgagtgatgtttcttgccttccttatcctgttgtccctcttcacatgcttcgattctcgatacccttgcctactacagacaatcactctccgtttgacctcttttgcggcatttcttctttcagcatatgattttcttatgctaaagcctttatcccaagcgtacttgttgtagaagtgaattccttcatcctcactattgaatgtcttgctgacaatttgttggtactccaacaattcctcaaccaatatccatgtatcctccatcagtgcttaaaacctacaagaaacaacatttaatttttagaacaccctttaccatcttgagttaatttataattttaactcaaattgtacatagcaaattgctttgtataaacaaatctacaaaagctaatttagtgtacaactaatttgcatgcggtacatacgaaagaatagtgcactgcattaacaagaactaaactatgtaaataagaaaattcaatatgtgtcaattcaggccctacccaagtaaacttagggatccatgaactcggtaaaaactataacaattgcgtaaataagcataggagatcttacctatgcacttgttacgtacttgtcaatcagattatgtctgatattcaaacacaaaacagtgccaatgcttctccctcaattatgtcaccaagcaagttcacctattcaaaccccaatatgaagaacatattaggatatctctttttgatcccttgtacgaagaaatttgtgaactacataaataactaatcaactacaggttctcctttcggtgaacctgtctccttccggtgaaacatccaaaccctagaacaagaacgaacccaagggaaagaagaatggagatgcgatctgttacggatcgatcggattgatatccgtgatttactcttttctctgatggcttaccgatctggatactgacttaccgatctgaatactgacagatggatgttagtattcaattaacgtataatgcccatgttttacaagttaattactccactgccatcatgttacaatatttttgttccgtaccttgcccctctcttgatcaacggttcacgttgttccacctccaagtacctcgcaaacaccgtaaaagatcttcctataatatgtaacaacttgattgagcataatcatgtatatagaaaatttctaatggaaaaataacagcatactattctgctagcctatatgtaacaatcataactattacgcacctccatgagttcctagactgagtggtggtagatcatcactatccttactattattcccagtcatgaccagactaaaaaatcccaaataggtggtcatccttgctgacttgccgttattaacagaggtaagtttgtgtttcaccaaaagaaaaccatttagcaagtagagtagtgtcataccaatcaaactcacaaaaaatgggtagaaaaatgtcaaaatccagcatgtagagcatggtgcacaatatttattttgttcatgggatagtaggctaaaaccgaaacaccatcaaacttctttggcaagaagcaaagcgagcagcagaataagagctaaacatatggatctaagacatgactccctggttgcatatcagttaggcaatagttaaatattcctggtcattgctaaaaccactacaacaattggttgatactctaggccgagcaagccccttgatttgttgatcaaacatgaatgatgaatcagaatatcaccactagaaaatgttgcaagggaagattgggggagagtaattgacggagcgtggggctcctcaccgggagaccgcgctggcccctctttgccggttcggccggggaccctgggtgagactctaagctcccaatctgtggaaggttcacgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctagaaaagtccaaaaaaatctcccttctctcagtgggcaaggtcctccttttatatcttaaggggataccacatgcaccatttccctcttttttgtggggacttcccccaccttttcataaatggacggagattttatcgttgccgtccga

SEQ ID NO: 35962 - DNA, 2083 bp, Oryza sativa
ccgaccccctcggggggactaagaggagggcaaacacatcaccctcgggcccgacgtcccccgagggtgccaggccacgtgggcgtttgtgtctgcctcaaacctctagtcatgatactcctgatcccatgtcaccgacagtaatggactctgtaattgtccaaaggttggtctacttctcttttattttcagtgaaactgaatagcgcctctagttgctcacttacaggatttggagtgcaaaaacttgagatctatgtcaggaaacatgcatcatgattacagagtataagtggatcatactgttggaatcaaacacccagtgatcattttcatccattatcataaagatcatctaagagtaacttgcagttccttcaatactgtttctcctccttgcaaacatcatacacaatattagatctgttaatgaaataaaggtcaaaaattattttatttgagtaaattttatttaatacaaatattattaaaaacaaaaagatagaagtaaaaaaccaaaaagtgtgtatgaggcacatttgcagagagctgagcaacattaaattctcaaaaaaagaaaagaacttgccttcttttgcagtatgatggcacactgaccagaagatgagtccgatactcctatttctcatctggagaggaaagagtgcatctaacaaggatggtggctagtaaacagtcgagcacgaacatcagtatatggtagcaaatcattggagtctatctgtacatagtcctgaaattcctcccgtagaatcaaagtgtttttgcttgttattctgtgatgaacaattggcacatgtgattattggttttgatatttagagattattggcgaagtggttttggagatgattgattttcaggtgatgaacagggttactgtttttatcgggtccggtcagaccgggctggtgctgccagtcagactggcatgtatcaagcggtcagaccggccagcccgtggtctgaccggccgactctgtgtcggtttcggtttcggtttcggttgtttgtttggatatccgtgattgtttcatgtatatggcttctagatagatactatgcgtatgtaatactgttgtttgctactaatgagtcaagttggagatagcttggtctcggaatatagtttctttgtttgattcatatgcaggtgacttgatgcctcaggagagtattgccggtgatggatcgggagtcggcttggggataagacgatgtccgcgacggtcagatatcatgtgggatacttaggctagagttcaatacacgtggttggtgaagattccacatggcatacgatgaaggtattgtgtgcgtatgggatgcggagtcgaatttggaaagagtccaaatttggtatgattggagtttgtaaagtttgtttcttgtacgggaaggtttcctatgtggattaggacttttagtatgagtttggttcgtggctttaggctgcctacctcatgtataaatagagagtgagcgtgagacttcccggtatcgcttttgagagcattgagttgatagtttagttagggtttcgagtttagtcgagattttcatgaggagtgttgttgttgcactttataaacacaaagagaagtaataaagttgtcatctactttgagagttctttgatttatgttttctcgggtttggcggtctaactggtgagacaccggcggtcagaccggcggcattgtggcggtcagaccggcagaggagtggcggtcagaccggtgacggcttcaggaggcataggcgatttcagggcggtccaaccgggcaatctacaccggtcagaccggcggcacaggcgcagtcagactggcagatcaacctcggtcagaccgatctacatcgaatttgagggtaacttttaattccgtaaaaagttgggttttttttagtataccaaccctctagttggcttagttcttgtgtttcaatcctacacctcccttactcctctatgcaagctgaaacagaaaacacaaaattttctcatgtgggaattccatcaagcagctagtacacatataggacgttacctgaggagaat

SEQ ID NO: 35963 - DNA, 2019 bp, Oryza sativa
aaactgagttagataaaatatcattaaatactttgcttgtttatctgtttcctggaattttctgggaattattttagcaagggaagtatatttaatcaacaaaatagcatttcacgaattatttaaataagaaaaagttttaaaacctttctctaggcaaagcctcactcgggctgcaagccatgccagcctgctgctccattcccttcttttcctttctttttccttttctctgaaagtctacaatgcctccctcggcactgttcatcttcaacctcaggccagccaattgtgtccgagctgctgccgcctccctttgaatccgcctccatcagttgctcccgagaccgactggatgaggggaatttatctcctcgatgttctctatctttacccttaaaaaccggagcttaattccttgtatttcaaccgaatcaaactcgtttagagtttatctctccaaccaaaccatcggattttccggtttcgattcctttcgttccgagttcgatctccttaatccgagcctataaatagcatcctctagtcgccctcttcggtttgcctcgtgttctagttgcagccgtcgctcgtagcgccgccgccgtagccgcttcagccgcctcgcgccgtcgccgtggtggtcgtcgccggtcgccgtcgctttcaccgggttcgcgaggagaagccgcagaccgtcaatcccttcatcggcgttgcaacccgccggaaagccgtcgtcgccgtcaacccgaagccgccgcttttggaagctcgtcgccggccgttttctgtcgtcgattgtcgtcgccgtcaccaccggtgggttcctctcgtcgtgctcgttgcgatggtgctctctgtttgcgccgttgtgccttcgttcgccggcggttgtgtggtccagaaccatgcccggcagtgatgtcatcctgacatcataaattttttatttaaatcgtaataattttctgaattaggtgaaaaactgattaaacttcggaaattcatagctaaatcatcgtaactcggattccgagtggttcaagttgctaaattcatctaaaatcgagatctacatgttaaaaatatccacatgtactgtttatgcttgtttttgtactgttttgttgattttgttcgtttgctttagtttccgatgttcccgaggagagcgtttacattgagtaaggttcagaagtgtttaaagaagctcagggcaagtcatacagatcccaaacaaccctttgagcatgttgaacccgtttaaagctaatgttttatttcaacttatgcattattttcgaatgtcatcgggtggtgagccttttcccaattaattatggccgaagatgactttatcttactatgggtaataaattgattagctcgaaccttatatattggtttggttcagctagcctaaatgctatatatataattgcttagccatgcttagaaacattagctcattaatgggataaatcacactacattactacttatggttatatttaatggtagctcacgatggttaatcgtgctatgataattaaaatttgattaatggtgggttgtgagcacatggttttgatggtagtctcatgacaattaaggaccggttcgcgagctactgttgtgaaatatttaccgtgccaaccacaagccagcgtgggcaacggctttaccttcagtatagcatggttcattacggggtgccagactgagaagcggcgagaagtctatgggggtcgctggggagttcatgcctctggttgtagagggggtgattatgatccaggattggtgcactgtggtgagttgtattgtgcgagggggtattgtcacagttcctttccgagataccgtggtggtattgaggcgcatggtgacatgtcgtggagctgtgtcttgtgggtaaagtggtacatctctggccagagtaaaactatttaaatagctgtgcccgtggttatgggcgggtctaataatgtttttcgtgattagtctcacactact

SEQ ID NO: 35964 - DNA, 710 bp, Oryza sativa
  unsure (1)..(710): unsure at all n locations
acagtagtccatcacaaatagaacctttattgatttgctagttgataaggtaaatatccagcccactaaatgctaggcttagtgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatncnnnccgtgaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtccttttttagattttaggagagatatcctacgtttcctttagtatagttttcatttccctattagtacttgtttatagactggacaggcgcctgcgccataaaatagagataaaaggattaccagaggctcattcatcgaaaattatagagacaggaaaagaaaaatgaatttctatcaaatcaactgcaagatgttctccatcttgcaaattcc

SEQ ID NO: 35965 - DNA, 396 bp, Oryza sativa
aaggaatgacgaacataccttgtctccacattggatccagaacaggatcagagggatcaaaaaccgctaattcgtataaagccatcgagccagcccaaccagaaactagagctgtgtgcattatatgcaccgaaagcaatcgacccggatcattcaatacgacagtatgaacacgataccaaggcaaacccatggaaatacccctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctgtactcgata

SEQ ID NO: 35966 - DNA, 1121 bp, Oryza sativa
aatactccaagactccacctttgtcatatattccatatatcacattagatagatatcatattcatggaatacgattcactttcaagatatcacattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcaaaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattctcttttccaagtaaaaacccccagtatatgaaagaatg

SEQ ID NO: 35967 - DNA, 2583 bp, Oryza sativa
aaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgcgtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagt

SEQ ID NO: 35968 - DNA, 1554 bp, Oryza sativa
attttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattccaaatcgtaatttgattgaaacaagaaataccaatttcatggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacgtatgggttcgggaaagggatcccccgaatattgggtagccgttgttaaaccaggtcgaatactttatgaaatgggcggagtatccgaaactgtagctagagcagctatttccatagctgccagcaaaatgcccatacgaagtcaatttcttcggttagaaatataaccccccaaaaaaagtagtattgaaaataaaaaaccaggttcttctttctggaaagacaatatttctttcatccttttgcattgaaataacaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaa

SEQ ID NO: 35969 - DNA, 712 bp, Oryza sativa
gacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcatcgtatacgtcattagtccgattctttgtaggaactacccgtaataacgagctggcaaaatggatc

SEQ ID NO: 35970 - DNA, 753 bp, Oryza sativa
tcacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataattt

SEQ ID NO: 35971 - DNA, 219 bp, Oryza sativa
gtacagtagttcatcattaatagaaatagattcaatttagtaatttcttttagattaagtcttagatctcgtttgaccggtgaaagacctcctttgttgaaatgttcccaaaattcctaaaataaaaggaaaaatactttccactgccctaaacaaagggcgggaagcaagacggcgaacatatcctctaaattgatcatcctcaaatcagctattcct

SEQ ID NO: 35972 - DNA, 844 bp, Oryza sativa
ataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagccttttccctgacttgctgcatcaaaaactaaatcacaagcttctgataaaaaacgggtggttctgatgaactacttgcag

SEQ ID NO: 35973 - DNA, 328 bp, Oryza sativa
taaaggtatgaaacaaatccaattggtaaaaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaaatcacacctaaggcaatcggggcctttgtttattttgacacctaaaaatgcaaaaatcaatttttgaaaaaaattgcaagaattgatttataataagcactcttatcaat

SEQ ID NO: 35974 - DNA, 672 bp, Oryza sativa
ccgccgccgcctcacatccactccactctctctctctcctctcccccgcaaatcccccccaaaaaaaaaaaaaacccgccaccgcgagcacgccgcgcgcctgcttcctccacctgcgccgggcgagaagatgatgctcccccggctcctcctcctcgtcgttgcctccgcgctgccgctcgcttccgtcgctgcgggcgccgtcggcgtcggcgaggggttctgctcggcggagccgtcggcggcgtcgggcggctgctccggcgtgcggccgccgctctactggaaggccaccaacccgactctggcgcccgcgcacctccagggtgagtgagcgtgaggcggagcgatacgtcgcgagttggatggaatcttaaagattattgcataaataggtgctctggattgcgtcactgcagtgtttttttagaactgcaatatcgtgatattggttctggatttggagttactgttgtggagtatggatgttgatgctggttgagacgctcgggatagtgtttagttcgttcagtttcacgatgataccatactctctagaaggaatttctctgtgaatggtgtggcttgctgtcgagaataagcttggaactaggtacgtagtagtaggtagtcatgtgggactgaatagaatggctatgatttcacgctcgt

SEQ ID NO: 35975 - DNA, 298 bp, Oryza sativa
cggtggtggtggtggtgggtggggttgcgggcacgagggggagtcgtgcgcggcgcacacggcggggaacctgtgccagagcttcctgctctcttacggcgtccgggtcggcatcggcatcctcctccgcgccttcaagctcgcccgccgcagatcctactcctccctcctcgacctcaaggtcctccttgctcctctcctcctacctgaatttgcaaatttctttcggttagtgctcaactgcgccccatattagattagtttagtttggacggaattattcggagaatttggccgg

SEQ ID NO: 35976 - DNA, 18396 bp, Oryza sativa
  unsure (1)..(18396): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgctgcctagatcatgtggatgccccagtattagtttataagtatggtgacataggcttgcatgatgctcttttcggtaacgcgtggcagcagtttgattggcctttcgcttgcgaaatacgtctagagattgcagttggtgctgcagaaggccttgctcacctgcactcacttaatgtggttcacggcgatgtcagaactgccaatgtagtactggatgtttattctaaatctaagctcgaaatgcctgggataactgcatttatggcaaagattgcaggttatggaacacaaaggctcctttccttggataaggccaagcatgaaatatttctaacagagaacatccattacaaggatccacacttcctcaagactgggctcatggctaaggaatatgatgtatatggttttggcgtggttcttgtggagctcttcgcacagaacatggtgcaaatgcatgacgtaaacatggtgctcaaagaacttgatggcattcctgctagatgccatcatcttaaggaaattaagaaacttgcttcttggtgtcttgcatccaaggtgacggagaggccagcaatggacaaggtagtacgatgccttcgagctgtcttgacaaacctgcaaaatcttcatgatccctgcaactgcaagtcaatgtataataagtctgcgatgcagtccgagcaaattaccagtgccaagtctgccagtagctgatagctccacaattgtgatataggaagttaatacaagttcccaattaatgtgacctaaatgtaatattaatatatattggtatatatgtgtttgtagaactatttgctggtcaaatatagggcaaagccataaacagtaataatatttcttgctggattttctgctgggatccagcgattggagagacagaaaatgtactgttagtagtagagatggcaataatgacaacacaaacccttctaattgtgtttccagcagatatccagatcttaagatgctgtttatatatgtgtaacattatccaattttacaataaccctcgtgatcgacaatacgggggttaaattcatctcactagagcttttttggttgttttgttgtttgttctgaggtttggttgttgcatgtttgcggaattgcatgcgccacagatagcaagtagcaaccgctgtatttagttctactagttagcgtgcacgtgcaaggcacatcgaattatatctaatggagtacaccatgttggttttttacactaacaatgaagaggagaaatatcaattcaaaaaaaacacattgcttgaaccaatcgagatacaatttatgttgtcaatcatgttcgaagaacgtgcggaagcattaggaacacagagccacctaggagtgttcaaccctagcacatgtggtggttagtgggggtgtggcgtcacaacgctccatatttaaggttagaggacttttacggtacattctacttcaagtattcaagtatatactgttagtatataatagggtaggttcggtatttgttaaaaatctgaaaagggttgtttagtcatttaaaatagagattattttggtttttttaatcatgaatagtgataaactttcccgtggttttttttctgttgtggatatcgtcatccgcgtgtagcgcttcttttcatttcatccggcgtccccggcgacggaagctcccggcgcacctcgctcccgccccggcccagcgcctccatcccgatattacctccggcgccgggagaagccgatcttccatgcgcccggcgtcttccgccgttccgcatccccggtgccttgtctctagccctagcctgttctcccccttatccgacctcccacagcttctgtcttccccaaaccacggcggcgagggttgatggttttggagtctaaacatggtttatatcgtataaagttcgaaacgatgttaatggttttggagtctgaacattcttctttcacggccttctctggaagactggaacgtgggagttgaatggatagtagtcacagaactgttcatacattagttatattggcatataaccatgctaattatacattagttatgctaattatgccgccctgccgctgccacctgccgccgccgggctgcccttgccgctgcgagctgccgcagctgcacgccttcttcccggcgcccttctgtagctccgcctgcccgccgcctcccgcagacagggcgtatgtcattgaactccgagttgaggatggtgtcgaactcaacgacgaagaggtggttggtcgcgttaacgtcgccatgccatcaaagctgagattcgcgccagtgaacccgttgaagacgaactgctcgtggccaccgcctttcgcagcccgccggcgccgcctcccgcaaacctgacgaattggggattttcggaagaactaggttttgggtgaggaaagggggagggaaattgaatcgattcccgatggcagcgacgccggttgtggttgtcgacggcggtgcggcgcggcgtgctcgcagaggcagtcagcgacagtggtcgcccacgcgcggcttcgagaaaaattcgctttgcctgtgcacctaaggccagatctgactaagtgagaaacacgaatttacaaaattacccccacgcaaatagataaaaaagacaaatatgccccattcaatttatactgcagaataattgggagaaagatcagatgttattttctccgttagatcaaatatattggtagtatatacttcaagtagaatgtatcttaaaagtcctctaacggcttgtttggttggagggagttttgaataaggaaatgggagtttaggagattgagctttttaatctctagtttgattagaggacttgggaattttagagggactggcatagagaattaatctatccaactcccaccgatcccatccctggggacctgttaattcacgagacttggtgggaattaaacagcagaagtccgaaatacccctctcccgcacactccgccgtccattgccgcgaaaaggaataaaaacgcgcgaaaaatcctgttcactgccgcgaggaggagtaaaaacgcgcgaaaaatccccatctcagcgccactttcctcgcccactccgttggccaccacgagaagcaataaatcctgtgaaatatcaccagcgattctccccattcacacgcgaaaccacagccaaggttaggttctgacgcaagtttgttgtgttcttgaaaactctccctctttctccctctctcctgtacagatcgagaccacagcctcatgaggtctggattctctctttccccatctttctgcagtacatgactgagaaatttgtgtctttctcctgtacagatcgatggaagcagctttgtaaggggaaaaggtggggggggggggggaaaaggtggttctgatctgctgttcgtacttctacgtctgttgttgctcaaggctgatttttttgtagttttgctctgcagtttatcacaccaaaagctgtaggtactgatgttattctgttctctatttttttttcatcagtcgattgccttgtttgattttccaagacagatcaatcagatttggtattttagtattaatggtagtaggcattttcccagtgtatagagtagacctgttcttaatttttttttcatcagtcgattgcctttatagattttccaatatagatcaattcgatttcatattttagtattaatggtagtaggcatttaatctgctatagaatgacacatagtgtattcgtcaatttcatacgtgatacatacagaatggagggggatatgatcagtatcaaaattcatcatgggggatctttttcaaaggagggtcaactttgctatgttggaggccaagtctctatttttcgcaattgtgacagcgaaaggatgtcatacttttgtctagtagacatggctaaagatgtaggtttcaagggtggagatgaactattctatgctatccctggttatagtcttgaaaatggaatcgacaaacttcatgatgatcattcagttcgtaaaatgttgaattttgcaaagaaaggcaagtcaatggaaatttatattaagcatcttgaataaggtgtaagtgctactccaatatttggacaggatgttgaagataatcatgtggaggaggtactgtacttagaaacaacttttcttttccttccgtattttttttctgatgtgctgacgtgtgatactgtgtcatttcgctatgtttttttttgttgtttgtgctgcttgtgcattttttttcctcatgagcatggtaccttgataaagtatagttagtacttgatcttgacctatttaaaatcctaataaatttgcaatataattttgttgacagacatggctcgccctccaaccaatcgagatattgtaatcttttggaacagaatgagaacacgtagagtgaaaatagtgatgacattgtatttattgatccatagcggactgtggagactaactgtggtgttgttcaaggccaccagcatcattgaggcccctggactggcagcggcagcgagaggtctcagcggcctagggtcgagtgaggattgatgtgcatagatgtaaatccaaacgatatcgtttcaatgacaatgtgagaataaaaaataaaataaatagaatatatagattatttgacaaagcagagataaccgttctttcgtttacaactatgccgtaggttgccttcaatatgaaataatcattctagtgctgcgctgttttaaagctaaacaggttgaatagagaattgacaagcataacaagtcataatagtgtcagtaatcagttacaaaaattgtcatatatcatgaactgaacatacaggaagcaaacacattctgtcagttagaaaaaaatgaaaagttatcaaaaaaactttcattgattttcagcctacaaatcataagaactctcattgattttagcgattccagttttcaattgtttcaatcgatctctagatcttgatggtactaacaacccattcaatataacttgattgtttctaggaagggatgatcatggacgtaagtaatacatacacttgattgtgaatcaatgagagtttcttttgttgaacgactgaaaaatttctactgcacttttgagtgaaatgatggcgaaaagaacacagtgaaatcaagaacggcctgctgctcaccgagtcaaggaggatgttggatgccttgaagacgctagatgaccggtgtgtcggcgtagtgaaggaaggcgagccccttcaccgcaccaatggcagtctacatcctcctcatccatggtacaggactatcgagaccttcacacaattacagttcaggtcagcttctacaagtctttccggaattgacacagaggtggtggtgacaaactgacggtgaaggtagcttttgtagcgtgaggttcagaatgaataaatgacattgcagactattaatatactgatggaaaacattgcaagatgtgtctagacaatgaactcaggagataacgataaactccagagcaaaacatggctgtccaaggttatgaaagattacaacgtagcccatattaatttggtaaatgttcagaattaggattataaatttagatacgttatatgaactataatccattgttttccataacagaacaaagatacaagtccaacgtagcccatattaatttggtaaatgttcagaattaggattataaatttagatacattatatgaactataatccattgttttccataacaatacagtaattcacaatccaaaatgcagattcaagtttagtttatggactgaaaaaaataatgtatgacaaggttcagaatcatttaatcaataataaatactgtcaaattttcaaaataatcaattcacgttcagtttcatcaaaacagtacatgtaaaaatgcaacattcaaataatgctgtacaagcatcaattgcatcgttccctcggcctctgccaagtgccaagtgaccaacatggctaaagagatcaatcatacagcattaatgtttcattgttggcctgataccgtaatgatacaacatgaaatattcatgaagtgaaaaatttctcaaaggtataaaataaaaaggaatttagtccatctaaaggcactcttagttttatatgcagagcatgctcaaaaccaggaatgacatggcaagctcgatgtttacataaaaatctctagaaagtttagaatgcgaatatacttaaacaaacttcaaagttttaataccaaaatatattaaatgaagggattttgtgaatctaaaggaaaaggtatcatcaagcagagtagcaagtcatatatatgggattagcatcatttacctctctcctgaaccccagttgttctcttatttgctgctggaccaatgcattccattcattccagttattgcatcaacttctgctacaggatcactaacaaatttcacaattccataaacctattaacacacccttaactgaaaggcaatggaccctaaatgcctcttgtagcatgtagtctgcaatatctgcagccagatcccaactacaatggcccaattcaatcgaaagaccatctcaacattcagcatcatttgtgcagtgtccactatatgtctgatgaagaacttgatcagcagctgcctgcaacgcttgtaatctcaacaaagtcataaccctgaagttgtccactttgtttatcccagataagcttcacagattgaacctgcaaatcaatgcaaacatcacaatatggtcaggcaaaaacacaaagttgacagcagtagttgttgtcattcatccattatcactggagcaaaaaaaccaagtcacatatagcagctatgtaactgttatatggtctgcaaacttttttttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgtctgcaaacttagcacccatgtggaaacatgtggaaacaatagataagtagaaacaatcaaacaaaaccttccaaagcccataaattagaggaagtaacctgttcatatttcatgggcacagctctagaaaaaaataatcagagatcagattgaacaaatatctgctgctgctaacaggtcaacatctatctagccaaaagcaaaagggttgcaataaagttaagtggaacctgtatcataaagattatttattcttcgttaagcaaaatataaaatgcaactattgaattgcagtgtgataagacactgcgcatgttatgaataaattagactttgtacacctttgcaatcagtattattatgatcaaatcctttccaaattgctctaaaaaaattgtatctcatcagtattgctccgatagaaatatatttccaatcagcattgctcctatcaaaattaattgagatacatgccctgaaaaagtatataatcacatccaaagtttaattacaacgataatataatcatgtgtttgcagaaacctcaaaaatatggattatacataaattgagctgtaagaagcatgcatgaactaaaagtaaaaatatagttagaatatgtatgcctattgcaaactaaaatgcaatcttaaaaataaaatcatgtttaccttgaagccaatgtcacatggattgaaattcaatctttaagctcaaaatagggtggtaggctgaggcgaggagatgattgacctaaatacctacaggcgcacaactcaaataactcccaccttagtacctgataatatcactggcttatttggagcagcacacatctgttctacttcctccgtttcacaatgtaagtcattctaacattttccacattcatattaatgttaataaatctagatagatatatatgtctagattcattatcattaatatgaatgtgagaaatgctagaatgacttacattatgaaacggagggagtaacttctaaatcaccttgcggtggctgtcattaatcaacccagtaatattaccctccactttaagtgtttacttccagaggctcacatgaagtagtcacattcaaaaataaatataaacattacttaactgaacctaacaaacacgttcacatattttactgttcaccaaaagaaaatgcaattattttgcctggtgatgttacaaagagtgcagaagacaaggaaaaatctgaaactaaataagcaaatatctgctactgctactaacatgtgacatcaattcactcaaaaggaaaagattagacattaagtgggattggaaatttttactacatgtgttcgtaacgatttaaatgccaatactaaaaattaaactttgatgaaaaaactttaaaattaagttttaaaatttaaattttggcagcggctgattttgtatagaggaaacgaggggagagtgttcggatcaccttttggttttacttttattgggacttgcatgttgttctggaactgaatttggcaagggcactaattgggtcagatatatgaacctgaaacaatgcacatgtgaattttcaaggctgaaaactcttaccttggtatattttgattccatggtataataatatgtgagaatgtaccaaaattagataaagcctttatctcagcatgacacgacaatgaatcaacagcttcgcagtcctggccgggagcaactcaatgagaccctgctcctacctacccgctggcagatttactgctccacaagcttcatactgcaggccaaacaattgtccggctggaactcaacataaattcacctttgtcttagacaggagcagcgagggagacgtgatccggatgagtttgcgtagggggggcagcgaggaatcgcggtggcggcgcagtggacaccggacatcgagggatcgacggcgaccggacagcaggagatccggtgccggcgcgaggctaatgcggggatcgacgatggccggactgcgtgggatcgacggcgaggtgcgatgcaaacacaagggcgaagcggctcgacggagactagatgacgatatatcgacggcgccctgacagcggggatccggcaacggcgcgaggcggcgagggaaaggcagcggggtggtgctgggaggatccaacacttcgtataagccgttggatgaatatatctaaggataaaaaaatatatataggtgtttgatgaagtcgtactttttgtgtgacaccttgaaaacctcaaatttgtaaaaatcaagtctaatttgatatatattaacaaataggtagaaccgagtctaatttgatcaattagcataggatttaggatttagttttagatttatttttcgagcctacttaagagtttatccgacggactttaatttgaaaaatgtgagccatattgtttgatcaaatttacttttggcccaggtcttcccaagcaggcccaaacttgggctggcccatcatcggcgagttgagtcaattcgacggcccttaagctgagcggctgagcacggcccacatatgcggggacggtccgatgcacttccgcggcccattgggcgcagcgtaatcaatagcagcgacggcccaacgctaggcaaatctgagccgtccaatctaatggacggctccaatcgtccccaaatccctctctcctgattccatttctctccggcgacgagcgccgagcggcctggacctcgtcggcggtaggggcgacgccaagccgacgcttcccgtcttcagcaaaggacggtggaggggtgcaccaggacagtgcgtgcgcagggacacgactgcgaggaggtgaaggtgcggcggtgccgcttcccggaaagctccggtgagctcaggggcttcaagtccgataagtaacccgaaccctcaggggcttcaagtccgataagtaacccgaaccctcagcttaattgatttggatttgactcttatggttattacctgaaattagggttcttcgaattcagagaattttgtcgagaaatttcaatatattttattcccccttttcgagttaggagagtttcattatcgtttatcctcttttaattttaggaacttcaatcaagtttatccctttgctcaattttgttttttttttctttggctggcgtttcatcgcgcggatggggacggagggcgccgctcgtccccttggaaagattgagattaagataagattttcacggacaacggaagtaaattgaatcgatctttttttttgttttaatgtttttttcgctattttttcgttattacggacaacggaaacatttttaattttttttaagtagtagagatagagaagatagagatatatagtaccgtgtcaaatataataggattcgatttttttttttccgcgtcacatataattcttctttttttgaatccgacagatttgtttttttaattttttttttgctctttttttaccacgtccacgcggattcgtttttctctggccgatcttttttttcacctggtttttttcaccctttttttaggaatcggacatattccttttttatttctttcgccttttttttaccgtggaatgggattcgtttttcttttcccttttttcgcccgttttttgatcggacattcttttctttttttcgcccggttttttttcattcggtttttttcccgttttgttttggatctgacagatttttttcgcctggttttattgacggacgatggaagcacctcttattttttaatttatatatatatataagtagtagagatagagaagatagagatatatagtaccgtgtcaaatataatatgattcgatttttttttaccgcgtcacatataatttttttttattccgacagatttgtttttttaattttttttgctctttttttaccacgtccacgcggattcgtttttttctcgccgatcttttttgtcacctgtttttttttcgcccgttttttaggaatcggacagattccttttttatttctttcgccttttttttaccgtggaatcggattccttttttttttccctttttttttgccccttttttgatcggacgttcttttcttttttttcccccttttttgatcggacgttcttttctttttatgcccggttattttcgttcggtttttttcccgttttgttttggatcggacagattttttttcgcccggtttttttcgacagacgacagaagcaactcttattttttaagtagtagagaatagagattaatatcaatataaaaaaaactacatactacatctcatccatttggcatagacccaaactgattcgatgtaagctgcataaatcatctattcaccgatttcactcgtttgacaggtgccaaattctggtgcctggaatatgatgcagagaagtgtgctcactgctctgttttatcgtcaaggtaggtagcaagttattaaatctgtcaaatcccctttgaacattatatgaatatagtatatcaagttatcaaatgtacattacatcaaaattgttagtggagaaaaaaatacagcagggctggtctgctagcagtaacaggtaactgggtcctcttatttgtcaaaaaaaaaaaaaactcctaatattgccgtgtcacaggtatagcggttcttttccactggatctttcattagaaaatcaaacaatcctaggacaagttgattgaaaagatttatgggtaccgcacgatgcctctagtagtctagtagttaattggttagatgcgaccaacgtgcacaggtttctataactttcagcttatatggtttcatttcacatgttgtaaagaactactttcagattctttggagatatcgaaatacatttatcaataaaaatgttacttatgtgtatcctcttgaactcccatggtatgattcctcctctccacagaccactttaccattgtacacctaacatagtaagttgattagaaaatacacccatgactgtacattgatgtgatttgctaaattgttctcagcaaacctgtagcaccaaaataatttccagatgtgaatgtttgattggatcgcttgaacgttcaaactttagctattagggaaaaaaagattgctttaaaattcaaactttagctatgacaaaaaagaataaactgaaatagatggggttggcaattttttcttattagccaattaaaaccttataattgacaacatgctggagaacaagccagattaactaaaagtaaaagtagcacagtagtatcagattcagaaatgccacacaatcatgtcttggttgctcctttgatgtgaataaatcaaacgttgagaacaacaggaaaatattatggtccccttaatcaagatcaaccactcatcccccctaatcaaacgccatacaccaccaacagcaggtaaaatttggttagagaagaggaggaaacaggaggggaaccaccacacctggactcctagagacgagaaaatggacatttcgccatgttcaaaacgcggtttcgctagaatgccatctcaaaaacatgattcgataaaatgccaatatagagcgtgcgtctaccgccactttgccatttttgccattttattcattttcgaaaagattttctctcctctactaggtgatgagacaaaattgccccttatcaactcagagaacacggtgaaagatgagacagaataggcaaggagacagagagaaggggcggcgacgccgttgctgcccacaactactctaccggccggtgcgccacctctccccattcctcaacctcgccgctccccgccacaccccacgccgccaccacctgtgctcgccgccaactgaacagccaccccgccgacaactgccaccaactgtcatcgtcgtcggtcgcgccgggacctgcggcagcggcggcgaggaccgcatcagcaacctcccggacgaccagttgtgtctcgtcctacgctggctcgacacccacactgcggtcgccacgggggcgcttctcttttcttctcctcttcccctcggtttctcttcctgttccccttttctctcttccttcttagctagcgaggaggcgcagctggtgcagtggcgaggctgggtgcggcggcacggccgacgacccgaccaaggcgatggcggttggcccagcgcggcggcggcctaagggcggccaggcggcgtcgggtggatggggagagaaggccggtgcggcgaggaggtgccggggcggcaccggttagaggaggcagaggtggaggtgctgggtggtcacggaggcagaggcggcgcgcaaggaggcggtgctccacacggcgcggcggtgtcccagcgcccatgaagacggccatgggggcgctcgcgttgctcggccggcaagctcggtcttgccccatctcacaccaccgtcgacgccctcgtcagcaacggtgaccacctcgccatgctcgatctcgatcccctttcaaccgacaaggaggggcaatttagtctcatcaagccgaattccagtgaaaatggatttgaaaatgacaaaaatggagaaaatggtaaagtgactgtgatcacgcgcttcatattggcattttagcgaaacatgttttcggaatagcattccggcgaaatcgctttttgaaagtggccaaatgtccatttctccctggagacggcaaggtcatccattgtgtagatgaagtcaaagccctggatcttctatcggtcggcactgtcaccacgaggagagcgggcggggccatgggggcgtccaagcagcgcaccgccactgctgcccttgcgttcacgcgaatcaccagcacctcctacacccgatgcagcggcgcgcaccgtgggagtcgagctcaatggcggtgcttgaggtgccgaggggtggccctggttcctcctcctgatgcgacgcgcaacgtgggggtggctgcgactgcagctgtgcaccgaaaccggtcctctccaccgtcggctcggctgcctccctaagcagtccgtcgccacgtttttcctgatgtccgccatcgccggagctccatccctccgtggctgtcaacgaatgtggctggacacggtcacagagaaggggaaccgaagatgggaggccgccttgggatgggagtggtgggaggacgggatttagggggtggatggagacgggaggtgaggcggtggatcggcggcgagggtgaggtggcgtgggagggcgaggtcgggcacgacgattggggcgaacacgtgatggacgaggagcgggagtgcgggcacgatgacgttctggcgggggagatcgtcggcaacgtgtgaaacgacgagagggagagaggattagggtggcgtggaggtggaggagacgcagggcggggtggtggggttgagatctgagcgaagggcgtggggcggtgggcggaggagcgaggccatgaggggcgtgaagggatcgatgtggagcactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaatgactttctcggatttaatgcgtgaatctccattcttccacacaagattggctacatgggcatcgagaaatataaatattaatgaattgttttttttacgaggaataactaatgacatgtttaaatggatgataagtagaattacttacccttgttcattgtgccaagataaaatatgtctatcaaaagtagacggagggagtactagttatttctcgtaaacaaacgattcattaatatttacacgatgcccatgtagccaatcttgcatggaagaatggagagtcacgcattaaatccgagaaagtccttaagagtatatgtggttggattcaaatatgcctatcaaaaataatttttttaatttagaaatatgcatatcaaaagtaaacggagggagtagcatctataggaatggtaatgggtcaaggtccctgagttcttccacaatcttatcttatctaattctagatcaaatatatatatatatatagaataagtatgtaattggcctaaggaagctgcagtatttttttaaaaaaaagagagatgctttgagttgactggccacgaaccccccggcgtctcccaaccaccgcgtacgccctacttctttgtccccctactctttctcccatctgcactactctcttctactaccttgttgttgcagcttgatttttgatgtattagcagttttacatgatgacggaagagcgagatcatgttaatttctttagagaactagatcatgctattttttacatgatggaatggcgcattacaatgattaagataagatgtaccacaggcgcatggaaattcgcacaatcactgcaggtcgccagggttcgatttcagttcaatttccccaccatttggttttgcgaaaacacgatagagtacaatgtccaatgtggatgcgtctggagctttaggaaacgctcagtcttgaggttaactgattgttgaaatttgaaagagaactgatgctatttcgaagactacataataaagccatacatgcaccagtctttagtggagtattaatgtattattattcatagcacaacgacaattttctccaaacttgttagttgttactactaacagatagcatcttaattcattattcagaactagcacattgaggagactcccggggtctacccaattcccttttttcagagctagcacatcaaaattcaaggaaggaaaagataaatctgagagcatttttacggtctttgaggaggtaccactttttctactgtaaatttggtatctcatagtacctaggtaccaaattttatactaaatttttggtacctcatgatacctcctcaaggatcataaaattgttctaaatctgaaatccgtgccccaaatctctttttttttctaagaactactccagcacatcaaaattgaaggaaaagaaaaatctgaaatccctctctttacatcagaaacctttctagcataacaatgcgaatggatgaaaacaactatgcactgtcccattagcatgccgaacactccaccaaaaagaacttgttatcaaatactccctctgtcccaaaatgttttgacgccattgacttttttaatcatgtttgaccgttcgtcttattcaaaaaatttaagtattttttaattcttttcctattatttaattcattgtaaaatatacttttatgtatacatatagttttatatattttataaaattttttgaataagacgaacggtcaaacatatttaaaaaagtcaacggcgttaaatatttagggacggagggagtcctagttcctttcagttcagcagtatagagcactagtacgcttgtgagtaactataatcaatttgggggttccatcctccaaaccgttaccctccaagtattatcttttgattcaggagtccagcagattcaggttccactgctctgtttctgtgatgatcaatcagattttgcacctccctttgcgtatttttccttcatcttgatgtccagtgctgtttcgggaccgttctcgcatgttttctaaagcaagaaaatttggtttacaagaacatgaaaaatatttgccatgtgcatacgtataattattgggagaataatgaaaaagggtactacaatcctaaaacagaggccaactgtgagaggaatgtttatgcatataaagccatcattctttcatatataaggaattttttagatgtgtactgccataaataatttctaacgtatatatttttgtgacaacatgctaagattagctatcttgcgacatttgtttcttcaaattaacattgaattgttgttgttatcttaattttcagtaaaattaagataagctgtagattgtacacatgacttcctcagaaaagtattccatgcattttattggctttgcacattataaagtacagactaataataaatacagtgctttgaataatgcaccatcttcacgaattttcaggcacaaatataaccacatcttctgtgtcactgatatgggagattggtatgataaactttcacaatcttttagggatactgcaaaggaagtattggcaaagacagatattgatccaaatgttaggtgcttcccaaaaagacagatgaagcgcatcaccaacaactacagcactaccctgggaagaggagggttttctgtggtgtacaagggtaggctcgacgatggtcgttcagtggcagtgaaacaatataattggagaacacagaaggagttcacaaaagaggtgatcatacagtctcagtgtagccataagaacattgttaggctattgggctgttgtgtagaggccgctgctccgatattggtcaccgagtttgtccccaacggaaacctttctgaccttctacacggcaacagtggactgcttcctgtcacattagagacacgcttacagattgcgctggatgtagcagaagcacttgtatatatgcattgctcccaaagttatccaatccttcatggagatgtcaaaccgtcaaacattcttctgggtgacaagggtgtagcgaaactgtgtgactttggaatatcaaggctgctctctatggatagtgatgaatacacaggatttgttatcggaagtaaaggttatgtggatcctgttttctgccagactgggcgattaagccaaaaatgcgatgtctacagcttttgggtggttcttttagaactcttcaccagaaagaaaggaa

SEQ ID NO: 35977 - DNA, 3062 bp, Oryza sativa
ggaaatctggcggcacaccactgatggcgataaagatgtcaactgcagttacagagaaatggaaagacatgcttgggaatgaaatagctgtccaatctagaattaagcacatgaatgttgccaagcttatcggttactgcttagatcattcggatggtacagtgcttatatacgagtacggtgcaattagcttgtatgatgttctttttggtgatgcggggaagatatatcgtcccttcacttgtgacctgcgcctgaagattgcgattggtgctgcagagggcattgctcacctgcattcacttggcgtcgtgcatggcgatgtcagcattaacgacatactgctggatcatgtctcttcgtccctggtaaagattgctggctatgggacatcagggctccctgacatcgacaaggctctggattcgcttgaaaccggtcatgggaagaaggagcatgatgtgtacagttttgggcttgttctcctaaccctcttcacgtggaagaaggtgtcactgccacatgatctcaagtccgagcctgacaaacctgtgctactgcaccaggaagccatccgtgggcgtagatgcaatcatcttgagatgatcaagggcttggcttcacggtgtctgacgtccgaggcgacgaagagaccatccatggtggaagtagcaaaacatctcaacttcatacttatttttcctgaaaggaggaaaacttgccatgacctggagatttatcaatctcgaatgctttcggactaggctaggctgcaagaactagcagtcgtacatgggttttttttttagtaaaggtgccgtatacgttgtagatgctatatataattcaagcaacatgtgtattttatatcctgacaaaaaaaaacaatgactcttgcttcttctcaggtttggtggctctttcttgtttctaattcttattcagtgcatttgtctttttttttaagataatggagtataattcagtgcatttgtctacatctggccctttggcctttctttcttgtggccgattttgctcggtcaaatttttgtgtaacagaagaaattaagccgcatcagtttactttggatgttgcttggattggtactgtttcttgttttcatgtttttttgtgaaactttatgtaggatcgaacataaataatcaagcctacgagggggggtgaatggtaaggaaaaccaaaaacccaaaaacttttagcggaaataaaagttaccctcaaatcgatggaaatctcgacgtagtcctgtcgccgccggtcggactgctcgtacgccgccggtctaaccgccgctttgtagccggttgaaccgtcggtatgtcaccggttagaccaccgaacccgataaaacacaaatcgaagaactcttaaaataaatgacaactttattgcttctctctgtgtttacaaagtgcaacaacatcactccttacaaaaatctcgactaaacttaaaactaactaaattatcaactccatgctctgaaaagcgatacaggaaacctcacgctccctctctatttataccacaaaaaccctctattcaaagtaggtgaagaactcctatacacaatatgactcgatacttcaatttcctttttctccaaaatccgcagccgcacccaagtcagactcctccttccctagctgctgctgctgcttgccgcctgagccgagtcggtttggcaccaccgagcccaactcggtcgcccaggccagaccaattgctgctgcttttggaccacgtgcacagcacctgcgcacacccaagcccatatgcatgacagacttccatccaatcggccacacacacgtgcccaaccaatctacagcacatacacacacatgcatgtactgatcacacacgtacaacacacgtacatgtatcatacacgctacagtacatcaagtactgtagcaaccatgcactccaccatacatgaacatctctatcttctctcattcctcttcgcgaacaccaacgcttgcacacacacctcgtgaagcccgttgcgaagatctttcccacactatgtccatccgccgtgtgccatctcgtattcaacttcgtcacccggtatccttgaccgtctggacctcaactcctccctgagtttagttccgatccccaccgttgaccgaagttgacctccaagaatcctgactctagtcaccttctcacatggtatcccgatcgcactagacctctgttcctccctgaacatagtcctggtcctcaccattgaccaaggctgacctcaagtcacctgcacacaatcagacaaaacaaccgtttctgggcatagatatcacaacctgacccacattagtcacacgcactcacaccaacatccacacatcttttcaaaccaattcattgattaaatcatttgcatagccaattgttcatcacaaatattaatcatgacagtgatttcacactttccagtttttacctctctcgtgggctccaggtggatgtgtgttttggccaaaaaaaaaagatcttctgaaaggttctgccttaaaagagtttccaattttcatttccaaatgtggagggatgatggtcctgattgtaaatttgttattggtgcacataatttgctatccgtacaatggcaccgttgcaacttgcaatctaaagagaattggctttcctacgcagatgatgttgaaacagcacaaaacaagtatcacaatgcacagaggggaaacagaaatgaaaaaagttcagacgcgccagcacagtcttcttcttcatcttcagatctctagcctcttaacgttgggtctccagccaaaccttgattgataaacttcacttgcaactcgccttatgagcctggcccccagtagcaagtttcttcggcttgtttcctgtttctgcaaagttgtccaggtttcaacccaataacaagcgagaaagatcagatcagtaggatcatgtggaagtttttttttcaaaacaagctttatttctaatcttccaaatagcccagatcatagcagcaaggccaaccacaaccagattccca

SEQ ID NO: 35978 - DNA, 1447 bp, Oryza sativa
ttttttatcaccctttcttccaaccttttttagacaagttatctttagtcagaatcttgttcttaccaaacaaccaaataaaaatcttaattttcaaaggtattttgaatttccagactttcttaaaagggaacaccacctgtttcattttgaaacctttataaaaagttcttacactgaacttgccctctttacttatactaagttcccacccaactttatctctacaatgtgcattgataaccagggagtcccaaccagccttgattttgttctagtccctaagtttttcactatgctaatgctatcaatccccttttggttaatatttgcaattgtcaccattttttttcacaactatattataagagcaattttatggtccttgaggaggtactatgaagtaccattttttctattataaatttggtacctcatggtatctaagtactatgaggtaccatgaggtaccaaaatttactaaaattttggtacctcatggtacctactcaaggaccgtagaattgctcatattataaaggtcaggaaattggtcacacaaaggtctactcctatccagttgtcctcccagaagagagtatctttcccattgcccaaaatttgtgtaacatgtttgtaaaacagatctttaatctccatgatgccctgccaaaaatgtgagataccaggtttttgttttaatgcaaaaaaaggttttcctttcaagtatttctctcttagaatatcttgccaccacacatcctcattttcaattctccacacccattttcctaacatgggtttattcattatatctagatccagtacccccagatacccccccccccccgatctctaggtgagcaaaccagaagccactgaacaaggtgaaactttccaataccctaatcttcttgccacaagagcctccttttaaaatagtccatcctatccctaacaccctgtggaagtctgtagaaagagatcatatacaaagggatattggttaggcttgaattgattagcaccagtctccccccaatagactggattttgccttgccaacatcctaacttgtgttccattttattttcagccatcttccagtctttgttcagaattcttttttttgtcaatggggatacctaaataggtcatgggaagctctccacctttacaggtgaaaatctaactgtacagggattgcttctccttagcctccccaaaacaaaacacttcacttttgttgaaatttattttgagaccagagagctgttcaaacagacacagctagtatttaagatgtttagcttgttcaagatcatctgacagcaagaaaatcgtgtcatcagtgtattgcaaaattgcaaccttgttatcatcatttatccccaacccctctatcaactcattattcacagctctctgaaccagcactgtcaaagct

SEQ ID NO: 35979 - DNA, 3731 bp, Oryza sativa
ataaatgaaggtccaattcaccttgtcatatgcttttcaaagtctactttgaataaaatccaatttgtttgttttgatgcactgagttaagaatctcatgtaaaataacaacacccttcatgatgaaacgactcttcaagaaggcagtttgatatttggagatgatgtaagccataatgtcattgatcctattcatcatcacttttgttatgattttaaaactgacattcaaaaggcatattggtctatacttaacgcatgtggctattacggtagctcctttattgtgagtatcttacactcgaattgcacaaaaaaatgccgagataggagcaattcaagaaattctaatctgcacgcaataaactggtgcgcgctatttaaccttttcttctgcaagggacacaatggaacactatatactcctcatgtatagacattaacaccgcaacagccgtgcaaaagggtgctagatcttgacatattggatgctttacggttaggatctgttggttttccaagtgtacaagcaaagaaagttcaaaccgccatggcagcgaccgttagactcttagagtccagggattgcttcaagattgtacttctctgatgatgtcagtgttagtgatatgccaaatcatagagatgattgtatcacatactatgtttacatatttatccgacattgttccttgaaatagataactcattattggttaatgaatatgtgattctttcatgagactctttatgttgtttgttactatttctaaaggatccctgatcaaatatcatatgtggaacaaatatgtttatatgatcagcacatgtattaattaatgatcatgtctcatggatcatggtatagagataccaaattaataatgtggacacatgttggtgaacatgttgttggatagacccaacatgagacattgtaagagccatatgtgttgtgtcatcagtgatctcatttagtattggtgttgaatccttagacctgatattatcatggttcccaacatgtgtagtagcttacttagggactgttaaacgctactccgtaattgggtagttataaaagtagttttcgggtatgctatgaaccatgtagtgggatgccatacatatggaattaagccgatggcaacaaaggtttactgtttaatctaatcttgtggattttatgacatcggacctccagccgatgtatgctttaaccttcggattagtatttcttttattatattatattgctagccaattggtttatactggattatattattgttatattgattatcatcagccgatcgcctttatatcattatctgtattggacatatagctgactgatcaaaaccctatcgacatcggctggtatcgacatcggctaaaattactccatcagcttgtcagccgatcggctcattgatcttcaatttgtatatcttgtcagttgcagggtcaaactgactggcacgcccgtatctcatcaagatttggacctgcactgaagctaagcagatctcctagaccagtgtgtgtttttcgcatcaacagggcccaccttaaggacaacttgggccatatacattgctcatgcccttagtgatgccaaatgtcaatccgttgtgcctgctctaccagccaccgccgcagctgccggctgcccaacgtccgcgaggaaggccattcctacagtgtccgcatccctgccgacagcgccaacccttcctacaacctacagtatgagaagcccccgacaaacgacagcgcctccatctcctcccatggcggggctggatgcgcaagtgctgccggatgaaggtggagagctcgtctagggagcctgcattgcactgtcacggccccaacatcaaagaagactaccgtgtgttcttccagcatgtgtgccccgttggaaatggcggctttgtgctggagcatgagggcaaggtgatcaggtactatgcttcgggcgcaacagtcagctgggatgagtctcccggtgagtccgtgtctccgtaatgggtgctccggagcccaatccacatcgagttcattctactttccatcttgtttagtgttgttgtgcgtgtctctaacatacatgtttgctcttaggcgaaaattgtgcaggaggatcaggaggaggaggatatgaagaatgaggcatgctgaacttgaagagatattgcgtcatgatgaaagagatattgcatcatgctgaacctgaagttgtggcctttattagttatgggcttaaatactaatgagaagattacaacatacaggctaaggaagcagcccatggtcgctcttcgtacctatttcataacaaatttgttcgtacgtatagagttttccgccgcaaaaccaagcctcatatcgcttttgtgagaatttattatgttatgtgtgaagccccgcaaataattagaggaaaaagaaaaatagcaaagcagcagcccagtactgtgctgcactgtaacatcgcggtactgtagaaaatttagacccacctcgctagttcagctagagcagcactagcttataaatatgggagcctgaggactattaactccggttcgaacctttttgtgaagcgaggatgaaaacgtgagagagttaatagtgtaggtgtggtttaactggataagctgaaccagtacctttttgggtcctgggcgttatattatgcttatcggtttcactaatatgctctgttggacaatagctaaggattgtatcactactaaaaaaaggtttttttatggcggccaaaacaggttttcactggtggtccaagggcccgccagagattaaaggccaataaagatgcagcctcttcgcttcataggtgttggttggcagggagttgggctccggaaacaattctttcaacaggaccaataaattgttaaaactattgtcggaccaaccgtttctggctttcaatcttaggttcaagcattgtatgcaataatgtgaaatcattgccacaaccctttgcctcatcatgcaaaagtttctttgctgccttttgtaatacattgaaattatccaaaccacgagcagacccagccacaacttcaggttcagcatgacgcaatatctcttccatcggcatcatctaccgtgacatgaccatcatcgacatcatcaattgtgtgatgaccatcgtcaccccaacatcatcatccaactcattatcaacggattcttctactaccatgaaattcctacccttgaacacttcatcgtgtgtctcttggttgggaactcgtgtggcagcttgggatctctcaatggtgtgaccaatttttgtagccaacaacaaatccacgcatcaccaagtgtgtctcgattacagaaatgctagttaccgatgaacattgcaatgtaaatcttttggatggaatgttctttggctgtctactgtgtatacgattaagccatgctgcttttgtccaggctctccatccgcataaattccaggaacctccgagatgctgagatctagttagaatgccagatcttgcagcatcttttagaaaaacgatttaaatttacaacaagttccaaccaattgttggttatttggtcataattaggcatattttaatccaaaataagaagataataaacatgacattcacaaatagtaagtgatctagtggtggtgcttaacagaaatatgggcatgctttttataacataagcatcat

SEQ ID NO: 35980 - DNA, 10542 bp, Oryza sativa
  unsure (1)..(10542): unsure at all n locations
ggtgcagtggagattaaggcatttgtattgccttcattgctgttgtctcctgcagcgcccgtccgttccctcctccaggagtggcattgttccctccaggctccagctcctgggcgccattgccaatggaagccatcgcgatgcagaagaatagaagcagagcaggcacgctccccaaaaacttgatagtccgcctacccgggcaggtacacaagcggacggagttccggaggcccgctcatcctgtcacttgtgcacgcaggtggacagaaccggggaatcaatagctagcacaggaatagaggcacaaggagtttccaaggaagatctgaggaaaatctgaatgcgaaaagaggaaagcaaaagccagcaagctgtgtcttctgtctgccttggtggtcgccttttatagcgtacgggagggaaaatcgttactgcagtaacaacggaatcaatccgatttaagtcgaaattgatttgtttgttataggagtaatcacccccgtattgaaatcatatcaattgtgctggattcaattctcgtccattgcaaaatttacgagttacaggagtaatcacacccgtattgaaatcgtatcaattgcgctggattcaattctcgtccgttgcaaaatttacgagagtccattgcaaaatttacgagttataggagtaatcacacatgtattgaaatcgtatcaattgattgaaatagtatcaattgcgatggactcaattctcatccgttgcagaatttacgagttacaggagtaatcgcgcccatattgatatcgtatcaattgccttggattcaattctcctccattgcaaaatttatgagagagagaagcagcctacctcggcctagccggctcggagcgcgcgcgcatgcgtgtggctgtccgcccaccatctcaactggtgaacagagactctctactagctccatctcaaccggtcaacagagcctctctactacttcagattttcaaggtggtattattacctattgcattaaatgtgggccattggaatttattaagatttaattgggcctagcccattaatctaacaccaaatttgtactgcatgcgcagtaacaaattctagttgagattctgcgcaataatactgcaagttgtacttcagaatctatggcatactcttcctggctatttatttaattgatccctccgatctattatttgtagtttcaaccgagatgtagatgtgcaattgcaaatggttttatttgcatgattttcaatctcacgctcgtgttaagtaaatttagatgcacgcatgacacatccaatccacacgctaactagcttgctaaacactttactatgattcgcggtcttattcaccagttgaaaaaaggttgcgtaatacaacgaaagcaagttaaataaccaactggtactatatatgaattaaattggtgaaagtcatgaactgccaagaacacaaacatgaaatgttacgagcactggcaagggaacggattggatatgaatgggtcactggagggcgaggcttcggcagcctctttaccctgcccgtgacggcgagtgggaagaacagaggaagggagcagagaaaatgggatgagaagtgtagattgaatcttgcttagattaaccataaattcgtggctctaaatagccttacattgaactaatcttgctaaaacaaagggataacaaaatagcaaaacaaactgaaaccaatcgctagcaattcgcgcggtactgtttctcatccgacacgctgctcgtccttcttcgccgcgcgacgtctgcgctcatacgtgatgccgaccatgacatctctcccctccttcgcaaacagctcgtcctcaagctagaacgcaggatacatgtgcctgaattctgcctcgtcttcccatgtcgcgtctgcagccggcttgccttcccactggatgagaacctgacgcacaccgcgtgccaaatgagcacgaacagctttcgccagcattggcaaaacaccgccattggacaatgcaggcagagcaggcggttggtccggcggtgtagccttgaattccttgagcaggccaatgtggaagacgtcgtggatccgtgcgccggccggtagcttgagacgataagccacatcacctatgcggtcgctgacctagtacggcccgtaatattttggcgccagcttgccacgacggaacccgggcagggacgcagcctgacggtgaagaaggcgcacgcacgcccagtcgccaacctggaacgcgaggtcccgatgcttgtcgtcgtagtacagcttggagtagtcttgtgcttggagtagacgctccctgatttcccccaaaaattcatcacgctcgatgagggcttggtcgactatgcggacgcgtgccaagcctcgattatattcccgcagcgctagaggcggcctgccatagacaacctggaacagcgtcgaatgcagggaactctggaatgctatgttgaagcaatattccgcccagggcagccaacgtagccaatgccggggacgatcaccggtcaagcaccgtagatacatgccgatgacgcggttggccgcctccgactggccgtcgctctggggtggaaggctgagctcaagttgagcttgacattcgctaggcggaagagctccatccagaatgagctggtgaagacctggtcgcgatcgctgacgattgagcttgggatgccgtggaggcggaccacctcatcgaagaaggcacgcaccacagtcgtcgctgtgtaggggtgcccgagcggaatgaaatgggcgtacttggagaggcggtcgacgacggtgaagatcacagtcttgccgtgcacgcgaggaagaccttcgataaaatccatggcgatgtcttcccagacctgcgtcggcaccggaagcgactggagtaggcccgccgggtgcaggtgtttggtcttgttccgctggcaagtggcgcacgtgcgtacgaactcctggacagcttgcttggcgtggggcgtgaagaagtccgcccggaatcggtggagtgtgcattcgactccttcgtggtcggtgtgggcatgagcgagcaatgccggcggtgtcggggaagatgccgagatgtagacacggtcatcccggaggatgaggccatcgcggagtgcccaaggcgcgctcagcttgccgctggtgatgtcagcggtgatcttgatgaggtcgccgtcggtagccacctcattccgaaggtcgtcgaatgtcgagaatgttgggccggagagcgccagggcggcgagttcggcgtcttctatgcgacgcgacagggcgtcggccacaacgttcgtgcgccctgggcgatattccacagtgaaatcaaagccaatcaacttgcttacccatcgatgttgtggaattgtcgagaggcgctgatccaggagaaatttcaagctgtagtggtcggtgcggacgaggaacgccctcccccacaggtacgcgcaccaatggcggatcgcttggacgaggccgatcagttcccgctcgtaggcggcgagtccggcgtggcgtggcgcgagtgcccggctgaagaaagcgagcggacccgccccctggtgcagaacggcgccgatgccggaccccgacgcgtcgcatttgatgacgaacgacagggcgaagtccggcagttgcagtacgggcgcgtcgatagggcctgcttgagctcggtgaaggcgcgggctgcatccggcgtccactggaatgcgtcgcgcttgaggagggccgtcagaagagccgcgatcgtgccgtagttacggatgaacttgcggtagtacccgacgaggccgagaaacccgcgtacggcgcgaacgcggatgcggccagtcggccaccgcgcaaaccttctgcgcatccatggccactccgtcggtagagacgacgtgacccaagtagctgatctggtgttcaccgaagtggcacttcgagcacttgaggacaaggttgttggcgcagacgacggtgagcactgtccggatgtgctgaaggtgttcggcccatgtcctgctgtaaattagaatgtcgtcgaaaaacacaaggacgaaccttcgtaagaacggcgtgaggacagtgttcatcagggcctggaacgtcgcaggttcgttcgtcaggccgaatggcatgaccaagaacttgaagtggccctggtgagtgcggaacaccgtcttgtggacatcatcggcgtgcatgaggacttgatggtaccccgaacgaaggtccaacttggagaagaagggcgcgccgtggagctcgtcaagtaactcgtcgacgactggaatgggaaatttgtccttggcggtgaccgtgttgagcgcgcagtagtccacgcagaagcgccaagaaccgtcgtgcttgcggacgagtaggactgcgacgagaacggggatgtgctgggacggatgatgccctgggccagcatctcagcacattgcttctccagctcgtccttctgtagctggggatagcggtacggccgaaccgcgacaggggacacaccagtcttgaggtgaatgcggtggtcgacggtccgggccggcggcaaaccggttggaagcgcgaagaggtcgtcgaattccgccaatagggacggaaggagatcgtcagtgtggatcgcagcgcatgtggacgcggggcgttcgtcgaggacgccgtatagcgtgacctcccggcagccgcgacaaattgccatccgcatgttgacgaagtcccacagtatcggtctgagagtgcgtagccactgtgtgcccaggatgatgtcgacgcatccaaggtggagcgcgtagcagtcgacgtcgaatacctcgtcggcaacacgcaggtgcaggccatgcgcaatgccggggctggtgaggcgatctccgtttgccaccaccacacggacaccatcgcggaccggcgacagcggaatgccgaggtggaacgcaaggtcagcgtggatgaagttgtgggtggagccggagtcgacgagggccaccacctcttcatccgcgaggtaggttgccaagcgcattgtgttggcgccatcaacacccgagatcgcgttcagcgatatgtgtggctcggtgtcctcatctttgtcggccgagtcgtcatcgggatcatccgccgtgtcgtcgtactcgatgtaggagagccgtgcgcaccggtggccgcggacaaatttcttgtcacagttgtaacagagcccttgtttgcggtgctctgcgagttccgccggtgtcagatgacgaaactggcgagagttcacatcgggcacggcggccactgccgtcggagccggggaggcgctagcggccggagatgacgcagccgtgcgcgcgaactgcttgctgatagtgcgcgatgggctgaagttggctttgtgttcatatgcacgtgccaaccccatggcttcccgaagatcttcaggctgatggagctccacgtcgatgcagatgtcatcacggaggcccgccgtgaacagttggacttgctgccgttcggtgaggagatccgtcacacggctggacaaggcgaggaagcgctgctggtaggtggccaccgtggtcgactgtgagaggcgcttgagttcacccagcgggttgttgcggattggtggaccatattgggtgtagcatagctccttgaacgtgtcccaatcaggcggccctttgtgttgctcgtagtggaaataccactcctgagcggcaccagtgagatggtatgtggccaaccaaacgcgatccccatccggcgaacgctgtgcatgaaagaactgttcacagtgattaagccaattgagatgatcgtcagagccatcgaactttggaaattcgagcttgtaaaagcgaggaactgcgttgccggagttggcgtcgtgctgtgcgccgtgtctagcatgtggcggaggaggttgttatagaggtngtggggaaagttgtnggggggtggtggtggtggtgatttaaggaggccaccgccggtcagacgtggaccagaggaagtggaggaggactactccaaggcggtgatgcgggaggtcgcgacagcgacagaacgactgagatcggcgaggtcacttttggaggccaaaagcgaaatgccgctcaacaccgtcgccatggattcctgaagctttgccagtgcgtcggcatcagtggatggctgcgtggaggaggattgatctggtgatggctgcgtggaggaggaggattgatctggtgccatggtctctgataccaagttgttacgagcaccggcaagggaacggattggatatgaatgggtcactggagggcgaggcttcggcaaccactttaccctgcccgtgacggcaagtgggaagaacagaggaagggagcagagaaaatgggatgagaagtgtgattgaatcttgcttagattaaccataaatttgtggctctaaatagccttacattgaactaatcttgctaaaacaaagggataacaaaacagcaaaacaacttaaaccaatctctagcaattcgcgcggtactgtttctgatccgacacgctgctagtccttcttcgccgcacgctgtctgcgctcatacgtgatgccgaccatgacatcaaaaaacaaatttagtccaccaataattattgaatactctcatgtatgattgtcgatttatgatactcgaggaaaaaaataatttggataaactaaaaattaatgtaagttcgaaaggtagggaaacatgataaattgtgtaactacacctcaacgaacactgagagccatctcgttgacgtggtaacttcccgttttaacagttcgatcagtctaaggctcaaaaggtggaaccaaataagccttgtacactcaacataaacccttgtagaaatgatcgacagtagcactaaataagctataacagtaaaattaaccattatattcctaagactaactaaaatgcactctctcaatcttatttgctttgtgctgccatataaaattacaggcatgttgagttacatgtagcaagcactccatgacatttaactaggtgagcatgacatatacgccgttcataaaaaacatacaacaacggagtcgaactaaatgaagtgatgataaaaagaacctacaatgcaacggagtaagttactccctctatttcatattactagccaaatactcctgctttgcaatagattaaaacaaattaatagtgatatttttgggataattttgtacccatgtgtgctatattgtacaggtgaaatatgatagaatcatatatttagaggaattattttataacattaaagtacatggatagttggtagaaaatatgataaagtaggtggtaaataaaaaaaacaactatacttggtgagtggtgacagattcactgctaccatccttgtcttcttctaatataaaaagagtatgataagtcgtttagtcaaaattttaagtttgacactatactgtgcataaagctttcatctgcgcaaaaaccgaaattgggagaggagagcggcgagggtaaacaaggttttgcctttacctcaaaggcagcaatggcggtcgtcgggtgattgtggctgcggcgcgggcgagcgccagttgcggctgtgatcctgccagcacgcgcatgcctcgggggatctctctgaagcagccgccggcggccggccggggatcggatcaggcggtctgttgcccatcattaccgaagtgggcgagggatccctcatcgagaaaatggacatttagccatcttcaaaacacggtttcgctagaatgccatctttaaaacgtgatccgataaaatgccaatatcaaggccacacaactcgccggattgccattttctcattttctcttaattccaaaatcattttgcctcttctttatggtgattagacataaatgcccttggggccaatggaaggtccatctcttctctttctttctctccttcttcgttttgtgccgccggtggagatggtcgagcgcagcgaggtggtcatcgtcgttgctgacaagggcgtcgacctgtcggggatgcggtggaacaagttggcgacgacggtgttggacagggcgaggccgagcaaaggccatggggcttggttgatggcagcgatcaagaaaacgtctcagtggcggctccgagcttcggcgagacgacgtcaactcattccattcgatgtgaagccatgcatgtgcatccatgaggttggttaggtcccagggatggtgcatgcgcaaagaatcaacgagggggtcaccggagcggagggaatcgaagattgacgccggcagccaaagttggagaagacaatgtcgatctccctccttgatgctccaatcttctcggttcttgaggggttttaaagaggacctcaaggaggagctgatggcgcggtggcttgctccaggatggatgaggaaccggacatcgacgctgccgaagcggcggcacttcagagcgtgctccagcatgacgatggcacggcggtgttcccgttgctacaatggatcaaacgcgatggcgtcaaaagaaagtttgttcggcaagatgagttaagtatggaacgcaaaagggacaaggacgaccgtggcttggtggtgaatatgatcatcgtcttcatctcgtccggcgatgggattgagaccaaagaggcagcccatgcttgttctctcgatgtggtcagcagtagggtggagagtgagatggggcgacggagttgggagaagaccatagctgccgccactgccgccactcaatacgccggcgaggccatggtgttttgtcccctgctcgccgcgctcacgaggaagggcaatttcatctcatcatccggtggaggagagaaaatgatttcgaaaatgcacaaaatggccaaaatgacaaagtggtggtgagtgcgtatttcatattggcattttagcgaaacgcattttcagaatagtattatagcaaaaccgtgttttaaaagtggctaaatgcccattttctctccctcgtccccgcgcgtcggagattgcttgcccccgggacacgtgccgttcgagggcgcatcgacaagccaggcaggaaggtcgcaccagcgcgacggccccgagcggccgccggcggccggagcggccctgctccctcccgccgccgattgcggcttcctggaaaaaaaaatgtacggccaagcctcagccctcagaaagctgcagatgttgatttttcaatatatttttttagaaagggaaatgctttgggttgacctgatggttgactagtcggctccccccaaccaccacgtgcgccctacttctttgtccgcccactctttctcccgtcatcagatctgcctggttctcttcttcaagaacacggtttcttcaatcctggcgaaccgactgtccgtgaagtactaagctacagctacaggtgcacaggctatttcactctcttctaccttcttgttgcagcttgatttttgatttatttgcacattttgcatgacagaagagcgagatcatgttaatttctttaggaactagatcatatgcttcttcttcttacataatggaatggcgcattacaaggatttaagatgtagcacatgcgcatggaaattcacacagtcactccaggttgcgagggttcgatttcagttcaatttccccaccatttgttttgcaaaaacacgacagagtacaaatgtacaatgtccaatgtgtgtgcggctgtagctttaggacacgcttaatcttgaagttgaacaggttgttgaaacttgaaagagaactgatgctattcgaagactacatcttctccaaacttgttactaccaacagactagtatcttaattcattgaggtttgttatgctccagaaggtggtacctctagctactgccatactggtaccaccaagtatgaaatgagatccaaccgttcaatcaacaagggcactgttggaaaagatgtgaaacaatactggagactggagagggcttacgatgaacagcacgcttgtctatcaacgccgcaatctctttccatgtagtcaaatccttgatctattctttacatgaagttacctttttagcctttgtgtggttataccctccacctgtgacttcctgttagaagctgtaccggcaagtacctgggtctttgcatccagcttaatggacatacgagatactaggtacgtaccaggaggaacaaaggaccgtaaaaaaactctaattcattattcagaactagcacattgaggagactcttggggtctagtggctagcaacacgggtggtgtgctagcctgttatgaacgacgtatagaaatacaaagtaaacgaaaaacaatcacagcggagacacacgatttaacgtggaaaacccctttaatgcgaaaggggaaaaaaccacgggcaccagccagcaacaatctcactatctcaagagttttgggttacacgcctatggcggcttacaagagaatcaagtcttcacgaaaccctagcaaagggcatatataccgt

SEQ ID NO: 35981 - DNA, 17870 bp, Oryza sativa
cgcacccccccgtgtgtgcatggggcgcggccggatgggccgggcttcagactccgctacgctccggcccaagcctccggcttgggcctccgctccgcttcgtcagaagcccggccaatatcttgaagtgaatttggaacaactccaacactagcccgcccacattcgaatcctcccttgtacaaaaatattttggggctatcttctcctcaactctctctctttctttagaattagcacatcaaaactaaaggaaggatagaaaaaatctgagatccaccggttccacctcatgagtcaacttttctttttagaaagaatccaattgcttttttctgtaagtagctaagactaatataggttgatcttgttcattaattgaaagatttttttgggggagggggcacatgaagctacgctaaatggatggccttatataaagtggtggacccaataattttgactattagatgaaaacaaaatcccctgtcacccttcatcctggacccacatcatttcttttccttcatcttgatgtccagtgctgtttcggaaccattctcacatattttcaaaagcaataaaatttggtttaagagaacgtgaaaaatatttgccatgcatatacgtataatgattaggagaagaatgaaaaaaaggtactatgatcttaaaacagaggccaactgtgagaggaatgtttatgcatacaaggccatcattctttcatatatataaggatttttttagatctgtactgccataaataatttctaacatatagtatatttttgagacaacatgctaagattagctgtcttgacacatttgtatcttcaaaatagcattgaattgttgttgctccagtagggctttcaactactattttcgataaaattcagagtaaactggaaatcgtacacatgatctcctcggaaaagtattccatgcgttttattggctctccacactataaattacagaaaaacaatgaatatgttgctttgactaatctaccatcttcatgaatctgcaggcacaatataacaacatattctgtgccactcatatgggagactggtatgagaaactttcacaatcttttagggatactgcaaatgaagtattggcaaaagcagatattgatccaaatgttaggtgcttcacaagaaggcagatgaagcacatcacaaacaactacggcactgtcctgggaaaaggaggtttttctgtggtgtacaagggaaaacttgataatggccgttcagtggcagtgaaacaatataattggagaacacaggaaaaggagttcacaaaagaagcgatcatacagtcccagtgtagccataggaacattgttaggttattgggttgttgtgtggaggcagatgctccaatgctggtcactgagtttgtccccaatgggaacctttctgaacttctgcatgggaagagtggccagcttcctgtctcattagagacacgcttccagattgcattggatgtagcagaagcacttgtatatatgcattgctcccaaaatcatccaatccttcatggagacatcaaaccatcaaacatacttctaggtgacaagcatgtggcgaagctatgtgactttggaatatctaggcttctctgtatggacaatgatgaacacacgggctttgttataggaagtaaaggatacatggatccagtgtactgtgagactggacgactaagcccaaaatgtgatgtctacagttttggggttgttcttttggagctcatcaccagaaagaaagggattgatgaccagagcagaaatctagcgggaatgtttgctcgctcaagtagagataaaagacatgaactatttgacaaggaaattgcagccgatgagaatatagactttatagaggaaattgcaaatcttgcacttgattgtttaaagtctgaaatagaagatcggccgcaaatgaaagaagttttgaaacagctttggagtatcaaaaggtcagagatattgagacaggagagaaggcttgcagagttgagagagagaaggatcatgacattaagggaaataaaggtcatgttgcgtggatctggctttgaaagatttgttacaaaagcgacatagattccatcataggtgacccagaacaggaatcaacctcagagacattttcaggaaaaagtgatgttgccatgggcaaggtttacatgggacgtttgaaaaacactccattgattgtgataaagatgtctgtggaagttgatgaggattggaaacagacatttttttatgagatgatcatgcaatctagaattaagcattggaatgttgccaagcttttcggctgctgcctagatcatgtcgatgccccagtattagtctatgagtatggtgagatgggcttgcatgacgctctttttggtaaggcgtggcagagtattgaacatcctttcacttcctatgtacgtctacaaattgctactgatgctgcagaaggccttgctcaccttcactcatttgacatggttcatggcgatgtcagaactgccaatgtaatagtggatgttttttctggatctaagctcgaaatgcctagaactagtacatttccggcaaagattgctggttttggaacaacaaagctcctttccttggacaaggctcagtatgcaagatttctaacagagaacatacattacaaggatccacacttcctaataactgggctcatgactaaggaacacgatgtgtatggttttggaggggttcttgtggagctcttcacaggaaacaagattcaaatgcacgacataaatacggtaattaaatattttgatagcgtatttgctatatgccatcatctcgaggaaattaaggaactagcttcgtggtgtgttgcacccgaggttacagaaaggccaaccatggccaaggtagtacgatgcctccacgatatcttgaaagatcagcgacggccttgcccttgcccctgcaagtcaatgcattaggccctttgtttcggcttaggctttagaacagccaaattaataatgagataaaacaaacaaaaaggaccttagtttgcaatgtaatttcaggctgacaagtggctcataactccagaattgtgatatcggaagtcactccaagttgccagtaactgtgacttaaatgttacagtatattatatgtttgccagtcaacttagacagtgataatattgttgctgcggttttctactacgattcgcgcaagtcttggaggcacagttcgaatgcactatgatactaatataaaagctgttcgaagtgctttggacgataatccagtttttgtccaagattatgttttggtgtagtactgatatccagttttacccccgtgtcaaaaataataatataaaaaaacagttttacccaacacaaacaaccctcgcgaccttggagagaccttggttcttgttttctggaatgttatccggtttggcaattgcaacgtttcgagatattgcgccagatggtaactgtgatattgagttctgatgtagagaccgtgttttcgtgaactgcactgtcgattgtaaatgatttatcaattgtacaaacttagacgctgagtattatctcacatcgtttgtgctgttttagatgtctatcgagagcaaattagcaacgaatgcctgtgtttattacgatagctccttttgttgcgagtatcttacactcaacatgcacaaaaacgcctagataagagcaattcaagaacttctaatcattccgcacccaacaaattggtgcgctctatttaaccttttcttctgcaagggacacaatagaacactatatatactccttgtgtatagatattaacaccacaccagccgtgcaaaaggatgctaaatcctgacatattggatgctttacggttaggatttgttggttttcaaagtgtacaagcaaagaaagctcaaactgccacgaatgcgacgtctctactcaaagtccgggaattgcttccaggttgtacttctctgatgatgtcaggccattctctgggccctgctgtgttcttggttgctccagcacgttcagcttctgaaggtaggagtaggaggcattgggatttggcggtgggctcgggttgcttattttgcttgccaggaaccgtctgatgagtcctctgaggaatggagccatggtatctggctcatactccaggaaatacatgattccccccatgcacatgcagaaaagagccacctgcaatgtttgccgggtaactgtcagcggatctgaaaaatatgatcatctactaaccaaggggcacactgacttcaaacatgatcccttccagttatcaaggcaataggcaaattgtgtagaattaagaacttaggactaatgttggtttacactgctcttcgacaccagattactttgaaataagctagagtattgcaagtaatcctcatgtagtttttgtccaaagtagaaaaacaaactgaacaatgaagaaaaatacctcagcgtttttaatatttgggagcagatggcggttgattaatatataccacaaagaatcccctgcgcggggaagtacatagagagctagctcagctcttctggctttcttttccaaaagaatagaaagaccagacatcagaccagcaaaccagtacacaaacttgtggtctttggttgcaactttacgatgcaaacagatggcagcctagcaatgaaaccagaaggatattatgatcatgaaacatttactagtatttgttaaggactgtcctcgacaattacctggaagaatgtaacaaaagcagacaaaaaggtcgtagagcgaactgcacccacaagagctcgccaacaagttgcagctggtgattccaagaactgatatttttgatacagagattccatcattaggtaattaacatagaagatggatatgtatgaactacaggataatgaaaaagtaagaagattcattgtgctaatcttgttgagtgctcgggatgttgctcaatattttgtttcactggcaacatatataactaaaaagcaatgcatgcattttgcattaagcaaaattaaagtgtctgtgcactgtgcatgaagagtacaaagatagagatgtgctataatttgaaggcttgtacaattggcttatacttgaggcatcaaattttatttgaaagaaaaatatttcgatcaagcaatagcataagtgggaaacaagattagaaagttaccttttgaaggcgtagaacaacaaatgggacaaatgtcaatgagaaatacagagggaatgttttcttgaacgttgatgaagagacactgacattatgagccaagcacgatgctctgtcaggatgtatcacagaacatggaataatgggtggactttttgttaaatttatcaaatttgaattcttcttgttagctaaataggctgagagaccaatgagatccacatgaccacctctgcagcaatctcttacagccttgtaaacaggttccgcaactggtccagtcttttggatgaagtcttggtacgatttaggtaagctttcaggcctcataacgaaagaatacataacctggaaggatatttcatatgattatatagatcttatctccataacaggataataatcccaaagcaaatcggtcaacttcatcttgttacctgggcagacgcaagtgaaaaaagtaatgcatctccatgcctccaatggcttccccaaaagtgaaatctgttcttagactttgcagaattatatgcacactgtaaaaaccaagcatcaatacatgaggaaaagggccatacatgcatcttcaccatataaaatgcaacagtttagcagttggtgacctgggcaagccttgccagaagatatagagaaagggtgcgcctcctacttgaatcatctagcgctactatcgccaagcctgccaccgaacctgctaatattctgctccatcacgccttcagttgagtccatgaacattattcgaggtaatcttataataaaaaattaacatgctttggacctatctactttttagggaccatctcagattcaagaactggttagaggtacacatgcgttgcagatgtgttgtagtgaatcagacaagataaatagacacaaaacagcataagcatagagttacttacgcattaaatggtgtttcctttttccgaaatctccgaaggaaacatcgaagtgcatgatatgatccagtgaatcctccaaaaagtaatcctacccggcaagcttcctccctcactattagatctttctccgaaaccagttgctgcaaattagaaaagaaagttatatcaatgacatcttatttgaactttgtagtatactagtagtagaacagtaaatatttgtcagaaagggaagtttgggaactggaccaattattttattttttaaccttttcttagtaatattttaaaaataaaccatccagtattttgttttaaatgaacctttcggccatgtcacggctgatggcaaggcaaaacagtgaaaacacatgctacaccatatgctattatctcggtgtggcagaggttatttttcaaacattattaacaaaaggttcaaaactttttttaagaaaaaaaaatcatactggatagcctcacaacagggatcgaaccatttaatgcatagcaagaaacatccctccaacaggttatttgatgtgcttcaaacactaccagctggtcctacacaagtactactagtaccagctcattaccagttcaccactaactattcaagtaaatgaacatagagcaatagatgtaacatcacaatcaagaccagcataatatgtgaccctgtcctttgctaacacatttgcacgccctaatgtgcgtgtgtccaagctccaacagttaagcaccaaaacccccaattccactccaattagccaaccgaaacaagatgaagtaaattcgcacagccgaatcccagttcccggccaaattctccgaataattccgtccaaactaaactaatctaatatggggcgcagttgagcactaaccgaaagaaatttgcaaattcaggtaggaggagaggagcaaggaggaccttgaggtcgaggagggaggagtaggatctgcggcgggcgagcttgaaggcgcggaggaggatgccgatgccgacccggacgccgtaggagagcaggaagctctggcacaggttccccgccgcgtgcgccgcgcacgactccccctcgtgcccgcaaccccacccaccaccaccaccaccggcggcctcctcatctccatccacccccttcccgtccccatccccatcccctcctcccccgtgctggtggcggtggagctcctggatggcctcccgaagccgctcctccgcctcccgcagcctccgcgccgccgcctccgacgccggcgcggcctgctgcggggtcggcgggtgaacggcgtcagggggaggagggggagagcgcgggccgagggtgggctcggcgccggcggagaggtcgaacgacggcgtcgagaggaacggcatggccggcgccgcggcggggtgggccccgcctgggattcctccgcttcggtggctcgcgtcgtcgtcgtgcttcctcccgccgctgctggctcgtgtcgcgacttcccgcggggttggattattaagcgatgataataataagattggaggtggttacgggtgggcactggggcgggtgacgcgtcgtgcgtgcgacggacggctttgcacctgcacatttgcacggaacggaatgtactactaggcgcctactactagtgcaagagatgggatcatgggaaaggtatggataacctcggcctatttacatcccacccaagattttacaccctagtcacatcgaatgtttaacacttgcataaaatattaaatttatgctaaaaataactaattacacagattgcgactattttgtaagacggatcttttaattctaattgcgccatgatttgacaatgtggtgctacaataaacatgtgctaataacggattaattaggtttaataaattcgtctcgtagtttactgacggatactgtaactagtttttttattagtacccgaacaccccataaaacacatcctatataatacttgatgtgatatgtcaaaactttaccccctaaatctaaacacccccttataggaaccctcttctttcttctaaccatactactccctcaggtttcatcatttttaacgttttattacataataccttctttcttctaatcacggttctacacgtcattttttgtctagacttggctcagcatgatctaattacttgaactagacgatttgaccctatagacaaaaaaaatggtctagggcacagtttaggccctaaacgggacgaaaacctgcggtctcacatctagacgcggtctagacagtctagaccatggtctaggcgaacactgatttattttgacaagtttgcaactcgattcaatggttagtttaagaaatatcgagtttttatagaagcgttgtcaagttgtttttgtcggactgtcataccaataattgtacttcaatcagactagctctaagtcccatacaggtccggtcagactgtcaaaagtgtgttccattggctttcaaggctgggatgtgttttgatctattaaagttcaatttttttactttccctgacgtaattcaccccctttggtaagtttggttacttgtgttcaatcttacagtaatttagatttggggataattagacttgacgaactacttggtaaagtagttaaaatttaaaaatacttcaaacacatcatcaagttgttatgcgttcttttctacaactccaaactacaatttaggcgttttccgttagcatgcttcccgaactgctaaatggtgtgttttgcgcaaaaaaaaattctatatggaagattctgaaaaggtcaaataaatctatttttcaactttataataattaatactcgattaatcatacgctagtgagtcacctcgttttgtgtgtcgctaatatgctactccaatatgaatactacggttcatacagaacccttgccttttctttagcttagatttctatacgcatttaaaagaaagcaatggtggtgcccaccaactctattatattttctttaccaactacctttgtgtacttcaatattacaaaagtctttcacatattgttaatatctttttttcatctctatttaagtttcatgcaaagacatatacaaggatgaaattgtttcaaaagccatacaattaattgttccaaacaatgttagcacatgtataatacatttttgtccactgcaaaacacagttgttttgctagtttaacaaaattttactctatctatattttaccggttttcaaatgatcttacggaaatcaacaaaatcattcaggagtgattttcgatcgggtttcgttaatcccgcgttcctagcttcctactctagcctctagaaaagagcataatactctcttcattcaagtttgatggtcatattctggcttcgcaccaagaccaaacacgcttataatattcctactaatctagtactctaggccaacacacctgtggcaacgctttggcaccaacacaaccaaattgttgttgccacatccttgatcgtatgcttcttacccatagcgcttgtgatcacacgcgaaatttaactgttttactatgccttgcagctatttttgcctactaaagatgaaaattagtaattagccattgcccatgcaacctaaaccaaaacaaaattgaaagagcagatcaaatagccctatttaaatagcacttggttgaagaaaggacttaagttttcaattcttttcctccctacctggctgcctctaccaccgaacaacgaaagtaacagatgatctactctgtaaattatcacggtgagcagacaggagcgatggtaaagaagagtttgtcgtggatgcgttgctgcacatggtggattagaaaatgagtgatagaagacttatcggtatgatctatagtcaattgcaaatatgattactttctcgtgcatacatatgcaacgggcttttacgaagtactccctccgtcccataaaaaacttaatcatgtgtttaaatttgaatatatattatgtccagatttaaatctaggatttggtttagtactcatgaaacgtccacgtggtggttaattaatttcgtgtgcgaactaaaacgactaatccgacaagactcaacgggctatcaaatgaaaatccagattcttttatacaagtgtgaatgatcaatcgtgaatggagagaacagaggtggtgggggagccgggcaggtgggcaatggcatccgagtcaccaagtggggcccacctaccaaccaccgtccacgagtgtgccgccgccgccgccttacatccactccactctctctttctcctctcccccgcaaatcccccccaaaaaaaaaaaaaacccgccaccgcgagcacgccgcgcgcctgcttcctccacctgcgccgggcgagaagatgatgctcccccggctcctcctcctcgtcgttgcctccgcgctgccgctcgcttccgtcgctgcgggcgccgtcggcgtcggcgaggggttctgctcggcggaaccgtcggcggcgtcgggcggctgctccggcgtgcggccgccgctctactggaaggccaccaacccgactctggcgcccgcgcacctccagggtgagtgagcgtgaggcggagcgatacgtcgcgagttggatggaatcttaaagattattgcataaataggtgctctggattgcgtcactgcagtgtttttttagaactgcaatatcgtgatattggttctggatttggagttactgttgtggagtatggatgttgatgctggttgagacgctcgggatagtgtttagttcgttcagtttcacgatgataccatactctctagaaggaatttctctgtgaatggtgtggcttgctgtcgagaattaggctgtgaactaggtaggtagtagtaggtagtcatgtgggactgaaatagaatggcatatgatatgcacgctcgtcagttactccttttcgtcgaattggattggccgagaagattatcttgtattcccttgctaagcacactttaaagataatttatgttttatgcttctgttttacttattacacggtgaatgaggatatcttctgagctattttatcgtttactcatgtaggctatctgtgtttcagaagaggatgcgttccttttcctgttcctgctaattttgttacttttctgtatctccagatttacctggcttcacacgtagtgtttacaaaagggatcatgctttgattacaccagagagccatgtattcagccctttgcctgactggtattggccaccttctgttgtactttctctttgctttccacaactatgtaatatcatttatttactctttttttttcaggatcaacacattaggagcatatttaattagtccagctatcggggcacatttcacaatgtacctggcaaaaatgcatggtatgcaatttctcccacctacaaagcataggtagaaatgtaaatgatagcagaatattcaacaagttctctttgaggtccgagtttggtttctattctaggaattcagaatattttgtttgccacagaaccattggattagcaagaacatttttttttgtgtgtgtggattcatttcggccattgggccaagaatgcctagctcccaattaaaagcttgtattcttattattgtacatcggtacatgttgtgttcaatcttatcaaactaatctgttgacaagatagagagttcttattttatatgttttatttgcagatggatcaaaatcagccctaccaccaaaaggtgttgaaaggttcagtgcttctcacttagttagaatagcaaccattcacacttgtaatcatcactgtttcaaagaacagaatgattgggtcactcctagtcctagccaataaatgttgactgtgatgcacatccaattaagtagctcatttgtcagcatcctatacttgactcgacttggtttttcaccatccagttaatgggtttccactggtccatggtaaacaattttcaggcttatctttgtactccaaggaagcattctattgtctgaggagagtgggaatacccatactctgctggtaagattcgatcaaacttagtatctgctattttgtgaatatctagttattttttcactatactctatgttcgtcgtattatgtaagtgttaatccactttaaacatttctaattccatgacataacttgatgggatcatacgacatagttttcaaagtttagaggcagcctaagccaactgcggttgacaatatttttaattgcatgaagatgatttacaaaatgtgcatgggctttttaagatcatttctaatcattactaaggaatacctgaagaatagtatcaaccatgttcagaaattccattgtagttgaatgagattttgcgacatggtgtatccggatttgtctattcctgcttctgttgttatattggcataacatgtttgaacataatgcaaattaaacttatggatgatcagttgttaaatttgtagggtgatgttattaaaattttgtcaaaagacaataatataaatattatacatgataaaagggtactaaatatgggatactgatgtttgtaaattcaacagaatttccattgtttgtcataactgaatgaatggaactcccacttgtttcttgcatactcctgcagtaaatggcttaattcttttcatgatcctgatacttgattgttttaacttgatcatcttttaccagctttagagaagtaaaggttgcctagcattaatatggtttactgattgtgtaattgctgagtgcaggtggactcttatgcctatcttcctgcaaacatgaaacactctgtgatctcagatgaagtaactacccttgtaatctttgagaggaggtacaatggttaaatggcacactttcatgtaaattttgtttgttttttaccactattttttttagggaatgcgcataatccatgcgcatcatttgttttaagaatttttaccactattattgacctagctgactagctgagtgatcttattgaatagctgaagttcttcccattttggtaggcttttagtcgctaagactggattaacttttgcaatataaatggattggcttaaggccaattaagtggttgatgaacagtatttttcctttgtcttctttttgttgtgaatatgatctgcacatctcagacaattattgttttccgtcaatgatttagttttctcagtttacatttctcattatttaatgaatatatttgtttaggtacacaaccattgagggttaccatcctgatctcattgttggatcaactgataagcaaccccttcttgaaaccccaggagaggtacattctggacctgtgtggtggataccgattatttgcaatctctaggcatctagataaattggtttgcctgccatttgagtggtacgcctttaatttatactatgcattttcaagagggttggaataaactggtttcagttttcaatttatatcatttggccttgtgttgccaatattgtagagtttttgctgtgacattcatatagataattgctgttttttcccctgctacagacaatattgtagtactgttttttgctgatatatattctgcaagcacttacatgaaattcttgcctcttttttccaataggtatttgagttgaggaagctgctacccacttctctgccttatgactttaatatccatgtaagtctgattaatttgggtttattgtttaacttggtgtgtataacatcattccactgaatgtgagtgcccataaatttcggcaaaccaagcattagattcaagctatttgttctcctagttattcattgaaataagtgtaataagctattgtgttgtataagaactcaaactctgaaacactggcaacctgagcttgcaaaagtcattacttatcagagtctttaaacttattcgtaggttatttctagactacaaaggagctaaactttttctgatatccttatttctcacttgcagataatggattttcagcctggggaatatcttaatgtgaaggtttgtgaatattttaatatttcttaggagatttcagacctaatgtgctagtaccatgttttaaaccgtgttcatattttaattgtctattagattaattacaaaggggctcccaccagaaaatctgcaatgtgtgaactacattcttggtcatgtcactagtgactagccactatgcacccatcacattctgaagctgctttttttttgggggttaattataaacaggaggttcattacaatcaacatgggttgctgcttttagaagggacaaggaatataccgattgggagacagctggtaaggatgtgatctaaaacatttccttttttgtattattcttttttttccttttaggctttatttggttgtgcaacgttcagacttcagagtcccaggttcccagccttgtttcctcctgggacaagctgtttaaggaagatatcataatcttattttaatataagttctagaagatgtgtactgagtactgtatatagattaacggctcattattgagcttgacatttacaaaatatgggtgcgtatgagcctaatctacttcatggcactattgtcatgactcatgtgtttctgcttccatccactgtcctcaacatttttttagaggccgcccttcacatctaagtatatgctttactgacagttgtaacattatagactatattagtctcctacttagctgattactgaatatttgttctgtttgctaatacaggtacccggtgcaatcaggggacaccatttggatggcaccgtttgtgcctcaatggttagtatctgtcaacatagtgtttatcattcatggaattggcttttgtaggcagctcatcaccgttgccttgctgttccaggtacgctgcccttggaaaaaccaagacgaggtacttgctgtataaagatgtcaatagggatccactgatatgaggaatgcaacatttcctgaccgatggtaatagatcaaattggagagctattacgctggtcttgaagagtccctgtggaagatgatctcagaaaaaaataaatcttctttctcgctgatgaacccttcaaaatgatgaatcgacgcaagaatctcagatctgtacatggaatggtcaagctacccacttgttcttattggtcaatatgaattcagaaaaaaagttgctgtactattttctggacagaactgggctatgctgtgactcttcggaaatctgtattggctaaccccttgaaatgtcgaaataatgcgtcgctgtaatgaaaccaggtacctgattccaagattagtgcctttttttttccttttaattgcagagcatcaaatatgtggcgacatgtcgaacatcaatgtttgggtatctgaagatgccttttaaaaatggaaatgaactgctttaacaatatttgcaagaagaaacatgattactctttggctttatgaactccaaacttatgagctatgattggtttatgcctttatgttaagcttgatctccgaactatgaaagggcattattcgtgctgtcaagggaaaaaactaagaaggaaatgcaagttgttgaagaataattacattatgcttacttttactctcttgaaatgccgtgccaatctttgccaaaaggagatgatagaaaacataatattcttaatcataaggggatatacatgcatgatgtgttgataagtgtgtccctgccacatactccctccatccaacaaatccaacctaataagaatgagacataaataatttagtacaacgaatatgaatctgaacatgagtatataggttccagattctccctactaggttatgttccatatttgcctggttggatttttttttttaagggagagagttctccactccattaaaaaaatcaacttaagacggggtgaaatataacctagtacagtgaatctgaataagtcctaggttatattttatccttgcctagattggatttttttgaatggagagagtggtacaggagaggcaactatatttttttattttgtaaactttttaaataatactcctccgtctcaaaataagtgcactcctctagttcaattttaaagagtaaattacacaagcggtccttaaacttataacgaagtttcacttaggtccataaacttgcaaaatgtgcatcgagatctctaaacttggtttaatgtatcatcccggtctaaagctgcgtttgaccatagtcttgcctatgtggcatgctacgtggacgatgatatggaatttttttctcccttcttccttctttttttctctcttcttctccctttttttctccactttgcctccttcctctcccttctgccgctgacaggtgagacccacctgtcaacgccccgcgaggctggcgagggggtggggaggccggcagcagcaacgatgtcatcgacgggaaggaaaaggaggagggaaaggggaaaggccccccactccagcctgctgcggcagctgctcaagttcaacaagctcacctcctctttcgcggagctcattgtcgggccctgccgccccgctaccgccatcgagcttgcgcccgccctgctcacgctgagctcaccgacgcctccccctgcacgcacggtcgcgttcggcgacccctccccccggggcgcggctggcgacacttccccttgcgcgcgcctcgaccgcttccgcatgaatgacgcgccgccgcccaacgaagtgcgccgccccccctcttcgcccccctccagtgcggcttgcaaggccgcgccacccccgctcatcaccatcgttctcgtcttgggcagcggcggaagaggaagtagagggagaaatcatatgtcgccgttggcggcggccgcctctccctctcctcccccctgggcctccgtatgcggctcctctccttctgccagccggcgcccgagcacgcgcgccgctcctctcctcaccggccaccacccgcgcacgcgtgctgcttctctcctcccgccggccggtgcccaagaacgcacgctgaccgtcgccggaaacctcgtccaccacgcaaggtgaggaaggagagaaaagatggggagaaaaaaggggaaaagaaatttagccatatcatcgtccgcgtggcatgccacataggtaagaccacggttaaaccaggctttggactgggatgatacattaaaccaagtttaggtatctcaatgcgtattttgcaagttcgtggatctaagtgaaacttcgttacaagtttaagaaccgctagtgtaatttacttaattttaaacataattatgaaaaagtatattcggatcatcatgtcatattcatcggaatgacaagaaaataccatcacgttggttaccaagggtgtgataaggatttaatcacgtagcatggctaaaggtttatttttgcaaacatttaataatgttaaaaggcacatttgatgggtagtagtgtttaaactttaggtggattcacttgcagaagtacgaaaaaggaaacatgatctacttcctccgttttttaatagataacgccgttaattttttctcacatgtttgaccactagtaaaattcaaaaaatttacgtaattataat

SEQ ID NO: 35982 - DNA, 2112 bp, Oryza sativa
tcaaacatgtgagaaaaagtcaacggcgttatctattaaaaaacggaggtaatattaaactgtggtgttattttctcctgaagatgaagatgaagttttttttacgcaaaacgaggtggtattaccgtatgattgattgagttttaattattataaacttgaaaaatagattaatatgatattatagagcaacttttatatagacagttttcgtacgaaatacaccgtttagcagtttgaaaaagtgccactaaaattttaatcttaattcaactcttgttgaaaaaaaaacgagacctaagtaatataggaaacaagtgctttgtgctagcagcacgcattgaggatagatatcaactgtcaaccaaagatagtacatgactatgatttttctttgtattaagctgagttctttttaataacttgaaacggtttaattttctctttttcgttagcacttttttagaaatgctaaatggtacattgtatgtaaaagtttctatatatatatatatatatatatatatttttaaaaatcttcttaagtttaaaataatcgatacactattaagcatgaggtaatgactcttcgcattttcgtgcccggaaaatcaacgaccatccaacataatcaaaatagcccttaggctatgttcttcaatttctttcccaactcatttcattctttttaggcaaactttttatgtccacacgcttctcaaactactaaatgtgtgtttttttaaaaaaaaaattatgtaaaaaagttgcttttaatattataagactttttagcattgcccacattcatatatatatatatatatatatatatatatatatatatatatatatatatatatatatatatatatatatatatgcgcgcgcgtgcgtgcttagattcattaacatttatatgaatgttggcaatgctagaaagttttataaactgaagcggaggtattacttaattaatcatgcgttaatgaggaacacccttttttcgtgcgggaaggtggagtttcgcaaactcagccttagtcgttgtttgctgtattaacgtgcactaaaatactgtaggagacattttcacgcaaaatgtagccggagttggttcttttcttgaaactggtcacatggctaggtttttttattttcaagcagaatcaacatactatttttcttcttttagttgacaagttcaaccagatggtttgatcggaattttcgaaaccatagatgttatatttttaatgtgacaccgcttacaagaatactatatcaatatattattaccattccaattagttccttaccatcgtatcatttccatccctataataatctaaggttgcgttcgtttgaggggttgttaaacaaaacggagctgtgaattagtatataactaattaaatattataaaaaacctaataaataaattaatataatttttaaaagcattttcctacatagatttttcaaaaaaaaacacacagtttaactgtttaggaaacgtccacgtgaaaaacgagacacatacacagtatacactaattcaaacaatatttcactcatgataataaaaattcaaatcacaaactgcacttcccctcaaataatatcgaaattgatgcttgaccagtcaacactacttaatcacacacaccacccagagccaaaccagattaaatcaaggtcgggggttgccttgcctaaaccaatacaaacaagctgctaatccaaaatcaatgtcccgtccgatcgcgagatcgcgatcgcaaactggcaaaatcgcacccgcaaaaatatctcggcacgagtcgacgcgacattccaatagcagcagcagcaagcagcattcgcattggccttcgcgcgcttttgcgtttacacccctcgcgccccctcaaaattgcagacgcccccctcccctcccctctcgtgctctcctctcctctcctcttcctcctcgcctcgcgtcgcctcctccgcggcgtaccctaaccctagcctcgccttccccccaatggcgcgtcacgcgtgaggagccgccgccggagcagcaggagcgggagcgggagggagggaggaggagatgtacaagcaggg

SEQ ID NO: 35983 - DNA, 9030 bp, Oryza sativa
cgcgtcgtccatgcccaagggacggtgctccgaaggtgacgtcacgcgcgacgcgacgcgaccgactcgccttccccctcctcttttttttttattggccgtctcgcgtggcgcgtcgtgcctgagattgagaaatccgtcgtttgcgtggtgcgctgatgcggttgcggccatgggaggggatagattgcgctgcggcagcagggaactggttctggattggtattccgttgtgtttgatatgattagtgattgcatatattcgtctttatggggattcaggcggctgcggtagaaatttattgtttgattttaaacgttaggattaggatgtctgcggagctttcctaagagggaaccattcgtcacatgtggtgtttgatcgatggcatgagcttatgaacctgtttggaactatagaacttaacagggaataactaatttgacgtaggaatgtaattgattgttgattgtggattttcattagcggcgaagttgttggagcgttggaggtattgtgactggtttgcaatgatctgtttaatgtatcctaaatgtgttgaagactatgaaagttgatttatttgttctatatgtgtgtagagatgtcagtttaagtttttttggaggtgtttcagggttgtgttaattgggctgttgttttgatgatgtttgaagatgctgatgtaggatcttattgaggaagtgtttgcttgttgtatccgatttaccatctgcttgtttcaggcatagacgcatagttaatgttgtgtaaaagcacacaaatgccttaaatggccttacctcccattgggctttccatatgtgcaccgcaaaaaagattaacggcattgtctaacatcacttatcttcatgattttatatgcaaatacaacgcgtggcttaattacgtacaagaataacaaaaacaactccaaggacaacaaaaataaaaacaatcctgaaattttttgcatgtgttgttgatttaaaggttaattgaaattacattcctggagtggtctccgttaccaaaaccaaaaatcaagtggcccatacgatcagtaatatcttatttttatgcttcattgattgcttaaatttggttccattgcccagttctttgcatgaatgttgccagtcgggttgaggagtccattagtttaattcatctatgctattgcgggtctaactggagtataacttttaagttttttgaggtgttgattaagcatgctatgttttatttcagatttgatactgtgtttacaggtatgctgcatttgcatcattgtttgtaaaagcctttgcattgacaagtccatgcttgacattgcaggggagtctgaatctgatagtgaagcatcagatgttagtggttctgacggagaggatcactcatggatttcatggtactgcagtctaagagggaatgaattcttctgtgaggttgatgatgattatatacaagatgacttcaacctctgtgggcttagcagtcaagttccatattatgattatgctcttgatctcattttagatatcgaatcttctcacggtaaatgttccctgtatttacgtatgcaaatgaaacaaatggtggatgtatttgagcaaaaaatgtttcctgtatttcttccttgatctgcttaatagttgaaactggtatcttgtattgatgatgtccaaacagaggtcaacttagactttttaaacaaaagtacatacaattcttagatatttgttcaactcttaagctagatattagatattgtggagtaccatgactaatttaaggtacctctcctagaaagaacacaaaacatagatgttcctttttttctcctcgaattgatctctgttatcaacttctatgattatgaacaaataaccagtgcaggtcaaaaggccttttcttttactgttagttattgtgcttttgtattctggatgaccgtctcttttgcaactctgcatatggctgcaccatcatgcgttacttgtcgtttgctccttgatagtacccatagtacatgcttagaaactttctgttctattacatggaaaattaattctcactattattaaaccttgtgattttgttttgttcttggtcacctgtttaggtgccctaatgttattaagagtgatgttgctaatagattgctttaggtttctgtggcagtaaatggtgtggtagtaattagcaagcatggagaggatatgtgtgttgttttgtctgctattttaaatgccataacccatcagtaatgtaacacagccttctttatggcatcataatgcagtagctccctttaatccatgttctcttttctactgttctcattctttttgctaatgtttcttgattgtgtcaatatgtaggtgacatgttcaccgaagaacaaaacgagctagtggagtcagctgcagagatgttatatgggctgattcatgcacgatacattttgaccagtaaaggattggctgcaatggtacctttctttggtatttatattgttggacttccgatttatgataaattgacagttgttaatattttttgtcacagctggagaagtacaaaaactatgattttggaagatgcccacgagtttattgctgtggtcaaccctgtttaccagttggacaatcagatatacaccgatctagtactgtgaagatatactgccccaagtgtgaagacatctactatccacggtccaagtaccaaggcagtatcctaaccactctcttatcatactgtctatatgagcgttccttttttgtttttctctggaagaaaatagaattcctttggatttccagcattactatattctaatagttttgccctaattcgctgataggagtggttggcaaatgctttgacaagttttaacaggcagacatatacagttgttaggacgactaatatcaatactaaggacataaacaattcagtaatctttaacgcatggtcttttgctttcttagtgttctcagtgccaatatatattatcgcttattagatgaagtccacacactctcatctgtgttacattgatatcatagttacatagaactgccattttgttgttatattctgctgttttcttgaccatgttcagacatcgacggcgcatactttgggacaacattcccgcacctgtttctgatgacgtacgagcacctcaagcctcagaaaccctcgcagcgctacgttcctcgtgtatttggattcaagctccacaagccatgaggcggagactggagttttgcagggcttggagacaccctggtggactactgcaagagtggggggcatttgccagcgatggtctctatcatgccgccactgccacctccacaggcctgccgcatgcatgcaccttggcaggcaggcccactccacattcgaagtgtagctataaaaagacatcaatcgatcaatgttgtaacgtaattccaattgttctttaattagcgaatctgtgggatcccgtaattctaaagtagccgatgttgtttgtgccttgattaaaatggtgtgctgccccaggcattggtttattttatcttgtaagttgtaagcaaggttcatgcctgcaattggaaggcgagggatgacaggggcaggccggtattctggtccatattgatctggtattctgttgcttgctcggagtatccacacaattcatcatcatggtggatggaagtgatgttcagtgctcggtattctggtaattctagtagaattttattttagaattattgtaatggttttaggcgccttccatttttcaatcctcggccttttgaactgctaaaataagagtagaagtgttataatcattcatttatttactttgctgctggtcatgaaccgtggctgtaaaaagacttccaaattccaaaaaggccttgtttagttggggaaaaaaaattttggtttggttgtcacatcagatatacggacacacatttgaagtattaaacgtagtctaataacaaaacaaattactgtagaattcaggaaactacgagacgaatttattaagcctaattaatccgttgttagcaaatgtttagtgtagcaccatattatcaaatcatgacgcaattaggcttaaacgattcgtcttgcaatttacacgcaatctgtgtaattgtttttttctacatttaatattctatgtatgtgttcaaacactcgatgtgattgcgtgaaaatttttgttttggggactaaatagggcctagcgataagcgataagcgattctcccaagtcatccaggccaaattatttggtctcatacaacttttcttgattaataaaaataagttatttggtcttgtactgtactaccagatagactttgtaaggagagccagccagcaactttagactgtgacagggactcgaagacacagggagaatgggaggctagtggcatgaatggttgctttcagtctgagagtcaggtaagctcaagctggaggcagtaccagctggtcatagcacagtacaaaaagtaccctttttttgttttttttctcccatcagttcgaccaggcaagcatatactcctaccagggaaacctagcaaactactccctccgtcaaaaaaaaaaaatctaaaactgaatatttattttttgcgagacgatgtttgttttttcgggacagagaaagtactcccttcgccgtagaattcggtctgcgcgtatacttcctgacttgttaaacaatgtctttttttaaaagagaagttctacgaaaacgttaaaaaatgcttttaaaaattatattaatcatttttaagtttgaaatacttaatactcaattaattatgtgctaatggttcacatcgttttgtgtatcttctcaatcttctcctttccctcctctcaaacacttcctaaggatgtgtttagatccagggggtaaaaatttttgccgtgtcacatcggatatatggacacacatttgaactattaaacatagtctaataacaaaacaaattacaaatttcgcctgtaaactgcgagacaaatttattaagcttaatcaatccgtcattagcaaatatttattgtagcaccacattatcaaatcatagagcaattaggcttaataaatccatctcgcaatttacacgcaatctgtgtaattagttttttttgtctatatttaatacttcatgcatgtgtccaaacattcgatgtgacagggtgaaaaaacttgccaggggaactaaacaggccctaagattttttttgtctttccctattgtcccaaaataagttatttttgagcaaccattgtaccgaagtttgtgaaaataggggataaatgtattgggaatagatagagagcaataattgcattggggtttgataaaatgaggatattgtagtcttttttttatattggtatatgtgggatatgtgaaaaataaacttatttgagacataactactaccttcgtccaaaatatagtaatttttagctatatatctgaatatgctcttatccagataaagatatatagctagaaagttgttatatttggggagtagtacaattttcgaccaacagagacattggtgcattgcttggacccatataattaggatgagtcagagacattggtgcattgcttggacccatataattaggatgagtcacattgtttacgatcgatgggtagcagatagggatggaaggagaatcaagatctaacaagtcaatggggtaggagataggtatggaaggagaattgagatctaacagcttacagctagtgggagaggaatggagacaactccgctgttaagagacgagaactagcgacacatccctaatcttactaaaaacatgttaaaagtctacttacatgtgcataatattcgtatgcatgaagatttgaaccttggtgggtgaagtcatgcacccacgactctacccgccggtgcttccacttggtgggatagtttttgctattctaagatcctcaatacaatgtttttaaaaaaatcctgagtaccatgaactttagaaagcaaatccttcatatttgccttaaaaaatatgatcccttattcactgcctcagatttcaaggaaggagacattgaggtaaataattagataaaatttcaggatatttttccttaaaatttgtgccagtgaatagacaatatcccctacggtaatttgagactaatgaagaggagtaatttcctcttaccaaaactgaagctccaaagatgtgggagatgataatacatggaaaatatatcgaagtcacatgaggttctggaggtaggattgactttgcttaatcatgcttaactttaaaaagagctgtttgatgctctcatatcccaagatcaatttacaccttcacctctcgtgggcatgccaattagcatagacttaaccattgtttaggatgaatagaaaaatactacctctatttttataaagatgatgccattgactttcagtgtaacgtttaaccattcgttttatttcaaattctagtgtaaatatgaaaaaaaagttattttaaagttatgttaatgataaaagaagccacaaaaaaataaatgatacttatatagtttttagtaagaaaatggtcaaacgccatgccaaaagttaatggcgttatctattgaacaacagagttaatataaagctaaaactcgttgagtcaaagataatgtttaagaaaggaactcttagtattcacaaattcaacagagacagtttatattgccgcagctttgctatctgcaaatttcagatccagaaatatgtaactcaacagagcaatatgtgtttcgatcagagatctgtttgacttacgaaaaaagaaactattcctagcatttaagacgatggggagacgttgataatggataccaggttccagtttaagctgacatgtcagttcttcagcagttacttcggaaataacagaaaacaataaacatgcagttcaatagtgtcagtggcacaaaacagggcatcattcctccatagtccttaatatatgagttgaattgatctttggagattttaaggacaaaaatattcactaaagaagcattttacttggtgtcctaagaagactccaaccaatattgtaagccatggacagctatgatcagaccatgctttgccattcttaattctaattgtatacttttagatcaatctaatgagctgtaatgaaggacagctaagaaactttacattgatactaagtttcacatgttgttctgaaacgaactgcttgatatccatgtccgttgctctcacattagcataatgtacatcagaagtagaatcctaccagattttttttttttgtaattcttatcaaaataaattcatacttaagagagggagatcatggaaaacaacgattgctgaatatcatttaatcatgtatgaattatttcaactagttattttttcaagattattagtaagtactaacaaggagaaaaagacataatttgctagacatgattgattagttttggaaatagtatcatttacgacatcaaaatgtggagattattctagttccacaaactaataactagattgtagatgtaaaacatgccaaaccttcagttactaaatgaaataaactgcatgggccagatatgtaacaagaagcagtccatgtgatgtaataattttagtaactaaattggcagaaaacattatggaactactacatgcaacaggtttgcaagtcccagctcccaaaggtcaaccaaatttactgaaaatgaaagcatcacaagagaatgataggggttgaaatcatcagtggggtcaataagtcaagagggttggtgtaacttgtaaggctatgtatttagtgctctagattaggttagtgaaaatacaattctaagctactagagaagagacagagaagaccagtatttcttccagagcttaccatgaaatcacactccagtctctctccaagcttcagaaccagacatctctcctcttctgtgcaatgaggtcttctaactttagtggttgaattttggcagtctccatgccttcttcacaagattatatatacatcagtttcaccggtcaaagtaagcacagccttccttgattctcttttgtgcgactttgtgatgccttcttgcattatatacactacatattaaagtcacacattcttggagcagagctatgtacctaaatcattcttagaagtaactaaccttcttcaacccttactttgtaaccatggctttctctactactgaaatctctctatgtagctccattggacttctaggaaaggaggtggtctttacatcttgagcgtccagaactgagctatttgaacagccttcacttgtttgtttttcttctggtgaaatattggcatcacctttctttgacaaagttgaacattcatgaattcttcttaacttttttttttatcctctcattttcctgagatcctacttccagctcttcagttggtcttgcaagttcatatgttccactgctttcttgcaaagaatccttgccttgtttacatgcctaagtttgttgctagcatcattctgcctatactttgattttctcttgttttctcttccttcttgcaatcgtgacaagatttacaattgtaatgctccactctgttctgaaaaaactaccatacttatccaaatcattctagcacaatcacaatgggctgcttcttctactcaagagagaagaacaagaataagaacaagaagcaatcaaggtcatcccctacactaaccgtagacaaagatgacttcagagatgaaatgtccaagaaggccaacagatcatgcagcctggttgttgcttcatcaccacggagcatactggagctatacgaggagcgtgcgcatgagctccgtgattttcgccttgccgagctgagaagtgctaccggtaacttcagtagagagctcaagataggggaaggaggg

SEQ ID NO: 35984 - DNA, 11637 bp, Oryza sativa
agagatgaaatgtccaagaaggccaacagatcatgcagcctggttgttgcttcatcaccacggagcatactggagctatacgaggagcgtgcgcatgagctccgtgattttcgccttgccgagctgaaaagtgctaccggtaacttcagtagagagctcaagataggggaaggagggtttgggagtgtgtacaagggcttcctaaaaacttcttgcggtcatttggggctcaggaatgacagtggcaatgtggtggtggctgtcaagaagctcaatcctaatggaatgcaggtattgattgtcttcgatagaccttatgaatgttagatgctataatcatgtttctatgtacactgcaattgttaaatggagttgaagcataccttttattatgaaacaaagggatgcagggagcctgggatcaaattgcataagtaaatatactgattctgcacatattggttactttcgaatcgtgccgagtatattatttaatgtaggattccaggctgtgtaacaatttttatacaaatcgcatttagtactctaaaaagttgggcaggatggtttggtcaaaattattatcacttatggaatggaatgtgaatgttagcctcaggatgactgatgacaaggattttagcaaaattattctcaaatgtagactactggtaaaatacatttttagttcatattttgcatttcccatgcataatactcagcaaatatataactgtcaaattatagctgcatgttatagaaaattatgcctcacgaatttcttgtgtcttatatgcaaaaaaggaaaatgaaccccccatggcttgtaagttttaacatctagaatgcagtaattacaacattttgaggaatcatgcacttggagtagcaatctgaaaaaacaaattcttccattaaatttgtttaaatgttatttatacttctacaattcttccagtatgaccatcaattcaaaaagttgatttattcctcaattacatcactttcagggtcataagcagtggctggctgaagttcagttccttgctgttgtggatcacccaaatcttgtcaaactcattggctactgcgggactgacgacggcgaacaaggtcctcagagacttcttgtgtatgagtttatgcctaacaagaccctagaatatcacttgttcaataaagcatacccaacacttccatggaaaacaaggcttagcatagccttgggcgttgctaaggggctgcagtacttgcatgaagggttggaaattcaggtattggtctaacaacttcgataatcgatatattgagtattgtcagttacaagttcagagaacaatgtaaatagcagtgctctttttttcctcctcttttcttctgctttttctgctgttttctttaatccttactattagttgttattagaagcttagggctctagagctatgttacattagtaaacaaataatacagctgtttcccattaatgctatctcaaaacccaagtgctcagagttaagtgacaactcccagttgttccagttttgcaatgatagtctcatagggatatgtatcaggagctatgattcagaaggctttctgatctataattctatacttgttagcgcaaattaacagagttttccagtgtttatattctgaactattgatgcttgtgttcacatgttgtagagttgtagacttgtagttatgacactctttatgttacaggtcatatatcgcgacttaaaatcatcaaacgtgctgttagatgaggaattcagaccaaaactttcagattttggattagcaagggagggcccagtggatggacaaactcacgtgtccacagcggtaagtcatttgtcatcagtactagcaagatggttaccatttaccttaagaactacttgcattcaatctgcacaaaaaaaaaagtagaattacagtattttcttgaataatttcatggttggttcgaatcgggcatcaaaacggtctagaaagtttggtaggcggccaaaccatcgtttcaggcatttgtcctgacatataatctgttttcacctggagagatgtgttttcacaaaaagattcatgcagttcaacgaatgcgaaacttccaccctttcaacaaaaataagctaaccaatgcaacccctagaaatttaagatctgagagttggcggtccaatttagttcaaagttcaaactaatggctaaacttttgcaaaaaaaataaaataaaattcgatcggagactaatggctactccctccgtttcataatgtaagtcattctagcatttctcatattcatagtgatgttaatgaatctagacatatacatctatctagattcatcaacatcaatataaatgtgggaaatgctagaatgacttacattgtgaaacggaggaagtacaattttaacattgggtgttatggttatcaaaagattggtacattagaaatcaattttagtgcgaagtaggacaggaataataggattattatgtattaatctgagcaatgcaagcatgaacaatcaacaacaacgtgtgatgtgtatgaaacgggcataaaatcaaacaggtgatgggcacgtacgggtacgcggcgccggactacgtggagacgggccgcctcacggcgaggagcgacgtctggagcttcggcgtcgtgctgctcgagctcctcaccggccaccgcgccttcgaccggagccggccacgccccgaccagaagctcgtcgactgggcgcgccgccaccccgcgggcacccggtggttctcgaggctccccgacccgcgactcgcggggaggtactcgcaccgcgccgcgcaggacgtcgcggcgctcgcgtggaggtgcctcgccgaccgcgccggggagcgcccgtccatggcggaggcggcgcgggccctggagcgcgcggcgcggcacggcgagctggatggtccccccgagccgccggaggagggatcgcccccgcctcctcgctgccacgccggctccggttcctcctccccggaggcgaagaaggcagcgacggcgaagcggcggcgaatggcgcacctggccaagctggcggctggcgcgagcgcggcgccggcggcgcggaggctggtgcacatgaagatgacgaaggcagcagctacatgcaacgcaggcacgcagcatggtgagacttgagacctccctgtgttcaaagttcaaacgcactactattctatcatgtaatctactcctcctattctatattacttcctccgtttcacaatgtaaatcattctaacatttttcacattcatattgatgtgctagaatttctcacgttcatattgatgtgaaacggagggaggataagttatttgattttcttttgttaaatttctttaaatttgatcaatttataaaaaaaatatagtagtatttacaaaacaaacatattatcaaaatatattcaatattagatttaatgaaactaatttgatatattagataaaaaaatatttttataacttggtcaaactaaataaagtttaactagaaaaaaaatcaaacaatttataatacgaaatgaaatggaaagagtactaatttttgggataattacgacctgattttgtttcgatgacttgctctcgcctgttctactaccattgcaagcctgtgctgtgcatatcatttttttttcaaaaaataagtgttttggtttctcttaagtacggcattgggatattcttcatttgaaaaacagcagcaatttctgatttcttaacatcaccacatagtttgaacacaggatgtgtaccgtaccaaaagtggattttaatcttgacgactacactctccacataagagaattcatcagaagctagaaacagaacggcttttgtgttttgtcatttgatccaagcgtaaactcaggatggaaaactggaaccagaaaacttcgactttgtaggctcggagaaaaatattcactattacaaaaatccatgcaggagtcaagttaaaagaagaaacagggttctgtctttgagatggagtataatttatttaagatcattccctccatcccatcatccatgagtttgcaaacttcagctcacattctaaaaatgaagatgcaaaagagagagagggacagcaacttaaaaacgtattgatcaaccagccaaagcggcattgagcgcactgtgaacatccactccaatctgagcttcggccttctccagttcagttgaggccgatccaagcttggcgttgaattccgcgagaccctgctggaccgcggctgggtcgatctggtccagggggacagcctcaacagccacgatatcagcgatggagtttgcatggacaaatgcaaagccactgctcacaaagtacttggtgatatcgtttccctcgtgtaccgagagaacaccaggcttgagctctgcgattgtggaaacgtggcctggcaaaacacccatctgaccagttgttgctggtacaattaccatgtcaacctgagtatagacaagcaaagacataagcaagggaaagaagcaacagaagacaatattgatgatgggggaagaattaattggtacattaacagtagtattgttgaatcaagcattgacatacaaaatctatgtgaatcaactgatagataatttgcctatcatctgttgaaatgcaacaacacaaacatagacaaccttcgaacaccatcaaccaattatatttcatacacaatagcaacaaaagaacatgacgctcagcaacatacttaaggaaaaattgatgatctgaaacttcttaatagtgccattaaccattaagtaaacagtaccaaaccatcaaggccaacaagcaagctaaaggaaacaacatgaaacaaagaaaatcaccacaaaactaaacaagtagtattagacttggttatcacagggcaaataacatatatcaaggacaaaagctataattggcgcacagtcaaaaaagaagctgcctatgcagcatagtaaaatataagtgaatagtaggctatattaatatgcagttttatttatagaacttcagaaggaaagattttctcaaccaaagaaatttacatcaggaacattgacagtgaatgttcagacacaaactctagttaatgtaaacaagagaaactgcaactataccgataaatccagacaatgcataaagccgcatagcactacaaacactagagataaacaggtctgaatacactgttgtagtcagaattaaaacttggcctggcacacagcaatcctagcaagagaaacttgaaatctataaataagaaacacccaaggagcgacctggaatcctcaatctgattaacaaaatgtaacggggtttccaaaagatacttcactagactactactacctctgtccccaaggagcggaccgtgtttattgaagattttgtttggttggttgtatgaatcacgaatttagccaggttcatagctaactaaaaacacagtcttttaaggcgaggaaatatcaatttatgaattctctatgctccttgcaattaaggcacacaagcaccccaaacaagaaaaaagaaatgcaatttgctaccaacactcaacagcaatcaaatgttgagcagaaattctatagtcatatgacatctagccacctggagaatcacgctacgttatgtttgtcccatgaaagaacatctccaactcatagcaacaaaacaaggaaatacctggtatgattcaacagccatgtacaaccgtaaaccgccacacattcgtgttaataggattgcaaatacgcacgcccaacaaatggccacatcacaaacattctgggcaaacgataaacggaggatagaagcattgaccatgatatattcctacggatgaagagtctggatgcgagacctctaccacaccagctcgacgaatcggatcgcgctgccttgacccacccaacccctatccctaatcgcacgacgcaaaccccagatcgcgcacatacccgaaaccctagcgacgccacacgcacagatctggggaccgaggaggacagaggagagggggaggggggggggggcaaacacggtccgcgcgtacttccttgttggcgatctcgcacttgtaggggaggacgaacttgacggtgagcttggaggggatggccgccggcgtgggggggcggggctgcatgatctacatgggcgtggcgggggcctcgatgttgggggccaccttcttccacgcctccgcgaaggcggagtcggtggccgcctcggccggcacctccgccgtcgagagcgccctgctactgcggccgtcggcgccggcggagcgggtggtggccaggcggcggccggcgtggcgcagcatttttctctttcttctttttctctctctcgtttctcctctagtcaaagcgactgcgcgtgggtgggtggaatggggttccaggggtgtggcccatttggaggccaaggtaaggtaagaagtgtgggtcagtgggagtgaggcaagtttgggctgggccgtttctatatttagggtaggtcgcctgccttcttttcatatcatttaggaataagttcacttgaggtcccttaactgatcaacgaatccgattttggtccttcaaccaaaaaaatagatataacggatcccaccactgtcaaaaccggcgcaatataggtcccatggcggtttggacggtggttttcgctgccatgtcgcttacatggctagtttgactcggtctttattctacgtggcattgccatgacaatttgatctgggaaataataaaaaccgtggacccatatgtcagctataataaaaataataattaaaaatggtgaggcccacgtgtcattctcactccctcctcttctctctcccggtcgttcttcttcctcctctgtcatctcttcatcatgtggaaagagagagagaaaggagcgaatgagaacacatttccatatcaaattgccactttaaacgtcacgtggatgctatatgggataaagatcaagtcaaactagccatgccagctaaaaccaccgttcaaaccattatgggacctatgttgcaccgggtatatggtttccggttgaaaggtgaaaatcagattcgttaacaagttaagggtctcaagtgaacttattcatattgtttattggattttttaaaatggattatttactccgcgtttctaagaatatgctttctaaaaaaagaatttttattggattgcttagaacaccttgttaaagttatttattaaaatgtttaatttatccatataatcaagtagataatccacagcacacatagttcttatatgttaaatggctactttttttcatgcttaatggacgaagcgttttgacaattattagaggatacaaacaaatgaattatctattatcaactcgaaaaatggatttaaaatggtattctaggaagttcatatataaaaatattttacaaaaattacatcggaaaacatgccaccgttccattcttctcctcttctaaattaaaaaaaaaaactcatttcttccttaaacattttctcattttttccggtaaagaaatatatttttttaatttatttatgggttataatacaaagcagaggtttgcaatgaggatgatcgcattctttctgaaccagactacacaaatagccacgttttggatgggaacaatcacaagttcatggcaaaatgatagtgcacccagaaagcatagacacatcataattgattatatttagcataagagcaaccaagctaggtatttcggaaagacacgatctacagaatgcacctgcttacatcaacctggtactagataaatactgtgacatagccatagtcctgcatttaactaaaattacaaagaaccaactgatcaatccaactatcctttgggttttataaacacagcacctgcagaaatccccaacaatgatgtcagccctaaagttaagaaagaagccaaaccaattacccgtgcttccaaagaggcaccgaatcaaataatgaacacaccaacagtaaagaaattgatatgtggaaacttagcatcagtttttaacgtgcaaagtcaaatgcaatatatgcttaaagcctaaaaactattagaagtaaaatatttcttgtaattgagcagctgatggacagctatgctcaactaaaaggaaaaacttcctaaaattagtattcatagcaatatggcatccttcaacatgtgagcgtttttaggtaaaagttggaatcattaagcacgaacatcaactgtgttattgaaacatttttcctgtttttgctctattatctgcacatatttaggaaatagagagtttccaggacttatgtcatatgactatattaaaaagaatatcacaattagaatatctgcctcaacttcataactgtgtcctctagaaccacagcaactagttaagcatgccaagttactgttcaagttcctctaaaaaaagttactgttcaagttgtgtaccccacatggtagtactggacaattctggtattagtgatggcaaaccttagtagccagtaaggtctggactgcaagtgctctatcaaactcccatcaggcctacaagttcatcagtttcattaaaaacttgaaatcggtaataaatgattgtcagagatgtcaaagtgtacaactgtttcaaaataataaataccatttgtggtctatgcaattgatcttgcttgtgacgtaaggtcaaggagtcggtttcccacaaaaataattacttgacaacttgaagcaacagcatgatcttctgtatcagcatagcctctttgtagaatatcacaagaaagaaacattactgttggtaagacagtagtctaagattgccacaaggccagtactacaataagattatcaataagattatcaatggtcaacatatttaaatgtaagaattagcagccacctggaacctgaagaggaaatatgtgctgctatgagattcatgatccatgccaaaacagatgaaagaaaagacgggcaatttatataaaaaaaaaatcgatagttgaagccttgaaagttgatttagaagccttgaaagtggatttagaggtcaaagaagagaaaatccatgcatgtaagatgttacagtgagtactaaggaattggaactaaccatcaagaataaatggaaagacttgaaaggacaatacagaattatacaacagatgcggatgatgttacatcggaagaattctgtacagatgtgcatgcacaagaagagtgttctctaaatgcaaaaggattacagtgctgcagtcattttacctatttgacgcctgcccaggatctgaaagctctgacatcttctattcttttactctgttgttctgttttttcatgcagcaaattcaaatttctatacagattcttgtgtagctttagaaaaacttgcttgtatttccacttgtcacagtacattttacggtttgccatgtaacttaaaacctccatgactcttgcaaaatagccagcgtttaggaaattcaaaatcaagcagtcaagcaagtctctatccacagttagctctccatattcgagtctgcgctttatttctccccacagcatggcaatctccctatgcatgcctagtgaagaatatccacacagtatgtggcaaaaggtatgcagactgggtcttacattctgctctctcatccgcttatatgtgctcaaagcatcgtccatcatatttgccttgcagaagaaaagaattgaattattgaactcaaaagttaagtgctctcgagagctataatgttctatttcttgaaccaaactggaaagcaaagacgaatttctgaggggcatctcatccttgactattttggcaacatcctttatggtaaaggatggattggtatgaaaatcagccattgtatatgctttcttttgtatctgttggagaaacctattaacttcttccggtttattctccttctcatatgctctcaaaagagacatgtaagtacagattagaacaggaatctcagctgactctaaatcatccaggatatcatgagcagcatgcaaccatcccatcagaatgcatgcactaattacatctgaatgagatggcccctttagatcttccttgtgtaatgtaataagaaagctagacaatgcacgcactttacttgctttcaaacagccaacaatgaatttagcaagagccttctcactaggacgaatatttccatcaataacagcaagaaggccaaattgactttctgtatctaaaacgaaacctttgtccacttttatggggtcaaacattattctgaatccagttttcaggttgccagagcctatctgtattacaccttgtttatggacactatcaccaacaaaagcacgaggcttttgttgtcgatacagatcaaccaaaagctgagcagcggcatccatgtcattatatttgaaatgcaggttcagcagacttccataaaaatatagatagtgctgaatgaacggcaaagatgcaaaagaatcgatacttcttttcatgttcaccaattcaacttgctgcccaaccatctcaaagacaaggctagcgatagccactgtatttacatcggccacaaccccaaccagcgacataagctccattattctttgggccttgatcatgcatttgaaatcgacacatgacttcaaaaccatattaaacaaggtaacattactctttattggatccagttttttcagctgccttctatctccaatctgctccaagaaacactcgcaggtctcacacaaaacatcagcagcaagataggatcctacttgtgacttcaccatatgcaagtacaccatggtcagcatatcaacatcaggaagcttgccgctctccaatatgatcctcaccactgtggaggctggaatcggcatctgatctctggcaagcgccagagctagcttcatcagcgagccacaattaagaaggttgccattgcattggtaaactgacaagaccatgtcgaatgccctctgaagccatctcctgctagacgcataggacagcgacacgatcatcctgtccaacacccgcggctcaggaaggccatgcagggtcttgtaattggcaaatgcttgcagcacgtcgtcgacattgccgtcatcgagagcagcattgattgtcctcagtagggtctcacgagatggcgcttcccacggcagaatcttggctgcaatcgtgcccatgggaaggtgatgtatggccagagcggattgcctcctccatgacccgtagcaatcagcctaataacaagaaactatatgaactaaaggagaactattttcatttttttttacagattttagtaaaggaaaatatatccatttatcttatactccctctgtttcatattataagttgatttgtttttttcttagtcaaacttctataggtttgactaagtttataaaaaaattagcaacatctacaaaaccaaattagtttcattaaatataacacggaatatatttttataatatatttgttttatattggaaatgttgttatatttttctacaaacttgatc

SEQ ID NO: 35985 - DNA, 11810 bp, Oryza sativa
gaccccccccccccccccgtgcgcctctgtccaactccacgctcccaagcaggtatggtgctgccttcctaaaatctactctctccgtttcatgttaataagtcacaagccactttgatttttctttagttacacttagtttttaaagtttgaccaagtttttagaaaaatataacaacatttccaatataaaacgaatatattatcaaaatatattccgtgttatatttaatgaaactaatttggttgtgtagatgttactaatttttttataaacttgtggattcattgcactaagatgtatctcatccagtcctaggttacaagattttggaccggagggagtataactggtgcacggtaaaaaaaaaaaagcttcttatgcagcatagtaaaatataagtgaatagtaggctatactaatatgcagttttattcatagaacttgagaaggaaagattttctcaaccaaagaaatttacatcaggaacattgacactgaatgttcagacacaaactctagctaatgtagggcaaaggagaggggggcacacggtccgcgcatacctccttgttggcgatctcggacttgtaggggaggacgaagttgacggtgagcttggaggggatggccgccggcgtgggggggcggggctgcatgagcgacatgggcgtggcgggggcctcgatgttgggggccaccttcttccacgcctccgcgaaggcggagtcggtggccgcctcggccggcacctccgccgtcgagagcaccctgctgctgcggccggcggcggcggcggcggcggcgcgggtggtggccaggcggcgggcggcgtggcgcagcatttttctttttcttctttttctctctctctcgtttctcctctcctcgctgcggctgcgggtgggtggaatggggttccagaggtgtgggcgatttggagggcgaggtgatgagtgtggttcagggtttacgaccgatatgcccttccgttccgtttcgagcaccggtgaaattcgaaatttcacgaaatcaagtggaaaaccggtaacttctgaagaaatttcataaaccaaaatttgaatacaaattccctgagtttaccgataatttctcaaaaaccggtcggttttggtgaaatttcgatcgaaatcatcgaaatttcgatcagtaattgggcctatttcatgcaatctggcccatgtaagtgtttttttaattttttattctattctttcatgatgtataaatacacacaatacttcattttttaaaaaaatttatatcccaataggttacatgaatatcatagtatttataagattttatttgattttttttcttttttatcaattcaaatttgaatttggatgaaactcctcgaaatctcagatggtttctactttcgagccttgtcgaaacgtcgaaatttcgcgaaatccgaccggaatcgtaaaccctggtgtggtcagtgggagtggaggcgactttgggctgggccgtttctatatttgggctaggtcgcctgccttcttttcgtattatttaggaataagttcagcagaggtccctcaacttaacagcgagattttttgaggtccctcaacctaaaaccagaaatgttcgctcctaaattcattcaaaccattcatcggagatcctttggcagtatatgtgggtggtttcactaacgtggcatcctagtcagaaaaaaaaattaaaaaaaaatcatggggcccacatgttagctgcatttttttcttctcttttctctcctcctcctctctttcctcttctctctctttgccaacggcgggcggcgatgggtgagcccgcggccggagtaggcggaggggcagtgtcagcgtgcggccagagcaggcagagcggcggtgtctccgggagagcgtggcagcggcagcggcaagcggttggcgagcacggcggcgggcaagtggcggctctgggcgtgggcggtgcgcggctagagcaggcggagcggcggcgtctccgggcgcgggcggagcaaaggggcaggggacgcgggaggcgtggcgggcgaacggcggtgaggaaaaaccatagaaattgtgttgtttgctgcttggaacaacacccctttgagactttgctgcaaagcaaagtgcttttttcccatgagattacaaagtagaataccaagctggagaattcaacaaggttctgttgaatatcaatatcaataagtaaacatttatcttaatcaagtatacaatactaaggcttgtggttttcgttactggtgatgcgacgggaggtatttattggtgatcatttaaatgatatttttattgcagattgtttgggggccatttgacattctattactgagataggggaggcctttttcacgattagatgttgtagatagagttgagtttagtgtatatcaaagctatggcagcattgtacatttcgtatcattctctgctttgcatttttttttatagaaagtgtctacggaagagttattaagatattgcaatttacactacaataattcttgaactttggttgtttgcatgttgagtgtgatatatattgtggaaaatttagaataatctttaggtgattttacatgattagtgtaatataatgtgggaaacgtgccttgcacgtgtaagattactagtccgcagaataaccagtagtcacccacaaacttctgacaaggcattgttccaaaatattttgagggtctgtttggttgttgccgtgtgcaacatgcctccctgagattttgatggaatatgcctggttgagctgtttggttggtgatgtgcctcagaacggataaacttggattatgtcttataagtattaattgtaggtattgaccaaaatttgctaattttatcaatcataacagtaaccactaccgtcacttggctacctgtgattaatatagtttcacctccaacaaacgaacggttcgtcatttcgacttcccaataaggagtaatggataaatcattgaggactgctcagaagccaaacagatgtgcgattcctctcgggaattcacttagtatgatatttgagttagcctatgtccagtaaactcctaagacctttcattcccatccaggagggttgttcctagtataaatgtcccacatgttttatcatttagaagacttttgacaatgagaatatgaaccccttttgtttagctgcgtgctaacaaatttagagagagatctctacccctttgttcttgtggtttccttgtgggattatagaagcggcgttcgacgcctcccaattggtgctcctagtccctttgaggatttttcctcgattgattctaggttgtgttggttggtaacttagtgtggttgggcgaatcctcgatttaggttgccgtgtagagatggtggttagcttcgagttcgatcgtcagattgcactgttatcttggctacttgcagctagttatcttcgtctctttgaggctagttattggttcttgatcctacgccgtgaagatcgggacatcacccctatttgggtcgtatcactcttcctctctctcttacgggtcggcgacagatgatgggtggcgccgcgggacgcgggacgcgcaggtggtggcggcggcgggggacacgaaggtggtggtggcgcgggacacagaggagggagcggcgaacttcgggagggagcgggagggaactctggcgaactccctccggcgcaggagggtctccaccgcgccgtgcatgccgcctacgtgtccgctgtccacgcccgcccactgcttgcccccacctctatccgtccatcccgcgccgccgccgccgcctcgttcatagtgagagagagagatagagagagaagggagagtggaagaggagtatgataggtgggccccatattttttatcaataaaatgtagattggactatcacgcgtacgctatgtaggtcaaaactgctctggattgggtcgaggggggtaaattgtctggtattgaaagttcagggtgaacgatgtctagttttcgggtttaggggggtaattcggtcggccacgatagttggggggggtaattcgtactttttcttattttatattgtctatatttgataagcgtcttctattcttgtatgtaagataagatctcaaagtttcatatctatctatacatagtcttgcttcatataaatattccgtatgcatacatttaggggagcaaatcctatatgttatacaagtatttgatccaaattattcactttcatttaattgggatctttacatttgagcatacatttgagtatatgacacttatggtgttgattaatactcatcatttattcatattcttttatacatgtgatctgttggtcaacaagtgaaggttgacaaccgaatcattcggactaataaatacattgagttgaacaagaaaaataggtcccatgaattggaaaatgtgctgatactcgatagagatcatgacacctaatgatatcaagaataacaaagtgaagttattggaaagtggggtacgaagtggcaagacggtgaaggccaagtgatgctcgccgcgatgaaccatgcggtggtgaaggcaagcaaggagcttggcaccgaaggaccaaatccagtggtgaagggcgagtgacgactatgtctgatggaccgtgcaaggccatttgaagctacaaggagcacgcatcaatctttaaagaatactagaatataccctgcgtgatgttgcgggagcacatggtaatttttagctcaagatgattgtactgcatgtgtggccactactgacatatgaagtgaacatatgtatatactattatagtatatgcacatccataaacataggcaatatttttcttttattttttacatgacataataagttttttgtctagaatgttgagcgattttttatgtataagatagtatttttcctcttggaataaaataagtaagatgacacttgtgaccgatcataggtgtaagttttccttcaacatgcggatcattagtggaatattaagtttcaaaagtataagaagtgcctagcttccacctaaagttgaagcatgattggaatagttcgtgccatgtatatagtgcccaagaattaaatttgtttacttaaatattggtttgtaagattagaaactgtacgcgtcttgttagattttgcttttaacaaatgcacatcatgaccattctctgttctatacaatgattttgtttgagtacagttttttttgccagaacaaacgtgaagaacataataaaatttcaagcaggggaaggccatttttaagaaacgtgaagaacattctctatgaagggcatttgaacgaacaaagatgaatactgcaacaatcacttcaagcagggaaaagaatataataaaatttcaattatttcaagctgttaaatgtattttccccagtcttcttgtgtcttcactgcaaacctgtaacatgacaaaatttactgaaagtgctgagggaaaaactttcgtcagtttgattctaagatggaacatacctgtaagatgtttaattcttccatgttggatttgcaagaccataaggataaactgtggatgaataaccaattaaatctgcaagaacaaagctgattgaatctgagcaaatttgattagaacaaagctgattgaatctgagcaaatctgattacctggaatcctcgatacgggcaggaacacaacggagttgaatactctggatcctcgaataaacgtacaggaatacaatggaacttatacaatcagttgtgaggtccgtcatgaaaaatcaacaaattcccttatcttcagatagaagatacggatatgatacctaacaaaaccaagagatgagagtctaaggcaaaataaaatgtcatacttactgagcgaggaggagaatagggtgtgtttagtacagatgggagatccaccgaaaagaagctgtcgtaagacgacagaccttgttaagattgaatccaattgcacccaataatcctcgagtacagtgaaggctacttattcatgaatttgccaaagagatgataggtcaaattgaaaaggaagcacatacggattgatctttcctgaatgaaaatccacaggaggcacataacaaattcagaaggaaggagtaggtaccacaccatcaaataccttcggtagatatgaaagattcaaaggcatgaaaataaagctacaaaacgatcactgtagtttaaaccaatccaataatatgtacctatgcaatgaagattcatatgaaaccaagcagttcgtggagaacaaccaagaacctacttctgcttctgcttctgtatggactggagaacttcgtcggtaataagcaaaggcccgcaatgatatcgccatggctttaattagaggcgaatgaaattaacgcgttaatggcaatcataagtctgctcttagtgggcggcgaaggtttctcttaggatggggcgaggaaggcgatgcggctagcactgggaggagggaggcgaaacagacctagggagggccgtgcggcgccgatgcgacgggattggcaaagcgcgatgcgagataggaaggggatggggtggggtgcaagaaatgcggcggggaaggtggaaaagtgcgatgcggggagggagggcatgcgatacggcgagagacatgcggtgggggtggcagtagcgtgatgcgggagagggagccaatccggtgcgggagcggcaggcatgtgggctgggctgggccgagtatttgggagccatccatgaataaagaactgaggcaggctaaaagcaacctgatcggttgaagtggagtgatccaacggatggaaatcgatagtgatgtggcaaagcgagagagcaggaaaatagaattagtggggatgacttgtataggtatataggatacggtgaaacggttttagcgttggtatcccttaagacaaagaaaggaagatggtataaaggcattcctattggtataattattttcctatttatatttgagtataagaatatcgtactattaatagggacgcaatgttgttgtgcttgtgtatatctcagtgttcaaaataacctatcctagtgctaccttgagagaaagccaaactttaacctatcctttgagtggttttaaaccttgcttctggttgagttggtagtcttctaagtgagctttccatagagtccaagatcataaaaaagggactcccgagaaaaaagttatggttgttttactctttggtgttttcggaaattccaaaaatgatagaaattctagttttgctctctcgtgttttttggattttgaaaaattccgaaaaagacagaaatctcaggtttgctctctagtgtttttcggatatttttgaaaatgcatttcgaaagttccgaaaaatggaatatttgcctcaaacggctagttttgataggctcgggtatataaacgcctccatcccctccttgagtggctgttgttcttaggcatgaaatagatatatccaaagccaaatatcccatctccaatctccagcctaagtggtagatctttgtgagtaagatttgagaagagaagagagttgggaagagagtttgagagctagtgagcttcactctatactttgagcattggagtacatagcaagtaaattttcgattgtgtttgttactcttggggactaaggtcgccaatgagcaccgaaggttgtggtgtgccacaaaaagtttgtgaaggcttcaatttcgtctctgcaagggaagaaattaagagtgaaatcgaggagtgcatttgtgcaacctcatgtagaaaagggatgaaagagacccggcctttgtggcccctcaacgaagacgtaatccgtggatccaaacttgggaaacaagtcacgcgtctcctctcttggttcgctcgttcttgccttctctcgtgttatgtttgagcttggttttacctgatctatttgtatgcttaattgatatagttggtgaccttatatcttgcttggataccttgtttgtcaccttttgatccatatatattttgtttgttcgagctataagttcatagctagtgttttattctgttattctccaaactttttgattgagaccggaacttacaatcccgtaccggaagtttcaatttgaattgaaagttcccatcattctaatatgctatgaagatatgataatttttaggaatgcctatttacccccccactctaggcgacatcaaagtcctttcacttcagggcaccaaccaaacaccactcagaccaacatcagggattgaggcctttgtgcctagtgtagtcaccttgagagttgagacctgtgggaacgtgccaaagagaagatgatgtcatgcatcatccatggttctttgcttggtttaactttgtggccatgttgtcctatttttgtttactcaacttttactttttgatggcttttgtttcgatttatatagctttaatatgatagtctagtattagttggtctggtttaacctaacatgaattgtaggaaaacattctttaatttcaatattagtattttgggtaaagcaagaaataaaaaggtagtttcgagcgaaatgtagggcatctcaaatgtcgattcacttcaaagtgaggaggggatctaccaaaggtaagattcgattgatttttttttatgtcttcttttgcctctatattgctttttcttgtaaaggactcatcttcctcagttctcctcctcaactcaacctatggtattatgattctcattgctatcttatttctgagatctccctcacattcgattgtgttgttgtggaggcaataaaagatcttcttcaagacttgaatatagtggcagggagctcagtctcaaggctcaaggcacaaaggagctaaattccattagctttggactttgatgaagttttccatagaaaccttgattttctttcactttgaaaaaaatactctatgttagatttgtttccctggacctactaattacttagtgtggagttcagacagtatgtttgatatggtttggaaagttataaagtgttcccaaacagagcatgggtattaccaatgattttgttctaatccaaaccaatcacactaacatttagctctcttctgaaatgcagaattgggaaagtagatggatataaaaaaatacatgattttgacacgaataagaagtacaacaagcgattgcaaaagacagggataaaaaggaaaaagaaaaagagaggaaatgactgtttgattagatcaaatgaatttgaagatagataaatataaagaaaactttacatagggttagacctcatgttgaattttctccaaaacaaacatagaatgaggcattatatatgaattccataagattcaacaatgtctagtcctttgaaatatcaaagggccatttgaaaaaaaaatctatataaatgaaatactacaaaattcctatgcttttcatttaaataaaatgggtgttaattttcaaaataataaataacattttttttggtatcaattgatccaaaatggctctttctaggctttctaaaatgctaaacggtgtttttaaaaaacattatatatagaagtctcttaagaaaatatcaaataaatatatttatcaatttttaatagctaatatttaattaatcatgtgctattgaggagtttcaaatgggtccttaggctgtgtttgagacaagcacaaggaagataaaagtttctcatttttcgcccacacgcttcccgaaccgttaaacggtgcattttcaagtttctatagaaatgttgctttaaaaaaatcctattaatacactttttaagtttgaaatagttagtaagggggtgtttggatgtgactaaaactttttagtccctgtcacatcggatgtttggacactaattagaagtattaaacgtaaactaatgacaaaacccattccataactctggactaattcgcgagaagaatctattgagcctaattaatacatgattagcctatgtgatgctacagtaaatattatctaattatggattaattaggcttaaaatttgtctcgcgaattagctctcatttatgtaattagttttgtaagtagtctatgtttaatactccaaattagtgtccaaacattcgatgtgatagggactaaagtttagtctctggatccaagcaccacctaaatcatgactcatctcgttctttgtaccttcttaatcttcttctttttcaatctccaaaacacattcttataattgagaggataatgataattactactgtttatttcagttctccctctaagtggccaacgagcgggccctataaaagcgactatcagcacgaaccctacaatcattcacctgtttaggggagtttaaaattatgagaagcaactaggtgatagctagcttgtgaggatctagaaaacttagattttttagcttctaatttttagttttgtagattcacagaatctaaataaaaatctgaattgattgggaagtagtagagacgaaagaagctactactactaatttttcaactccagttaaaatgggagcggagctaggtggagcgctctctcaaaagaactagcaaggtagagctaggtttaggcagtgctccacaggtccactccagatccaacttctagagctaaatttagtgtctgtttggtagagctcaaactcctaagtttagctctaggagctgagtttagaatagagttgcagagcagcctaaactccgctccacctctctagttaattttgtgagaatgtttcacccaactgcactctcattttagatgaaactgaatctgtttcgttgagctccagcttcaaaaaggatgaagttggaactagagctatgccacatctctactctctactacttaaaaaaattgaaaacgtttccgttgtccgtaataacagaggtgaaaaaaacattaaaacaaaaaaggaaagtccgattcaatttgacgcagaaaaaaatctataaaaaaagccggtaagaaagggcgataaaaaacaaaaaaccccgtcaagagggtgaaaaaaaaagaagaaggatcgatacaaaatccaatcggacatagaacgtagaggaagagaaaatgaaccgcacaaatcaggattttcgtccgtcttagtagcggacctcctccctccgattcatctatcaatgcacccacaaccaatcccaaaccattgtaaatctaacccaaaaactaaatcccaatcctaatccaatcgaaatcatccaggataggagacgatccaattagagagaagaggtggaaatcataaaataaatcacatcacagaggagtagagagggaggggtgagcggacgcttttgctgctcctcgcccaacctcctcctcgccacctcgccgtcatggaggccccgagccgccgcgccgccggggagccaccgagccgggagctgtcgacctgtgcccctgtgccgctgctaaactagggagatgccgagagggagggaggaagaaggcgacgtcgaggaggctgaggaggcgcggccacgcgttgaggtccggtggcgggaggcagatgtggcaggggtaggggtggtggtgaggaggtgggcagcgctgggggtcgggcgggagtcgtgcgacggtgtggggtggaggtaccgaaggaggaaaaagagccggtggtaagtcggttgggattgtggcaataaggatggatggctaggattgtga

SEQ ID NO: 35986 - DNA, 9183 bp, Oryza sativa
  unsure (1)..(9183): unsure at all n locations
ggcggacgggctcgcctccggggtcgcggcgctcagcttcgaggacccgctcggcgccggcgccggggaggacgggtacgactacggcaagggcgacttcgtcgagcacgcgtgccggtactgcgggatccacaaccccgcgtgcgtcgcgcgctgcaacgtgccgtcctgccgcaagtggttctgcaactcgcgggggaacacgtccggctcccacatcgttaaccacctggtgcgtgtccctgtctttttctcgtgctaattacggtcataacagcttagggtcataacagcttagtttctttcagttttaagatcaatccatcgatcatatgtgaattcggtaggagtttgccgccaacctaagtaggtgacaagtttgtctcgcagatgatgatctcttgtagcttgataacattttttggtggcctatggtgccaaaaaagtgcatttagttcaggatgcggcaatcaactatattgaagagatgaattattgtgattgttgaattgctttcatctgcttaggttaatcaaatttgattgttttgataaattgctcaaccagtcagttctcccctcatttttggtaaaatttatgagcatgctggatggaaattctgaggattagcttgccagctcatacaatgaaaattttcagtagcgaaacgattttttttatttattggcattttagtgtagaatactcatgtttaaaacttgatagcatgctttgtcccataagggcatttatgtcatcaggatgccttgtccactaaaattatttgttcctaattttgttatctgtggtgcaatacaaaaatttatgataaattgcaatcctacatcttttcttttgaaatcaattgtgctacatggcaatttgctatcatgtctgcgggtggttagtagaattcaactttggttcaaaaaatccagggtcttctataggggatttctcaggcgttcctgaattacctatgctattttttgcagaccagcttaggctttacagactacatagaaatttaatggtagaaattattggtgtcacttatttttagcctgttactgctttcgttcagtttatttcatattttatgacttaatttttacaccgctgtgtattttacacaggttagagcaaaacataaggaagtttgcctacacaaggatagtccgttgggtgaaacaattcttgagtgctacaattgtggttgtcggaatgtattccttcttggttttatctcagcaaaggcagagaatgtcgttgttcttctgtgcagagagccctgtttgagtgttaatgcattgaaggatatgaattgggacctcagtcagtggtgtcctcttattgatgacaggtgtttcttatcatggcttgtcaaggttaatgcttcctccatttattattttgggttgtgtgtgcaattgtgcattgagtgttgtcctgttatttgtcttttcacaaatttgcaatcttttgttctaccaggttccctcagaacaggagcagctgagggctcgtcaaattagtgcgcaacaaattaacaaagtggaagagctctggaaaacaaaccctgatgcctctcttgaagatcttgaaaaaccaggtgtcgatgatgagccccaacaagtggctctgaagtatgaagatgcttaccaggtttggaatgttcattggttcatttgggcatttatttcctgagcctgtttttgatatcttgcaccttgattctatactaacacttttaaaacactcaaatcttccatgtttttctatattgtaactaacacaggttttcattttttttttgccagtatcaaaatgtgtttgctccactgataaagcttgaggctgattatgacaaggtactatgttctgataatatttcctgaatgtgctgatagttcttaaaacattttgttccttggaaccagactatgatatatgtatatgtactgaagtttcttgcctcctgttatttttctgtagatgatgaaagagtcacagagcaaggacagcttgaccgtgcggtgggatattggactgaacaagaagcgcatagcctatttcgtgtttccaaaggttagattaagaacttggaagcacaagatctgataacatagggcctggaatcttgtcaaaaccatttttcccttgctccttgtaattatcatggactttttatatcatttaatacacctacactttttatttttctaacatgtggaatcaattttatattttaggaagacaatgaattgagacttgtcccaggagatgagctgcggcttcgatattctggtgattcttcacaccctgcatggcagtctgtgggtcatgtggtatgtgccctagaaacatgttaattgatagctctacaataacaccaacagggtcacttctactttagtgctaatggtaagggcattattccttcagattaaacttacggcacaagaggaggtagcacttgaacttcgtgctagtcaggtatgaggagtatagctctcacttgtttttcttagtaaccttttactgctcccattttccatcataaactttcctgatttcagggagttcctgttgatttgaaccatggattcagtgtggattttgtctggaagagtactagctttgataggatgcagggggcaatgaaaacttttgctgtggatgagacaagtgtcagtgggtgagttagatgcatctatatcgtgtatacttagaatttctggtcctctagtcatatttatattgcttttactatgattactgcttaaggatgaacacacatttctttgcgattgaacaaagtgtttaagtaaaaaatgtatatttttagctattttttaagtttatggttgttggtaccttttttggggatatggttaaaggttgataggaccctgatgaattgggaagaactctcgcaaaatatccctagtctgtatttggattctttgttggataatcacaatcttttcaaatgtctcatgaggaaattcttactcttctgttgcttcaacgtaggtacatataccatcaccttttgggacatgaagttgagcatcaaataatacgtaatacactaccgagacgctttggtgcaccaggactttcaaaacttaatgcttcaccgggatgtttttgtgcttctagaaaaatgggtcgatacattaaattagtggtggttcttatctactccctccatcccaaaatatagctacctttagcattcaaaatttctcccaaaacatagttactttacctactccttcacctcaaccaatcacaaccatctcccatttaatttctccatctacatcctcttcttcaccaatcataatctttccccatttaattccaccaactttcttcatctccgtgcaaaacctattttttttaatctaacttcaggtgttcagctattatgccatagcttcactgaagtagaattaaacactatatgttgatctaatgttctattctgatcttgtggtgcatctattcaggtcttagcagttaaaagtgttctccagaagccaattagtttgattcaaggtccacctggcacagggaaaactgtcacatctgctgcgatcgtgtatcacatggcaaaacaaggccaaggacaggtataagagtgcatggcatttgctctgctggcataatttgatgctattgttaaccttgtctgatttgaaatttcaggtccttgtatgtgctccaagtaatgtagccgttgatcagttggcagagaagataagctctactggtctcaaggtaaacaataatttatggtttattttaagtatcaactgtttcctgtatttttgacttgtctgctatcccgtttgacacagtccattgagtagtaaaaccattttaagatagaagtttcaaattacatgcttggcttctatcgatgttgatactgagctttttttgtatgctcctgtggttcgcaggagtaattttgccatgttgaatatatacgcgttttgaaactgttaaattactagtacatctcatacattctttactatttacatttccagttagtaactgtggttgcatattgcaggttgtcaggctatgtgcaaaatctagggaagctgtttcatctcctgttgagcatttgacacttcattatcaggtacattcttgattcttggctagttgtttacctgtgaaatagccatacgcttgatgatgtcactgatgttcctttatgcataaaacgtaggttcggcaccttgatacatctgaaaagagtgaattgcataagctacagcaactcaaagatgaacaaggtccttaaactctctcggccattctgtttggttgaattagaaaattttcttatattctatttttataggtgaattgtcaagcagtgatgagaaaaagtacaaggcattaaaacgagctactgagagagagatattacaaagtgctgatgtgatttgttgcacttgtgttggtgctggagaccctcgtttagcaaacttccgattccgtcaagtaatactttctttctaatagcagtttaattttgatgtctgctctttattgaggtgatggagtttctttcttctttttttttttatgtcaggttcttattgatgaatctacacaggcaacagagcctgaatgtctcattccattggtgcttggtgtaaagcaggtaacaagtaattaattggtggttttttgttctttccattatgctatatttatactctttctttaggttgttcttgttggagatcattgtcaactgggcccagtcatcatgtgcaaaaaggcagctcgtgcaggattagcacaatcgctctttgaacggcttgttatccttggagtcaagcctttcaggctacaggtaattgttgaatctggtgttctgtttctccacattattaccatggtgtgagtatgcttaccatgccttgtcctgtgacattgatgtcaaaactttggaagcggtggatttaaagcctaactgatacattctttttaagttatcctgagattgctcataaatcatgttacttttgtgaggattctttgaaaaatggtttccccccgtatgtgtatgtcaggtacaatttagtgcaggcattctaatttgaacaaactgtcttgcttaatattcgttgtcatatcattggacaaaactttgaattattaagaatagtacatgttccaacattacttatcactttgcattttctggtttttctttaagccttttttggggatgaatcatcaaatctctgttgttcatcccgatattgtcgttgtttttacacaatcaattcaccaaattatacccaagtaaccattgaaacgagttatatccaagtattttgcgttcgaaaattaacattccttgggaacaaagctaatagttctaacataatcatctgttattacaggtacaatataggatgcacccttgtctttcagacttcccgtccaactgcttctatgaaggcacactgcaaaatggagtaactgtaaacgagagacagacacctgggattgattttccttggcctgttccaaatcggcctatgttcttctacgtgcaggtaccttcttggaccaccaccaattgatctttgttcttctgtacttcctaactgcaaaagctcttcttgcttatttacacaagagactcgtactgattttctgtagatgggacaagaagagatcagtgccagtgggacatcatacctcaatagaactgaagctgcaaatgttgaaaagattgtaactacatttttaaggagtggtgttgtaccaagccaggtatgcagtgatgatccctttttcatctactagtaacattttgcagcacttgattcttttataaaaaaagaaatcacattttgtggaatgtattgtagattggagttatcacaccttatgaaggacaaagggcatatattgtgaattatatgtcaaggaatggctctcttcgccaacaactatacaaagaaattgaggttaaccaccaatcatgtatactgttccgttaaacctaccaaggtgaaagctgccttgtcatataagatttatacttatttcaggtagcaagtgttgattccttccagggaagagaaaaagattacataatcctgtcttgtgttagaagcaatgagcaccaggtaatctttgctgttttacttggtttgcagcataatattcttgacagtatttcacattgacttctagagggcgttatagatgtactctgacctggccttttctatttagtgaaaattctatttatgttttcaaactcattggcaatgacagttgagggtggtaagcctgtctttgtaaattcttatgttaagcatctaggcagtagtttaacttgcagactgttgtatattttgtgcaaggattgaactgtgttgtctgtgcatattctagcttttcctgcttgaagaacaacctttttgtttcgcaaatttgtgttaactgacatgatattttttttttcacctttcagggtattgggtttcttaatgatccacgcaggttaaatgtcgcattaactcgtgctcggtacggtatagttattcttgggaaccctaaagttctaagcaagcagccactctggaatagtttattgacacattataaggtataagctttccttcagtacataacaatgctttgcataccctgttcaggttgcttatttttggggtttatgcccagattgttaggtgttttttgaacaggttatctttcctgacagtagaattgaatgcttgtagtgttgatggaacatgtgtattttctacctgcatgtgttcaaggtcttttacatttgagtatttgacaaacggataagtggttccattccaattgtcctgtttcagtattatttcttgcttctttatataactaaaggtgtgtttgagctggacgtttggctgggctaatttgtttcatgcaaaacgagacggagcatttgcgaatgattttattgattttttttaagaaacttatacaatttttgcaccaaactcagcctaaattttgtaaatctataagcacgtgatgcttggtactatttgagagatattcctgttcattggataagcatatctaatagtagatattgaaagtaaggagctcttctgagtttttgaattttcactcgataatctccatgtgtttaggagcatgagtgtttggtagaaggacctttgaacaacttaaagcagagtatggtgcaatttcaaaagccaaaaaaggtgggtgccttcttccactcttatagatacttgttggaaacattatggttccttttgttttattaaattaacaaagtatatgcttgagtagatctacaatgatcgacgactcttcctgggtggcggtcaaggtgttatgcaaggagctagttttggtgctgcaggcacaaacccagtggcagataagagaagtggtagggggaaaggtagatagttaattttgtttggttctgcttctaagtaacttttggctaattttaccctcttttctcttaacgctcctcttcttttctgaaatgcagggcattcctttgttccatttggcccaccaaatggggctcataaacctggtgtgcacccatctggctatcctttacctcgtatgcctttccctccatttgctggggctcattctcaaccctatgctattccaacccggggatcattgcacggaccgattggagctgttccacctgtgcctcaacctggaaacagaaactttggacctcgtggaaatactggtggccctattggtgggcaccttgctcaccaacagagttctcagcaagctatgggaggcatggggtcagcttttaactttcctggcctggagaatccgagcagtcagccttctggtggaggtccaatgtcccagactggattgatgacacaggtttgtttatttctattaatatatgtcatacaaaaaaaagtacctgtctagtaatatttgccttttgcaattagatgcctgtccaaggtctcagtcaaacattccgcgatgggttttccattggtgggatgtctcaggtactagcaattaatgatgcatgcatgccatttactatcttgttctatccttgatgacaaaatttggttttgttgttttctaggacttctttggagatgatttcaagagccaaggatctcatgtggcatacaacattgctgatttttccactcaggtacccattgtttcaaatgtctcttgtatttctgtgccaattcatttattcagttaaatctgatttgtcaaccaattggaaagtaaattatggcaatgccgtaaagtttaaagtttgcgtttactctggggaagagttttctaatataagttgttcatatataggcttctcaaggaggctatggtgttgactactctcaaggaccccaatctggatatcctgggaattatttgaaccaaaatgcacacccagggtattcccatatgggtgcagcaaatgacattgtctctcaggtctgttctatctcggtcataactattacgaaaagtaactgccttttcaagccttctttatgtgtatgttctgtgagtaaccttttagtgttatccaggatcacatggcccatggttcacatggaatgtttacacaagcgggatacaatgactcttcacaagatgagtcatcacagatgcattttggaatggctggtcctggtcttcagtctcaggtggtttatcctttttcattatctgtttaattgtaactttatctttctcagggagtgtgtaggtaacatgatattttgcagcccatgatgaacccgctctactctcagtcatatgctcattacaacacccaaccgcagtctctccaacctcctccccagtgatcaggaaagcttgtgatataattgctgaagccgcattaagttttggaagtttgatgggttgtatccttggcccacagcagcttggttgtgcctttctgcactgtaatgcagaaacgatggtgcatagacatcagttgcaagtattgggcacaagcatatgttggagcactacatggatatttnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35987 - DNA, 674 bp, Oryza sativa
tcagaaccccagagtccgcacatcctcaaatacaaagcacttccctagttagatgtaggttagacttcccgttccaaaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggat

SEQ ID NO: 35988 - DNA, 6483 bp, Oryza sativa
aatgatctgagaagaaaactgcgagaaaacgttgcttgagtttgcaattaatgttgtatttctgaggcagtgagatatctaggtatacattgccaaagtgtagtaggacttcacaaattgacagaagagaactgaaattttgtataagacctggtcataattcgtgtccattcttgtgaatatttgaagatatctcatccttgaggaagcgtaataggaatggactctgctgcatttggtgccttttgtccttgaaaacttggtttagctatgtactagctagatctaataattagctttctcaaatatgcagtaccaaaatatattggatattttcttcttgtattatttcaagtcattcctctaatggttgtctcgctgctatgctgttcttgcagagctgatgtgctaatctgtcatattaactcaataacatctgcgtgtgcataaattgtgttcaatattctttagaacaaaaaaaaatgtagttattcttgcctggttagagatagtctgaaatatgtaattgggttacagttttttaaattgctggtgaagtggtgataccgtgatatttcttcatcagtggtagtgtctggttatcactgccatgctcttgcatacaagataaactcttctttggtgtatgttatttgtggttgtgacagttgcagctgtcagatactcttttctgctctttattatctgtttatgtatctccagttcgggtatagtctttttctttggaataaaaaatgtaggcacccttttctggttagaggtatgtctgaatatattaagtatcttatagctttttggcaaaagttgcagttttgaattttatggtggtgttaagaaaagtatcaggtctttgtgtctgattcacaccaggccactactattctcttgcataggagtacctatttagcacatgcactttggagttctggatgtcaaatgcctacgttaattgtggttacgacttatgacagttgtagacttgcaccagctgcttacctctttcttttttttaacctgctatgttttcaagtttgtccctggtgatgatgagcttccaaagcgagataatattggtgaaagacagtgaaaatacgaactacatgttcttgccagagtagaagctagtacacttgaagaagatgacttgcccaatgaagatgcccatactgaagggaagcttaacattttcaatccaaaacaacaggaacagaaacatttccatactgaagtgaagaagatgacaatgatgatgacattggaccatcagagtacaaggacattaaaaagcatgactgaaaaactcgagcaaagaacagaaatactcaccgtaagttccattgataaaaacttatgaagattgattgtttccgatcaaggttcttttggcaaggggatggacacaaaaggaaatatagactagcaaggtgggacatcatatgtcgtcctaaagaccaaggggggttaggaattcaagatcttgaaattaagaacaaggctctccttagcaagtggttgcataaactactcactacagatggtgtgtggcaacaaatgctaaggaacaaatatttggggtcacagcctttgtctcaagctcagtggaaagcaagagactcacacttttgggctagtctaatgaaggccaagcttaattttcttaggtttggctccttcaacatcaaagatggctctcaagttcggttttgggaagataaatggttggggaatgcctgtttaagggaacaatatccttgtctctataacgttgttaggcataaacatacaactatttcagaaattttccaaaccagtcctctaagcttttcttggcgcagggaccttactggctttaagttagtggcatggaatcaccttctctcacgcatcgctaatattatattatctcacgaccaagatgagtttaaatggaatctaaccactgatggcagattctcggttaaatatctttatcttgcgttggtgcagaccgatgttcccaatataaacaaaagaatctggaaaatcaaagcccccctaaagattaagatcttcttatggtacttacgtcgtggagtagtcttaacaaaagataatcttattaaaaggaattagagaggaaacaagtcttgttctttctgccacaaagatgaaactattaatcatttgttctttgattgtcgttttgcctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgcttagttctcactggtggagaaacctcaattgtcccagtttacaaccccctatatcccgggttgcaaaccgggacccccaaattctagactaaagatggtatctttagttccggatcaaatttgatcaagtttatagacaaattagttttattaaatttataattgaatattttttcataatatatttgttttggattgaaaatgttaatatttttttctacaaacttggtagcagtttgactttgaccaaaggcaaaacgacttataatctaaaacggagagagtagtttatatgggtttctcattgttttgataccctaccgatggagtagtgcaagtgtagaaatttatggagttaccgaaatttggtagtggtaaggttgtgatagttgcaggagaaaattaacaaaatcgaaaagatacgtagtagataaactcaaaagataggttcgtattacacccattacacccatcaaaagataggttcttttttttttaaaaaaaaacaccttaactatggaactggacattttaaatctcaaccattcaaaccaaccaaattaccttcctaagaataaagtggcattcataattttggcatccaaatgtattagtttttctacttagatttaactactttttatatcttttctaactaagtgccatataagtacgaaaaatatactcgctctgttccaaaataaaataaatggattcctagaatcccaacaaaactttagtagggaggaaatgaccatgcacctggtggtaggtagcaagggataaagtttttttatttgcagatcgggggtatgtaagaaggtaaaaatcaatttattttgggacaaaatttttaaactttaggaactaatttattttcggcttgtttgataacttgagggaaagagattgggagtttacatgagggaattgatgatgagattaagatgggaatttgatttttaatcccaatattttgtttggtagaggtgatggaaattgatagggagtttagttggagattaggtcattaataaaaacggatggctgagatttgcttagacaaagtaaaggaggaattccctcccaattacctgcccctacccaggtattgaaaatgaggtattgaaaaggagggggttccttcctcaattccccatccccatcccaccaaaattcccatgtctcccaccaaataaaacacttaatagcctcatttttctatattcccaatccctcctaaaaactccctccaaccaaacggaccgtttgggatggagtcgaaaacggtcggaaacgatcggaatcggcagcatcttttcagaaacgatgctcgaccggccggtaattgaccatatttatcatttaaactactcagtattgacattaatacggtgtagaaagaattgtgaaaaaacaacatttaaaaatagccaaaaacggtatggtcagaaacggtacctcttatatggaaacgacgctcagtcgatcgggaatttccatgaccgttttcacccctagatagagtataatatttggatcttaaaaccatgaaaccgctgttaaaattgggttttgttgccatttgtgtgtgtgcgcgctcatactttcggaaaaaattttaaaaaataatttgttggctatattgttggtactatgaaacagaggatcgaaatcaaaggtacttgctatactatcaggttctctcatcaagtatcaattaggtttttttctatattttagtaataaaaagttaataaataacaagaagacctctcttttagaaactcaattatattatgtttcatgatttaataatcaatgatatgatattatttaaaaaaatgtaggctagttttttaaaaaaaacaaaattgtaaagtagtagtaaaatcttgagattggtctatattacacccttaaactactggttttgtttttaacaacgaaactagacattttacacccctcaaccaccaaaatcatccaaaataccctcccaaaagtaattttagttttgatagtgtttcttacaattttactaccgattcaacttttctactatatagccaagcccagccaaaagattattatacacacccatataaaatcatgagtaaattgcatattgggctcagtattattaccaaagttttactttgggcaagggtatagcctgcattttcactttggactagagtttctttcctttggttgcacgttgggccacctttctagtcggccggccaggcactgcgtgcatcccaccattgctggcagtggcaggctccaagggcagccattattgttgctgctgcaaggtgtgaggatctcctgcacatgtgtaggaagaggagaagctccgggggacagccatcagggtggtgaggcagaggagctcgtgcacagcggctgggatggcagcaccggcgacgctcgagcttgtggtggagcaaacggagtttaactaaccttgagggcgagggacacgattccttttgcatcatccggtcaggtccattggggattggaggggattatcgcaatagatgtagaattaatcctctccaaatccccctcaatccacttgtgggagggggccttagagggaagcaacagcaggttgcattctcatgcatggaggagtaggagcaagggggcggaccgcagctagaatgatatggagatgaggagctcaagcaggaagccatgggaggctcgtgggagttttgagttccttggccatgaagcgcgagctcgagctagcccagtatctcttcttcgtatcaccaggggacacccggcttggcattctaccccttgtgcaatgctgagcagagcagtgatgtgctcaagcatcgtccctcacttcctccccaagcagtcattggatctagaccacgggcgaggagaacggcagggattggcggcggtggtgatgaattggaagcagagaatgcacggctggagagattgagacatggggtggcctaaattgcaacaaaggcgatatttcctagtataaagtgaaaacattggctcttctcttgtccaaagtgaaatcttggtaataataactggcccaagatgcaattcactctaaaatcattgtcataactaatactaggtgacacctcatgctttgctacaaaa

SEQ ID NO: 35989 - DNA, 1967 bp, Oryza sativa
  unsure (1)..(1967): unsure at all n locations
aaagtgaacatacaaaaaaattgacagcatttatttatacgcatacatccgtcccgattaaatcatttctgtaatatttaacatatatttatccatacatttcgtagcaaagcatgaggtatcacctagcgacaatgattttatacgagtgtctataagcttttggctgggcttggctatagtagaaaagttgaatcggtagcgaaattgtaagaaacactatcaaaactaaaattacttttgggaggtattttggatggttttggtgattgaggggtgtgaaatgtctaatttcgttgttaaaaacaaaaccagtagtttaagggtgtaatatagaccaatctcaagattttactactactttacaattttgtttttttaagaaactagcctacatttttttaaacaatatcatatcatcgattattaaatcatgaaaaacattataattgagtttctaaaagagaggtcttcttgttatttattaaattttattactaaaatatagaaaaaacctaattgatacttgatgagacaacctgatagtatagcaagtacctttgatttcgatcctctgtttcatagtaccaaaaaattattttttaaaaaattttctgaaagtatgaatacacacacacaattggcatcaaaacccaactttaacagtggtttcatggtttttagatccaaatagtatactccatcccaaaataatgtagttcctaaagtttaaaaattttgtcccaaaataaattgatttctatcttattcctatccgctatcctattcctatcttgggccttcttttcatctgcctacgtctcaacactcaggccttcagtttcttttcttcttttttgccccatccctttttaaatgaacaaaaaatttaatgtttatattaaaacataatatagattaataatacgaatctttctaaatatttgtaaatattttgcaaaataaaaacgatttgaaaatgactagcacacgtcgctggttatttaaaaagacaggtgattcctcgcgctttgctgcgggaattactaagcaattctcaatatattttttcgacaatcaagttaggagtaaaaaggaaaaaataatgaaacatcagggcttatcagtacttattaaaaaaacaaatgatactcgtactttaatgtgaaacatattaataagtatacattaaatattataaatttattagaatattatgcaaatgatgtgagggatgattgttggatatgcttgcatgaggttaaatatgtaattattgctagtgggtgatgatgtggcatggttgtatcttgagttttagacttagtgggctataactttatataaagtatagatagggagtatttgttattatttattagttacccatacattagaacattaaatttaaaaggaattgtgcgacaattctaggttatgagtggtaatgctcgtttctagggcaagacaatctcaacgatccacttccgaaagtatgttttgctctccgttgatttttcggattttctgaagatggctctcaaaaattccgaaatcacaaaaattcaaaattcggtactgatgtgttttcagatatgttcaaaatgaaattttgtaatttctgaaattcattttagccctgtttttggagatttatatattttcaaaaatgatttttggaatttttgaaaaatggaatctttggttccaacgggtagatctaaggttgtggttataaatagtttcctccactctcaagttttggctactgctccattgaatatttcatgccattgacttacattgatttgagatccattttgagccttgttttctcactttccctctcctccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35990 - DNA, 1122 bp, Oryza sativa
tttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 35991 - DNA, 817 bp, Oryza sativa
aagtacttttggttctacagttttggaggtagctctgtatttccatcatctcaatagaaggcttcggttagattggcacactttaaatcatttcaagcttacatgttatcacaagatttaagaaattgtagaaactaagaaagaagccaaccaaatataaaattattaaagaaaggtggaaaaaaattaaaaaaatgtatacagaccttatttttattggattttaccactgctaccaggaccttgctaggtttggttacttgtctatttctgagaacatcatcatcaaaatcatccaacatttgcaggtatctcataattattaacaaaaaggcatttaaaagctaaaaccatccaaatatattaaatgtgtcgtttaaaagagaaagagatggcacaactaatgactcacctatgaggagttgtcctggtgtttgaaaccttctcaggcttcaactgcgtgaaattatagagccctttttcttcaagggttgctcatacttccaacatttcaaggctttgtgagctgatatgctcatcctagaattttaatatttgttcagcttttgtgcatctgcattattttcgaaacaaaatgctaaaatatatcaaaagtgttgtttcagttcaaccttgtcctttcttttgtcaatttcattctaagccttattagaatggtcattctttgtcaattcagcaacttccgcacgctgaataaaaattatcatgatgagttaccagaatacttcaattatcatgtttgtactttatagtaaagtaaagaagaacagatcctatttttatcttatcccgtact

SEQ ID NO: 35992 - DNA, 19768 bp, Oryza sativa
aattaaagaaacaaggctgttgtataaaagaaaacaaacccgttatacaatactctacatctgtacaagatgagcaattacaggatgatccggcacaaacaatgcctcagcttccataaggaggtagtagaaggttatatagcctaagaataagccagtaggcaagctcgtttcacttccaaaggctgcattttacccttatggttgcttgcccaactatcacctgcagaacagagtttattttaacaagggcaagcagtttatatcatataagataggcaaaagaaattatttttccttctcctttagcaagctttgccacaatcttgagaagatcagaaaaataaaacaactcctggtctcccacagcaagcagagtcagggtgcattacacttaatatccccattagctagtgctagaagagtcgctatcacctagtcagtgtgaagtgtgactgaactgataatgcggcacaatgatgtcaaggcaatggcacaagaaaatcaaacgatatttatttaaacaactcaaagtatataactaattataggtttgctgctttaactataactcaagaaaatcaaccgatgctttaattgtaggttcgctgccaattttattataactaaaacccccctacaattctaacaaaactatgtaagataaacgttagaaaatggaaagctctttcatgaaaaccacttgcatggcctaatgtttgtgtcatagcatgaactatgctaattactatcaatacgaaggccggtgcaagtgtcaattttccaatgcagtcactagaacatacttaaacaaaaggctatctaccaacttgatgaaatcatagagaacgaaaaatatcagccaattcagttcagccataaggttttctattgctaatgagatgacattcactagtattcaagtcaataacgaaaatgtgcttaggtaacactaaacattaaaaatgaatgggttttttttttcggaatggtagcccagtctgatatgatatctcttctccagtgccttgaaaatagcatgaaattgcacgagttcaagttcaaaaccatgttacccaaaacaatagagcatgcatgataacttggtttcctagaagattgccatttgccaaacacattatatcacatataacttgtatggattcctttaacacatcaaggaacaacagaagatcaccaatagtcaccgcatgagcactttccatcctcaaaatgatggaagcgatttatatccctcacgatgatttctcgtttaactattttagatatcaccgtaaatgcagtatgacaatccaaacaggaacgcaaattcttcaatatccttattggatgcccaggaggtgtcatcacaaggccatatgctaaagccagcctctcactatgcacccacagcattcgagtcttttgttccttgtctacgtcgtgcaacactacattaatgtcaggaatataaccttccctactagttttaagattgagccattccagcattgcatttatcacccgcatatctggatggtccactgatcccactgaaaaggcatgaatttcacccttgatctcaacccaactaagaccaggtaccttccttacaccaatattcctcattgatttcctcaaaagggcaacttgatccaaacttccagctgcagcatacatatttgatagtaagacataggttgtctcatcttgtggttcaatctcaagtattttttctgcagaaaatcttcccagagccacattcttatggattatacaagagctaagcaatgcacgccaaaccatagcagatggtgccgaaggaatatctccaatgaattgtagagcatcattcagacggccagctcgtcctagaagcctaacaatgcatgtataatgctccatacttggtttgatgccatgatcaatcctcatagaatcgaacagagataatccatgatttactaatcctgtgctactgcagacggatagcagagcaacaaaagtgatatcattggattccacgttgcttttattcatcctgtcaaaaagttctagagcatctgccgcttgtccatgaagcgcatatcctgagattattgcattccatgaaattatatcgcgttccattaaatgttgaaataccttgagagcatccctaatgtatccgcacttagcatatgtatcaataagtgaattgccaattacggtgtcattattaaatgtggacttctcaattgaacaatgaatctgaccagcatgtcttattgatgctgtgcttgcacaagcccggagcacactcgagtatgtaacttgagtgcaaggcatctgagcagcttgcatctcacagaatacactcaatgcttcttctcccaaaccagactgactgaagccaacaacaattgtgttccagctcacctcattggcatctcgcaatgatgagaagatcttaagtgagctatccatgtcgttgcacttggcatagaaatccattagtgcatttccaacaaaaagatcagactcatggcctatttttatagcatggttatgaatttgctttccgaaatccaactgaaccatgttagtacatgcttgcagaacactagaaaggctatattcattgggcagcacagaagaacgcatcaatcggaggaacagttcaaaggcttgttcattctgattgctctgtgcataccgggatatcataaaactcagaagtatcacatcatcatagggaatcatctcaaaagccaaacgtgcatccttaatatccccacatttggcatacatatcaagcaaagcaccaccgacatgaggctccgtgtcattaagggtttttatggcgcaaccatggatgcccttgcctagcacaactgatggcaagcaaactgcagctttgagcacactggttagtgcaaaagggttaggcttacaacccgacaccctcatcttggaaaagacccgaaaggcattctctgggcaatcattttcagaatagcaagaaaccatcgcagtccagacaacagcatccttacgcacaatcccattaaacacatgttccgcatcactgacaagactgcataaggagtaggcatcaatcagccctgaaccaacaaaggcgttgtgatcatggcccagcttccacgcacatgagtgcacacccccggcaagccctgccgcatccatggcaatagctagcttcaacatggtggtgagcacgaactggttcacctcgtgcccctcccaccgcagccttctgaacagaagccgcggcagcctcaaaatcaccgcgctgagcgtgggcctggacgagcgtgacgaaggacaccatgttccgctcaggcattcggtcgaacagcctgcgcgcgctggcaaggggcccgagcttcccgtacatattgagcaggacgttggcgcagaagaggtccaggcgccccacccctccgcggcgcactacatggccgtgcacggcgcggccgccgcgggcgtcgccacgagcgatgcagccctgcaactgcctggcgcacgcgaaggagtccaccccggggacggaggggaggatcgcgagcgaggtgagctcgtcctccagccactgtagcgctgctgcataggctgcgaacccacggcggtgtggggcaactgggcaggacaaggtggggaggaggaggccgcggttcagtggccggagcatccatccgcccagtcgcatcacagccttagcttctacgagaagctgaacctctcgggcttatatctttggcaaatggcggccccaatgttcaccgagagagagagagagagagagagagagagagagagagagagagagagagagttgaatacttgaatccattgccattgggggatcccagtttcaggaggcgcgggcgcgagaaaggagggaggaggcagtagcgcggaggtggcgctggcggagggaggaagggagaagtggggcgatcggcgaacccggatgcttgagggcaagacggcggcggcggcggcggcggcggcggcgagagacgagagccagtgagcggtgagggagaaccggagaagatgttcccgggctggggttggcgcctgccttggaggctttgatgcatgggcttgtttggtaaattgagacgaggattgggagttttttatgaggaaattgatcgtatgattgttacgaaaatttatttttcaatcttaatcttgtatttttggtagaaggtagaaataatattgagtttagactatgtatttttaaataaaaatatagtgctaagatttatttagatagggtagaggatgaaatcctttccaactcaccattatccaggtcaagaggagatccctcctaaaatctcccctctaccaaacgcattcacccttagcctttgatatattaggtttttatcaaaatattattctcaaatggtgtgtttatcactataatatcatttcagacaaaactacctataaactccctattttaaagctaccttctcactgatcatgatggcatgatttggtgacaagcgaacggcaccacccaacacccacatcccgtattgtgagcgagacagatgacagatgcgctacaaacaacttcagcccactcgaccccttcatttttatttaaacaacttcacacctcccccctccaccacccgtctcagctccacgttattttctctatcaatccccgtctcccaccctgaccatcatgtcggggctcgaggactagattacgtcacatccaatcatacttctttttttttggacaaacggaatatttggttgaaaatgtttattttcatgtattggaatcatagtcctataaaaacaatttgtgtataaaatttgaatcctaaaatttgcttatatttgggaacatagaggatataaatttcacaataaattggatctctaatcttccaaatcttgaatcataggttcacaatccaagggcccagatcttatccccaatccctatgcaaaccctccatattccattcgccgtctcacatctcattatctcatagcccatcacagctatttatatcttaactagtgaaaagtgacatccaaagtggactgagaatgagccacattatttggtaaatattagccattgaacttactacaagacaaaaaagagtgaatgaatcttagaccattggattaaatgatggcaaaagaacacattcaagagacttcaggagatgaagctactagaagtggaaagaaagaaatgaaggaagaaaaaaggcaccctcattcccttaactaaatattcattagtcaagattgagctattcagggcatattcaaaatgtatgttcatgtgattatttttgtttctagcaatttgttgttaatgtatttgagaaaaaaaattgctactgagacatgcatattccttccaataatgagtcatggtcacctgaatataggcttaatgatttttcacacaaatttaaaaatagaaattaaactaatccttaaaaacctacaaaatatatgacaatgagtcacaaaagggtacgcactaatagaaaataagtgaagaataaagggtgatacatatgtctcatacctattaaaatttacaataaatattaagccatctactttaccaacataatactatgactcatcctgacccaatattttactagcaacaagaaaaacaacagattgattatattttactagcaacaagaaaaacaacagattgattgacactcacgtatcacgtaacaagagtcgcgcaaatgtgtgacaacataagctagtatatatgatgtaagattctaatgaagaccctacaggatgaaccttatacaggaatagttatcattagtttatgacctagttagaattagtttgtgaccttgataaattaacctcaggaaattagcagcagttcaagtggcatcagtagttcagatttaagcctgaaagaccacatagcagcatgtcccattaaaagaatcaaatcttatctaatataccgaattcaaggtaaaaaatcaagcatatgattgggccacgtggctccctaagattttagggtttgctcctttgaaaaccagccacgtgtcccgtgagattcagctagagcgtcgattgtgcaattgtctcatctcttctattaatctaaagctagccattcttctagcgtttcattggtccacgtggcatgtttcattcgtccagccctctcgattagtccggacactggaccgtgaaaaagaaaaagaaaaagaaaagaaaagccattggttcattcactggctgtcaatggatggcaacgggtcgggttgggcacgggtagagcaaaaccatgcccgaccccatgcccgtcgtcgcccgcccaaaccctacccactagggttagcaggcaaaactctgtacccgtacccatgcgggcacgggtatgcccagcgggtacccaatggatctcacatgaataataactcgaaaaatatataatttaacaaagagaaataaaatcaacaatttatcaaattatcagctatcaacaataatttgaattacgtcacaacttattattagtagttagtatcacaaatgaatcaagagaaaggggtataagaattaagagataagtcgaaattagctaatacatatgaattgggtcgggcatgggttacccacagataaaaaatgaaactcggctgttgctcacgatgtctgcgggtctcgggtaggcgtgcccacaggtaaaaaatcacacccacacccgtgcccattggatcgggtatccgtggatacccgaacccattggcaaaattaccatcccgcctgtcatgggctgtacagcccagtcatgcatgactgcactaggcctggtcatctagcgttgttgctacagcatttgcacgttgcactttaccttctcgggctaattaattagtaataacacaaacaggaccaaacaaaagtaggaaaaaggaaggtagagaaaagtataaataattttgtaaaaaaaatcttcaaaacataaaatattgatatcctgtatttatataaaataaataataatcgggaaaaactaaatatcaaatataaagtgaaagagattggatgagaatttgttcaaatataaactaagaaccatttcttcaaatatgcactttatcattgatactatatgtacgactttttggttaatgaaatcacaacaattttgaggaaacataactttaaattttctaatagagtctagctatttgccaaattattgatcatcattaattacaatcttactttggtttttctcataattctaagacaaacataaaattaaattccattaacatgtccatttgaaagaatttttttcagagttaaacttactcatgtaataatatattactctgcatgtttaatattactggtcattctcacatttcaaattattatttttagatcgtggtcttctatcttcaccttttaaatgccatgtataactgtcaatcaaagttaatattgcttttgaaaacgattataatgtagttaataagcatatcagtgtaatttgccacatctccttgtttgatgtgaaattttgctagagttacaaataatataaaatgagaggtaggcaaattttctatatatattacagatgagccatattacatgctaaattaggtggcacgccaacaggcgtgcagatcttctagttgaaccattaagcagaaatcataggtcttgtaacaaaccatccagagcaatccgtatcggtatggcattaaatcgccattcatagcatgtagcttagttaattagcagtacaacttgtgacacaatcaatagctgaacatttcagtagttagatatagcatgttttcagtaaggcatacggtgataataaccagataaagtccttcaggatcaagctgcaggatgtagagtttcaataatcagcagtgtaacattgtccttcaattaccatggtttcagtacgcacatttagtgtgctttcaattcagtgctgcagttccatatgattgttcagtgagcattccatccataagcatataggcattcaaccatatattgaactaattgaccaagaatttgataataatttggattaatctgaccaacataaagtaccgctgagcataatataatattaattatatgagccaataacatgaaatcatactgaattattatggatgtatatcatggaagtcttagtacagagtaattggcagcaaaatcatagaaaacatatttatcagactcatcctggaacctcttagatcatgcaaaaagcaagaacagctcgaataggtgtttcggactcaaccatacaaatactctgcaaaccaaagaaaataagtactagtacattaagtttaccagcccagtctataaagaataagcagtatcctgcaactataaaaacacattactcttcaacttcctttttgatttcttccaaaagttcatccttgtagtcctcaaatgttccatcaaatttgttcacagtgccatcttctacaacccatatctcactcctctgctcatcgtcacacactctagagatcaatctcgagtcatggctaaccaagaccacaccaccagtgaattcatccagtgcatctgccaatgcatcgatactttgcatgtctaggtgatttgttggctcatccagcaggagaatgtggggatgtgacattgatattgaagtgaacacaacacgggccttctgtccaccagataatttaactattggagtgagatggttgtgccctggtaaaccaaattttccgagcttcgcacgtacagcctctgctttgctcattccctcctgatcaggatggagcctgagcaaatactgaactgcattttcctccattgtcagtaagtcaacaaaatgctgtgagtatcgcccaatcctcagcttctgactcctccttacctctcctttggttggggtaagatcaccagcaagtaaattaagaagtgtagattttcctgccccattgggaccaacaattgcaacacgtgttcccatgtcaatgccaacatcaacaccagacagcttgaaatctggcctattagggtagctgaagcccacctcaatgagctgaaggagcggtggtgtgagcaaagttggctctgggaagtggaactcaaccttgtagtcaagccatttctgtggaagatcagctggcttcatgtcgtcgtcatcatttgctacattctttcccttccccttgctcttggcagcctccttattagcctttgatagtgcctgacctttgaccttgtcttgcgctgccttgctcccagtcttctttgctgccttcatctgcttttcaaacacctcaaacttcctattcatctccttcctcttctgttcatacccactctcaaagtcgtcaaaatttccacgataaacatgcagattcttatcatgcaaatgaatgatctcattgcaaactgtgttcaggaagtcgcgatcatgggacacaacaatcagtgttttcttccactgtgagcacaagtattgctccaaccaaagaacagctcggaggtcaagatgattagtcggttcatcaagcagcaacaatgttggctgcatgaacagcgcacgagcaagcgagatgcgcatcctccagccaccactgaacgatttagtggacctggcctgcatagcctgatcaaaccccagcccagcaaggatcttggatgcacgagcccgggcagcatcagaatcccggaggttgagcttctcataaacctcagcaagccgctcattgtcatcagcatcgttagaggcctcgagctttgcctgctcggcacgaagcgctgcgagctcttcatcagcagcaacaacagcctcgagcgctgaacgattgtctccaataatttcctgctccacaagcaggacatcaatgctccggggcaccgggacctgccgccatgacagcagcttcagaagggtggacttgcccatgccgttgggcccgacgaggccatagcgccggccgtgcgagatccggagcgaggcgttcttgagtagctccttcccgcgggcagaaacagagaagttctcgagcacaatatccttgatgttgtcatcggcggcggcggagtcaccctcggaggccccggcggatccagcgacgcgcgcgccaataacgacagagaatgcgtcgcggtcgtcgcggagcgcctcctgcttggccgcctcggcttgcgcggccgccatcgcctcgcgcttgtccttcttcttcgcgtccttctgcgagggcgcgatggcgttgaggtcgacggtggcgcgggccgccttgggcttcgtggccatggcaacgaggtcggcgtcgtcctcctcctcatcggaggggggcaggtcgatgtcgcccatgtaagacgacgcgggcgccttggagggcttgggcttggacgccgccttggatggcttggccttggacgccggcgcgtccatggaggccagaatggcggagaccgacatcggcttgtccttcttgccgccggcggcggaggacgacgaggaagtatctttgcggcccatggaggcggcggcggcggcgtggtggggagctggggaatttagggttagttttgggctcggtcgattagatcgggacggctctgctgtgtttggctccgtcttaactactgtgtttatacttataatactattactataaaaaaaatgcatgtgaatgatcttaaaaaccgacttaaatacggatatttattttcaaaaaaagcaagtaaacttaaaaaccgactcatacacagatgacatataaaaatatcgacaaaaacatctttattttttaaatagcagagacagagatataggttaaaaccaaaacataaatttaaaaccgactcaaatacgaatgacgaacagcagaaacatcttcaatttttataaccgactcaaaaacggatgacggaccgcgaaaatatcttcaatttttataatagtagagatttccccgtacaaattaaagaaattctccttgttttctcggctcgcctcttctatcttctcgcgcgcttgtccttcttcttcccgtctgctttctgttggcaacttttttggtcaagtagataagcatgatcgcaacacctaaacgtcttgcggtgatttgtagagtcgccaaccaccccaaaccagcaaaatctagatcaagttgggttttgatagattaaaccggatagcggagccgatttagataaaacggtgaataactacatgtctcgtgggcaaacagaaggtttacgggacaaacctacaaaggatttcgcactctcgcaatgaaggcgaatgatttacggcgtaaatcaataaagatggacgaattaaagtagagctaagtgaaaagcagaaagcgatattgaaaaagcgattcgattgattgatcgttgtgtgatacattgtttgaaccgaccttatccattaaataggggttggtcttgccctctacaggccctcctccatgtctaactaggggtagaaaacaaaaaaagaacccaaaacatagccccctgagcaaggaatctcgagacccgacaaaaacggagtctgacttggactctgctggtcagaccggccctctggccacagtctgagtggtccatacatggcggttagatcggcccttctggaggaaaccggtagattcccaaatcttggcaatttttcctatttcgcctctaggtgccaaatttgagtgtaaacacattctttgtcaaaagcaatattgatagataagatcaaaccgaaaaaatataagatttaagttgataaatatagatttaactatgattatacaagtttgagtataagccgatgtaactcagaagatgccatgagataatataatttgaaccaatcggtcaaaactaataatataatgtgatgtaaataggatggttaaaacatccattggctgaagatccaatgtaaatgttgtcgaaacgacaaccgcatacgtcgaaagacgtggttactcaacagtggttggaaagaaacgaagtgtattaattttagaattttttacttcgggatccccttattacatggccctaggggactatttatagccccattataggttcttactactagggtttaggttatacaggggaatttacatggttacccttacgaaagggacatttacagggggtacataatgttatggaggttcatgggcccctgatgggccgtcgggcgaccgccggccctatagcccctaggcttgatgggccggaaaggcttcttcggccctcgcgggggcgaacttgccatggcgaaatcgtcttccttcggcagatactcttcgccttgcacccttcgcctgggacgcctctggctcgacaaggtactcgcacgacccctcgtctcgcgccgttcttgctccatagtctttgccacgggtttcggcagatttggtcgaagggcctcatgccatccgccaacagtaaataaattaaagtgtatatcaactaagtaatcattatatctgatagctaacccacaataaagacaactcatcggctaacagtccgatgaaacgttgcatgaaaacctatcggcttagtagaaatagacttattagtagcaatctaacagatcgagcctaactaagatattttaagattgacgataacaagaaaaaaatatttagccaatagatatatatacaaacatgattgatacatcgatctatctaaaacggcaatacgattagaaaaacatcaacttagtcaaaatatcggacctaagtgagaaagtcctaactaagccgataccactctaaatagcaatgcagttaaagatataatcaatatatcagatagacaatgcttgcgtcaacctgaataaaatattggacttaaacgagaaagttgtagccaaagttaaatagtataggaagaggagattatttcctcgcgggaagttgacgaaacttacttcctcgtgggagatcgaacttaacaaatgcaaacctgctcaaaactaagaactcgccggaataaaagttggcaatgtaccgaaagtaatgtattgatatgtggaaatagattacaaagtctacgggtgtacatatttatacccttaggttgatattagtcctaatcggacaagatacaagtttcctaaagataaaagaaaagatataagtcctgatcggttgattgacttctttccttaactgaatcctctaaacaaccgtatcaaattttggtgttaacagcttgacgatgactcaacaaagaacgacaagcgatgctcacgggcaaagcaccatgatgacgacgagaacagaggcctacctggcagatcaggatcgatcccactcagggtgaagcgcgatgatcatgcagactatgaatgaaaaaaaaaacaggtggctgggccgtattagatcaacaaatgcagaagatgatgaaatttgaaggacatgaaaaggtcacagattaatcaaaatgggtacaattcagttgtttttcttagaataaatagaagtagccagctaagagctaaactacaaattgaatgcaagtgtttaagcttagcactaatgccaccatgcgcttcagtcacccagctccagtgttcccatctctgaaaaaaaatcgaacagcattggatcaattccaaaaagaatcaggaagacaagctttatcatctagaaaatggagctttaggaaatgactatacataaagttcagaaatcaacccagtactgaaaattggtcttaaaatcaatccagtactaccaggccaagggtatagggtcccaagaaggaggaggctggtcttctccaactctaattggtggacatgcaatctacaaagcagacacaatttacattagtaaaattaaaatatttctaaagtgcaaggccctatatgtgctagtaccaataaaaattgaaataattttcaattgagatcaaaccgagaattttcaattatgttcatattggacatggataggtacaattatgtagatcaaaatgcttgtgcaaaaatcaaatcttgacttctgttttgtcctatactaatcatattcataaatgtataaccagatgagatatacaataaggagcaaaagacgttgaatctgtcaggaacttaccatgttgtgcatctatggtatgtactctaaccatcatactaatctaatttgttggataaagataaaagaggccacgttaactggtgactgcttaaaactcgacaaacagcagtaaccaggtactgcacctcacaattctacctttaataaacattcttccaaacttggtttgcttgaatcatctaagatatgaaatacatagctagcttgcacgatgactttcgaggcagcacatggtgtctcagtgatactggaatcaatcatcctaatcagtatttcagtgaaagtcagaaagttttgaaagcaaaggtgagccaccatagttgatttgcattaatttttgcattttgtcagcatatgatatgttcaaattgacattaatttcattttattccacaaaatcaagcagtgcagagcaaggagcaacctaaattgtgatgctgctcagtccatccaatatgcagaaaatcaggtttaatcaagacactgattaataacctaagaaaggcttattccaacgagaaccatcagtcctctagatccgctagctacatcaaaattgcacaccatctttaaccaagaaccttggaccaagaaccaaaccctaggaaggatagggagaagagaggggaaggaagagagactcaccggtgagaaagtggccagcggaggggacggtcggcggaggggagagcgccgcctccggggagagtgccgcgtcgccgtcgcgccgtcgactctcaatccgcacccgcgccaccgccgctgctttcccctatgcgttgatagtttcctcctgtgcgcgagggtttcttccacgcctcttgggtcgatgattttttcccggaccggggtgagggggaaaggccgggatgggccgggacagaatccaaactgggcttaaccgaacgcacactttcttgtaggccgggatttaatacccaccggggagaataagttcatctgaggtcccttaacttgtcaacaaatccgaatttggtccttcaaccgaaaaaccagatacaataggttcctcaactatcaaaaccaatgcaaatgaggtcctcggcggtttggatagcggttttaactgacgtgacgtgtcgcttacgtggctaatttaactatgtcttcatctgacgtagcattgatgtggcgcttacatggcaatacgaagtgggaaaataataatccacatgagacccatatgtcagtgtcacatccaaattaattttaaaaaggtggggcccacgtcatttctactcctcttcttcttcgtcctgctctctccccatctcccctctcctctctccaagcacgatggagagccagcggcggcgctggttttcctgtgtggcggcgtcggccgcgatcccgacgagtagccggaccccggtgtgcagtacgacccgccgctgtcgtcctcgtcgtccccaccaccaccacctcctccccggcgccgtcctacaaccgcccggcggcacacgacgcagcgccgtaccaggcgctctacggcgggccctacgccgtggccaccgcgcacacccccgccgccgccgcggcataccacgcgcaggtgagcccgttccacctccacctcgacaccacccaccctcacccgccggctgccgccgtcctactactccatggaccacaaggagtacgcgtacgggcacgccaccaaggaggtgcacacggtgagcacgccttcttctccgacggcaccgagagggagcaccaccacgccgccgccggacacggccagtggcagttcaagcagctcggcatggagcccaagcagagcaccacgccgctcttcccgggcgccggttatggcaacaccgctgtgtcgccgtacgccattgatctttccaaagaaaatgacgatgagaaagagaggcggcagcagcagcactgcttcctcctgggcgccgacctccggctggagaattcggcgggccacgaccatgcggcggcgacgcagaaacctcaaacctctcggccacttcttcgacgagtggccgcatgagaaggagcagcaagggctcctggatggggctcggacgtgagacacagctgttcatgtccatccccatggccgccaacgacctcccgctaggccgctaccacaatggtacgtactaaccttcgtctccactgatcaaaaccgtgctgatgatccaatttgcttcttgtttggtcttgtgcaatctgcagacgacagcggcgggtcgaccggggtctggctactcgtcgggatcgccgccgacgtagccgcacgggaataccagcgccgctgtcttctcgccatcgcgtggtggtggtggtgctgattccccccggccgctgactctccgtcgtgcctggagagaggagaggggagatggggagagaggaggaagaagaggagtgggaatgacatgcggggctcacgtgggccccaccaattttttattaatttgggtgtgacactaacatgtgggtccacgtggtttattaattttccgattcgaattgccatgtaagcgccatgtcagacggtgaccgagtcaaattagccacgtaagcgcaacgtcagccaaaaccaccatccaaaccgccgagggacctcatctgcacggttttgatagttgagggaccgttgtatctggttttcgggttgaaggacgaaaatcggattcgttgacaaattaagggacctcagatgaacttagtgatccacagggatcgcggcccaatccctgccatttccgggccaaccgaacaaggcctaaggggttggaaatcttcatttactaacaaaatgtgacaccgacatacaaaattgtaaagatttcttccacacatggtgtaagatgaagatggtataagattaaggtgtaagattaaggtggtattaacgtataattgattgagttttaattatttcaaacttgaaaaatatattaatatgatattttagagcaactttcatatataaagttttcgctcgaaatgcaccgtttagttgtttaaaaagcgtgccacgaaaatcttaatcttcatgcaacttttgttggaaaaaagaacgagacttagtttagtcccaccctcttatttctgggtataaaatctgtactacttaagaaaaacatagtggtggtcttgaatcctgatgcaggcagacacacgaaacgtagatcattcgatcatcaaatcgaattaggcagacatacgcttctctccgcaatttcatcgagcgacgcctcccatagcgacacaactcccccctcccttttctccgctatgccacccactccgcctaacgccaatgccagtcgcccagccaccagcgggctgtggtcaccaacccttgccccccgggactactccgccgcgcactccaccctgcatcgcttgccgccgatgaccgtcgccatcgcgccctgccctacctgccgtcgaatcgttgcctcctccgcctgcctgcaggtcaccatagatctccccggcatccccgcaacagcttatgcatgcagttgacgacacggtcacctagatgttggcagcccggggaggtggtgtcgaaacaagaattcggcaataataaaaggggtagcgcatgagacctaaaagtggatggatgcagagacaaggatttagacaggttcaggccctctcgatgagaggtaataccctactcctttttggggatttgaatccgccgggtgtattatagatctgacgatctggttgtgaattatgccccctagagggcctcctgcccatcttatataggatttgggggggggggggtcaggattacaagatagaaaccttaatcaatatggtatcagtttcctaaatatactttacaatattatcaaaccagaactttaggccgttctataatatacaaggaaatgtaataccaaagtcatgatcggttacatatttcatagatataagttatcccctataaccagtcggataaccatgccgtgtgggtatggggtacccataatctccacagtagcccgtgagaccttcacagtcgaaaagataatcttctctcgaaccagattactccaaagccgagtgcatcaatcatctttgccatggtctcccgagtacttttaccaaatctaaagactgtggagggctaaaaattaattaattataaacgtaggtgcatcgactagatgcacctaataggtatagccctcgactatgtggttagttgaacaaacaaaacatatagtcaaggagtaaataatccaaccaaccgagtggttttgataattgtagtaaaccaagtgacttaatattaatatatagcatatgcggtgtgaatccccgaataacatgatccgagtgatataccaactgctttataaaatatgatgcgtgcaacctaaagttgactacatcattgaaaattcacattgcaaaacaactataaaaaagctagtatgctgtgaacaaagaaatttctaaagtattgggcacacaccatgcgcacactgctttaacatatgtgcttaagtccctaaaagacacatggtttcaccatacctagaaatatatggcatatgtggtgtaaaatccgagtaaataaactcataaaggatttactaatcgcccgaaaaacgaccaaaatatatagtcaacctaagccataatattggtcaataagaatgcacacttacgtggcaaaaagcaacgatattgtatccaatcaattgctttataaacccaaacaatgccctgacttagataaaaaagtcagcaaggcagctatataaagctttactgtttggtaccttttaaaatgcattgtaccaactactaaaaagttgagtaagagcggtataaaaggatttttaaagtattgggcacttgatcacgcgcacttttgcctaaccaaaaaatttctaagtccctaaaagaacgtgacaggccacgcctgaaaatatgggctgcagacatattaggcctagacccaaaatatgcctactgatacccttagaatacgatgtgtgtaacgccccgattttcgttcgggattaaaaatcatttaataatccattttctagaaattaaataaaagttaaatcaattcaatcaagtgaaattaatgggggaattaaaattttcccttaaaaatcattggccgagaatattttgtaatattctttgtgccctaaaatactctccggatttttccgcgaatgttcggagctcaagaagtaatcttaaagtcacaaaattcaactaatcaattaaataaaaagaaaaccaaataaaaatccctctcctccctcttgggctcggcccaactccccctccttcctcccgggccagccaccctccttttcccctgaatttttttcgtttttagattttttttaatatttacagaaataatctatcgaccaaaaaaattgcagaaatagcccctgccgccctaatggtgggcggcaagctgacgtggcagacggtgggtcgaccgcgccgtctgccgccgtcggctaaaattgcgattaggcccttgccgcccatacagagggtggcaaggggctaattgcaattttggccgcccataaagagcttgcggccgtact

SEQ ID NO: 35993 - DNA, 19696 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtttgggtcgtagaaacattatatggacttaaacaaggagaattatataacatgaagaaatagtagtacaatttgaacatgatacgactatttgcattgcggttacatagatgatattagattcgaactaggagggaggtagcgcaatagttgaacacaacgacgatgtagtaatgggacaaggaagcatgacagtagaaatttcaatatgccaagttgtccgataatagctaacccctacgtgaggatccctctcctctctgaaaccgcgctttagtaaccctgtattgctctggtagttcaagctgcacaacacggctaggtggagttagaacccttatggtgtctatccattctctgtattgacatctccttggtggttcctgggaggaaagactagatgtaaagcaagcaaagttagtaaatgttgtgagaaaataaggattcatgtaatcaaaatatttttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccacttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacgaagaataaagcgattgcccatacagaatgaataagcatatgcagataataaaatacctcacggtcatagttagggcacctaaaaaagcgccttcctcgaatatcaggattcctcgaagccattagttggcatcgatcactgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggccttactcgttaaggcgacttatataggcgcaaaaaatcgagtgatacccctgacatgtgaacgtggtggggtatggtgggtacgcctgattggcgccgaaagatacatgcatgatcggcgctgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaatgatccggtggcacagcacgggtagcacgagtgtcccgcggaggagtggcctgcgcctggtcctgcgtctacaccggcggtgcgcctcccagttgtgaggggccaatgacgtcctctgtcgagcctgaagcgaagtcgaagtcagtgatgttgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcctgcgtaatagcgaactgggcgaaacctacacatcgacaacgggacccttgtaagctaagacataaaatgtatgtaaattgattgtcgaagtaatgttgtttttttaagtacctgtggggggcacaacagaaggcctgcagaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaatgtgcgcagctggatggggaccagtcggtacgggtggccgctgtacagctgcgtctgcccgagcaacgtcgtctgcacgacaggtgagcactcggagaatcgagcgcatcgactccaccatccgcatgtacgtcgtcaggtgctcctctatgggtactggaatccccgcgcctaaacgttggatcgtcgttgaaccgtcaacgacgacctggttgatgtcgtcgacctacatggttaatttgttcgtaaatattcgtaaaatttgacgaagagagagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccatgacctcctcggttgcgagcaaccagtactcaacaaaagtcgccaacttggcgggccaatcgccagctgagtgctgacccttgcgcgagtacctgcgaattaatgtgtaatattagtgtgaaacgacagatgttacaaattattgtgaacaggcagattttaatgcaacaacgaaaagcatagtgcaagatcttaccggtgaacaacagctgggacggtggtcggaaacggtactggaaagggctgacggaagccgaactgccgtatcacgcggaaaggggcgtgaggctcaacgcagatgtcgaagaccatcggaaccgtagtcatccagtacgcctggtccctggtgtagagtgtggacagacccaacggcgcacgagcctgggtagccgctgcactgtagggtcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcatggtacagagccgccaacaacgcggaaccccagctccactgaggcacctcgcctaccgcggcgtcggcgatgctcctggtgtagtgcacgagtcccttgtcgacggcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtagtgtgccaacggctcgagcgggaggtgcggtgcgcgctgtactagtgcgaaacgtgccgtcagatcgtcctgccaatccacagccgtggtcactggcccaacagcgtctcccgcgagcggtagccccaacaaatacgatacgtcctgtagggtaggggctacctcaccgcacggcaagtgaaaagtgtgcgtctctggcctccatcgatcgaccaaagttgctaggagggacctgtccacagaccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagattacaggctatttaaatatagcaaacgttactaatggtacataacgatgacgtgcaatttaacatatatgtagagttcaataatataacataacattacgtgtcgaagtccgacatacatcggcatacctaaagacgttaggcgccttagtccgacgttacatcacgagacctaaagacatgacatgccgaagtctgacattacacgacgaaacataaacacattgataagttcgaaacgaattacaagcaaatccacatgctgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcagcagcaatgacatgggtggatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctattgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctcttttggttcatgcagaatccactgagaaaatttccgaatctccaattcagtttttctaaccaatgttgcactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctctttgttcttgaattgcttgaagaaattagctcccatatgacgcatgcaccacctactctgtacatgttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcggagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttgccatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactacaaaatgttttaccgcctccttcatatcttctgctctactataaatcactccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccaactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagaggtttgaactggcattagttcccaataaaaaccctcagttgcccgacttactataacattgattgttatgtcacttgtctgtgatctcaagcccttcattaaccatccttttatggaaggtacactcctctcagccggtctatcaattcccctttctgatacaataaaatctgacagatctacctcagttggcccgtaacggacgtttcctggtccatggtaaacttggaatatttgtttgttcgacatatctgtcaacgaaataactagatcatattactctttcatgcaataaacatctacaacgtaatatcttcttttgtaagccaatgcaacggtaatgtattgattccaaactagcagatctacgtagttaccgatatctacaatacgcacttctagattagtacaactaaaaccctaaaaatataatgcatttattcaaacaaaattttaaagaatacacactatttaactcaatagtcacatataggatctatgaatattacctgaaattggcgtctgaatccggtagggcttcgccccttcttctcttctcctcccctctcttcttttattttcactggaattgaggagagaagaatgagggctgggggctgggcagcaggccttttataggcagcgaggcctgccgcccggccagagggcggcaaggggccgcctgcaaaatagctggccccgactggcttttttgcattcgggccccttgccgccccaccagagggcggcaagggttttcctgcaaaaaaccctccctccgtcaccgcccgttcctcccccgtttgccacgtcagcttgccgcctcagaggtgggcggcagggtctatttttgtaatttttttggccgatagattatttctgtaaatatttttttaaaaaaatctaaaaccgaaaaaaaattccttttcccctcctcccttctctttgggccgttggcccggcttgccccctccttcgcgcaagtccgtttcgcctccctcctccttcctcctctccccgagccgccgacaggtgggccccacctgtcggggtcacccccaacctccagcccaggccggcaactgccatggccgcctgagccgcccacgttgccgcccctcccagcgcgcctcccggttcccgcgcgcgtgtgggcgcggtccaccgcacgtcctcccctttatccactttctcccccattttcccccaaaaatcagcgccgttcgagccccactcacccacgtcgccggaacttcatccgccggccgttgccgcccgccacggccacgatctccacctcccggacctataaaaagcatccccggggccccctctcccatttttccccaaatccccaagtcgtcgcgccctccctcgcgctccccgcgccgagcccaggtgccgccactctccggcgaactccagccgcgccgcgccaccgctcccgttcaccccgcactgcgccgtcgccttccccggtaccgcagccgccgtgcgcaccccgtccaccgctccatttcccctctccacctccgaagtgccacagccacgcgcaccacctctttccgccgccgccgccgactccagccacacctcgccgcagtcctagtcgtcggcgcaccacgagacgacctccaccggcttcgccgtctcgagggcaagcccgaccgctactccatttccctaacccctcaccgaaactccacccccactgttaacccgaggccgccgccgttttgccacctccggccgcctactgccgccatccctgtccacctcaggctgtgccaccgccatcactggcttcgcggttgcaagggcaagctcggccacttctccatcttcgcgaatcaccgaagaaactccctcccctctgctcaaggtgagctcggtttcctccgccggactccggccgtctttgccgtcgtcccgcgccacctcccttactctagctcccttctataccttccccaggccctgtcgggcctcggccgcgccgcggtcttcgccgggagtcgccgaagccccgccgagctgtctatccgaggagcccgccgtcgccgttcctcgccgccggccgccttcccgtctccttctcgccatttgtgcgggcacggtgagaactgcctcctcctcctctcccttttgccgccctcctcgcgccgtcctatgccgccgctagtcaccggtggtcgcgccgccgcgcgccatcgctcggtcgactcggctttgcgccgcgctcgtgcactagccgcgccgcgccgccgttctctcgcgtgcgccgcctgccgcccatgtgcgccgccgctccccgcgccgcccgccggtcgccgtcaccagagaccgcgcgctgccgccgcaccatggccggctgggctggtcttggccataccgtgcccagccgtctctcccctcagccgtccgatcggcctcgggtcgatctgggccacccgtgtgtccgcacacgtggccgccacgtcggtgccccgtcaacgtcacgtgtgcgccacgtggtgcacccgtctcgtgcctccgtggacttggtccacggtggaccgcccctttgagtcaccgacaggtggggcccgcttgccggcaccacctatcccctcggtgacgtcataattgattttaattgcgcaataaattcgttaataattatagaaattcatttaaatggttcaaaacttctaaaattcatatctaattcattcgaacttcaaattgagccgttcaacttgcaaaattcatctaaaattgagctctacatgtttgtttactttttatgtactgtttccttggtttttattagagtttttcctcattttgtgtgccagcgagtagattccgtcatttcggaagtccgcgatcgcgaggaaaagagttcggaagattcttttgaagaagcaaggcaagtcacacattccccttgagcatttttatcctaatttacaaatgttttatcgtttgcaaataaaattgcatgttttgctaattacatgggatccgggtattacctatctgctcgcttgtgccatgtttacttgatatctgtcctttgtcaaccttgggtaataaatcaactagctcatgttacttatgtgacctagctagacctatatgcttagccatgcttaattaccactagctcagttgatgggataatgacagtattagacccttttagtatcagaataagctgcgtgctcgagacatctggccatgcttcatagtcgtaattatctaactaaaatgcgactgaatggtgggctgtgggtgcatggttttgctagtcgcacccatggcaattaaggaccggttcgagggatgccctggaagaacttgtcgtacttaccacaagccagcgtaggcaacggctgggcttgtagtgtagctttcctctagctgacgcatccaggcaagggtgggcgtgatggagtttggatgggccctgtgacggcctatgcggcttccggattcacctaggcatgagaggggactgcctgctgccttgcgaggagtgggggtaaaacctgaggtgtggtgcgcttggttagagggggttatgcgaagggtcctgtcgcggcctctatccggtatgtcgtggtggcatgtcggcgcacggaaatgtgtcgtggggctgtgtcttgtgggtacagttgtacacctctggccagagtaaaactattcgaatagccgtgcccgcggtgatgggcggtcgaccagattcaccgtgattagtctcacacttaataaatcgactcaatgcactgtagttcaggtgggttggttgggactgttcaacgtggtgtagcgttgatcagtggagatttaatgttactttaattactcaacagttttactattttgctcagtaaaatgttttacaaccgcctttatgtaaatagccacaaaccgtccttttgttccccttgcacgtctgcatcattggtgtggcttgctgagtacggtggttgtactcagccttgctattattcccccttttcagaagtgtagtgcttctgagctgaagacgaagttagaggatcaaggctcagaccccagttgagttttgcctgtggagtggagctgaagccccgctaggatcgcctttttccgctgctgctgcttttgtttcggtgtgaggacaaagtgcctcttctgtaagtattttacgctttatttacgtttggaactgtttattacttgtcgttttgtgtaccctggctggtcctggatagggatttaatacacaaaatagtctagaaatttgggctaaatttttgggcgtgacgtgtataacatgcctattaatatgctctcgagtgataaatttcccgggtgatgtaaatagaatgcatctcatctgagtagcttatgatctgagtagttatccctcatgggacgcaccaaagtagatgcgaagttgaatcccgactggcgcaagtactcggctgatagccctcatggagaataatgaatagtccagtcgttgagcataagaaatcgactcatgaccatgaattcatgttgcatgtatccagaacaagtccaaattgaaggtatgatacttgtgtttgagctggtaagcccctgagtatatagcttgtcattttgtcgtagtcgaaattatccattgacgatagcatatgcagtcggcatggaaacgagatgaccaacatggggatgacatctcccattagagatgatgaagatatattggtggtagtaaagacagtgacaccaatcaaagatgacgaagtcgcacagctacggaggcgaagaaaccagtcaacaacagtcaggtcagccaacagtgaagatgaaggcgcccagcaatagcgacagagttgtatagccatggcggcggaacaatcagtcggtgacgaggcagccggtgaagaagatgaagaggcctattagtggcaatggcgaaattcaccaatcatgaagatgaagaaaatagtcggcgacggcaaacgcaaccgatggtaatgacgattagcaacaacagagatgatcaactatgatgacgaagtttcccatcaatagcagtagaataggctatgttgaagaggcttgacaggatgttgatgaagatgacgatatcggtgatccagtcaatagcggtgtagcagccaatgataatggcaaagatgctcatcagtgtttgcgtagtaggtaaactgtgaaggtgaaataacaagtcggcaatgacggaagcaaccagaagcgaatatgtgatcacccattagcaacggcggagacgtcagggccgatgaagtagaggtgctggtgatgatgtcaatgacaataatccaccaaactgctgagaagatatcgaagctcgagtagtttccttgatgcgagcgtgtgtataacaaagattgatgcaacgccccttgatttataaagatggcagtagaacttggtgtcatagctgctgcagatgcttcatttggaggaaagtagatgctgttgtcaaactcgtcgaaactgagctgattggttgataaccctaaactctcaaacatgtagattatctctcaaacttgatacttgagaaatttgaagtagaccgtggcatcagctgagagccagaatagtcactcaaaatgttggagttgctgaagtagaaagcttgctctgaagtgatgatgaagataatgactcccggagttgactcgttggctaattaattgattgcttcatcttgatataacaccagtcgaattcgaattttaagggtcttgtatttgtgtagcccccgactctttggttagttgagaaataactaaacatagagtcgagaactgtagcttcttgttgtcgagtagccattgcttgagtgaagatatgtgttgaagatgtccgagtagaaatcttgaaaattggagcaccacttttgtagtataataacacggaatcatatttggtaacgcatgccgagatgttgaggctcttgtagacgtcatggttggtgaagtagaaaatcttgcgaagtagaggcaatagaatttgccggtgctgaagacaatgaagatgaagttgccccataatgatgatagagttacattgccgtgatgacgtagacacaagccggtggcaacaaaagcaaaccggtggcgaagaccagtcggcgacaaaagaagcagatggtgaaaatagagacatccatgagcagcagtataataggccagccatcaaggcggagacaccaatcagcaatggagaaggcaagctggtgatgacaatgatgccattcaatggtgacgaagacgtgcagccgtggaggcgaagaaaccagtcaacgccaaacaaggcggccagcaatgaagacgaatgcgcccagtagttatgacggagttgtgcatccatggcggcgagataatcagtcggcaacaaacgggagcagccggaagtgaagacatagacgcccattaacggtggtgtgacgaaccaaccgtgaaggcgaagacacaccagtcggcggtgacagaggcaagccagcggtgaagatatagatgcccaacaatggtggtgtgaccatccaaccgtgaaggcgagcaaaaccaatcggcagcgacggaggcaagccggtcggtgatgttctgactgatccattcctaaagcgtaggacataagcttaatgccatgaatccatattatgcatatctggatctggatcctgcaaaacaaacatataggatgagtagtatctgatgtaaatacaatacttgagaaaaattcaagtattttaaaatgtttataaatatgtatttctcctcttgtcaattttgatttccccaagcagatgactccttacgtttaaacactttgcccgactagtcatagcccccacgcatcgggaatgagctaaggcacttcctagacatgcatatgagtgacttgagttcgtcattaatggaacaaagtttcacggattagaatttactacgcgggtacttttgcaatggttgagagcagaaaataaattatcttatttctgtgcttttgatttcttccgagtaatacttagcatcttgcattactcggtccatccaacgagcccccggtaggaatcagcccaaaggcaactaaccatcgacaaaccaaacgggaagcatagaaagatagaactccataacttgataggcactttatatttttactcggtttatttcgcaagcaattaagatagatattatgaaaattttttgaaaaaatatgatataacatctgtagcccccaactcactactcaatagagaaccaattgatgtagtgaggtagagaaaagaaaaatatcataaaaaaattgatgacttagctttttggtcttcgccttggtgacggcagaggtggacgatgtggaaacaaattcgtccatcaatagcaatataaacaccagccgtgaaggcagctgaggcaactagcggtgaagatgaagacgcccatcaacggtggtgtgaccatccaaccataaagacgaaggatccaatcgacggcaatgaaggcagtcgtcagggaaagtgaagacgcccatcaacggcggtggaatccgccaaccgtataggtggaaacaccagtcgtcggtgatgacgacagccgacagtgaagacgttgatgcccaacaatggtgatgtgaccatcaaaccgtatagacgaggacaccagtcggctgcgatgaaagcaggccggcggtgaagatgtagatgcccaacaacggtggtgtgaccatccaaccgtataggcaaagataccagtcagcagcggacaaggcggccggtcggtgaagatgatgacgcacatcaacggtgatgtgaccatccaaccgtgtaggcgagggcaccagtcggcatcagcgaaggcgagccggtggtgaaaacgtagaccaaccagccatgtaggcgaggtcactagtcggcagtggtgaaggcaagccggcggtgaagacatcgacgcccaacaacgatggtgtgaccaaccaaccgtgtagtcagagacaccagtcggtggcggacaaggtggccggttgctgaagacatggacaccaacaacggtggtgtgaccaaccaaccgtgttggcggagacactagtcggcggcgacaaggacaggcaggcggtgaaagtgaagacgcccaccaaccaaccgtgtagtcagagacaccagtcggtggcggacaaggtggccggttgctgaagacatggacaccaacaacggtggtgtgaccaaccaaccgtgttggcggagacaccagtcggcggcgacaaggataggcaggcggtgaaagtgaagacgcccatcaacggtggcgatgtccgccaaccgtataggcgaaaacaccagtcggtggcgaccaaggtggttgacggtgaaagcgaagacgcccatcaatgacggcctaataggtcagccgtgaaagcgagggcaccagtcggctgcaatgacggcggccggcggtgaagacaacgtctccatcaaaaatgacggcggagtaaaccaaccgtggaggcaagggcaccagtcggctagtgctgcttttgactcatcgtggccgaggaggaattataccaaacaaatagtttgtgtaagccttggtttttgatcgggctcagccatcgatgatacatgcaaaagtagaaaaaaaaagatcacataaaggaagctttttactaatctcagatgactacatcaagttgatagaaccatactaagaaaacttccggcctttgcataactaggatgcacataggcaaaacacacacgagcccacaaaagactttgtaataagagagggaaagcactaaaatttagggagcaccaatcttcaggctagaccaagcttacaaagttaaattgaaaaggaaaacaccaaaaacttgccagaagctggattcgtggatgattccacgatttgagaggaaaataagtttctgttactagattaaagatcaaaaagatataaccaaataatagaaccggagaggatgtctgacgaggatgtgcatatatacttaattgccattaaacttgtactgcatacatatgcatgtcgccgacttctctgtatgcatgcacgccaatttcttgctagccaaatagatacgggacacaactggaaatatggtcctctcaacgggtgatgatcacgtgtatagcttggcgtcaatcaatcatgttcggcttggaattgcagattggacttgaaactcgccgccgagtggttgtcatcctccctagccgattagacccgaatctgagaggcgaagcttgttggcgactcctgtattttattccatcccctacctggcgcgccaactgtcaaaacaagaattcgtcaataataaaagggggtagcgcacgagacctaaatgtggatggatgcggagacaaggatttagacaggttcaggccctctcgatgagaggtaataccctactcctatttggggatttgaatccgccgggtgtattatagatccgacgatctggttgtgaattatgccccatagagggtctcctgcccaccttatataggacggggggcaggattacaagatagaaaccttaaccaatatagtatcagtttcctaaatctactttacaatattatcaaatcaaaactttaggctgttccataatatataagaaaatgtaatacccaagtcatgatccgttacatatttcatagatataagttatcccctataaccagtcggataaccatgccgtgtgggtatagagtacccataatctccacaggtggaggtgctggtgatcggtggtggctgtggtagagcggaggaggttggaagacgaggttgacgatgttgaccctgtgtgacacttcttcgtcacctgcaactgagccccctagctctgtcgatcccttccgcaccaaaaattggtatcgcactatgccggtgtgcccaatgccaatgcatgtacgccctcctccacagcatcagtaagtctctatccctattatctgttgatcttgtggtgccctcctccatggatttaaatcttgctttgctacagcgcataagtgcataacagagtgttccaatttttgctcctgaaattttttagtggtgattctctcccatgttcatctgattggatctggtggtggcagtacggcactactgatatatgttagacatggatccttatccagccccctcatatgcctaggttgtttcaagatccaatttgcaagaaactttcctagattgctatttaattcatatgctttctcgttatagggatttagctacaaatagctgcaaactgcaatgctcatatatatatatatatatatatatatatacatatatataaactattctacacccggggtatagaatagctattctacacccccctccctccaacccacctcatctccttctaagggctcaaaacccacctcctacctcagtcaaaggctagtccaaggtcccccacatcggtcaaatctcggtcaaacccgccaatgacttcccccaccaccccctctcttcttagctctcgtatcggaacaacgtagtaacgtcttgtttatcgtgcagtaacaccgtgttttacttgcagtaacaaaattaaaattcagtcataatatagtcatgatggatctacttttgataagcactttttttcgaacatcatggtgcaaacggtttttaaaagtagtacatgatatgagagatattgcccttcaaagatttgttcttaaaaacttaactctccacgagcagtaatagtatatcaaaaggtgttactagtgcatgttttgcgttactgcaatcacatcatgtcgttactacaagatgtagtaatgattataagtttcatagtaacatagtgtgttactgcaattacttgataacatcactacaagaatatggggaattggttcggtttactcgtttgttttaacccatatatttttttattcctggtttactacaatttcatcacgatgttactgccaaattaagatgcagtaacgctctatatgtactacagtaataaagtttttttactacagttcttggatagtgttattgcataaacatgcggtaatgtgtaactatcaagtggtaacgtgtatctgctgtgcagtaacacttttacttttgtgcagtaacaagtatatggttagcatctgagactttgaacccatatatttttgttccaattccaggtttacaacaattcaccacaatattactgtcaaaagtgcagtaacgtcatatacatgcacgcagaaacactatattggagggtggagaccggttttcttgagaagaaggaggaagaacgatttcttgaggaggggagtatgtagatgcattttgaagtttaactctccacatgcagttgcactatagcattatggtggaaacggttttaaaaaataatgcatatcttgtgagatattgcttttcaaatattggtattttgaactttaaccctccacatgcagtaacaaaatgtgtaatatgcagtaacaggggcatatacatgcagtaacatggtttgaccaaatgtataaaattgttcaaaatactcctacatcaatcagacctcgctcaaagccaactacagactttacctatggcccacctattcaatcttcatcttgtaaaaatgacataataaaactacaattattgtgcagtaacatagctacttggaagtggtaacatgcacctattatgcagtaacacttctacttttgtgcagtaacaactatatggttagcatgtgaggctttaacccatatatttttgtttcgattcttggtctactacaattttaccacgatgttactgccagaactgcaggaacgtcctatttgttctacagtaacgtggcgtgttactatacttttatgataatgttactactggagcatagtacatgttacgagtttcgtagtaacatatctttgttttttgttttacgatggtagagaaagatattagaattgataatcatactactttcccacaaaattcttgaaataaatagcatcattagatgaattggttagaagaatgtgctttgaactatgaggtcatgggttcaagtctttgaatttagcaatttattttttattttcctagaaaagagaaaaaagaatgttttaaggagaaaaaaaggatcgggaggggggaaggggaagcgagagagaagggatcgggagggagggaggggcggatcgggaggggggagggggaagcgagagagaaggggagagatcaggaggggaaggggggatcgcgagaggga

SEQ ID NO: 35994 - DNA, 9240 bp, Oryza sativa
atatatatatatatatatatatatatatatatatatatatatatatatatatatatatatatatatatatatatatatatatatatatatatatatatatatatatatatatatatatatatatatatatatatatatagtgaaatcatatagtactttgcaacttaactaaatttatagttggttagggaaatcaatactttgcaaattaacttattatgtcaaaaccttcttaaaagcttacctagactaatagaccatatacaaaagttcttaaacaggatcaaaagttgcgcaagcgcgactacgtggctagtgttgttctttagaaatcccaagtaacctttcgagttatttttgcgaggtgaattgacatatcaaattgcacatatctttgaggaaatgctccaatggccctttaatccaggattaaagaaagtactttttaatgcttgagtagaaaccttaattaattgcagtatgaataattcaggttcttcattatcctactccctccgtttcaggttataagacgttcaactgcttcaagtttgaccaagtttgtagaaaacaataataatattttcaactcaacacaaatttattatgaaaatatattctattattgatttaatgaaactaatttggtattataaatattactatatttgtgcataaacttagtcagatttaaagtagtttaactttgaccaaaatcaaaacgtcttataacgtaaaacaaagggagtatataatactctttcttcattttttggaagaatgttgtggcctattctgtttgttattaattattcagtggttcaacaattgttaaatactatacaggctataccgtctttagattaaagttgatgcatctatatgaattgcctaccaattgtttttcatacattttagaggaattgccagatatatgaaccttttgctagcttcctataagtggaatattcaataatcaaactcagataaaacctacagtgaacatgacatagcaacacaatatttattgcataaattatgccaagttactcttaacatcttgttaggtagcaattgggttaacatatctctgcactactggtatttgcatggctttccttggaagatgaggaaagtgatgatgcggtgtgtagaaccaagcgtggtgaaggatgtggaggacacagtcaagttccttgtttccaggtgaggtctaataggatattttcaactgaacattcatccagaattattggaggaacctcactgaaacgctgataattaagaacttcatgtaaaaaaaagaatttgagggaaataatcttccattttgctgtgcaaaaatgtaagctttttattctggtaagcatggtttgtgtgttagtgatatgccctagaggcaatcatagagataattgtatcacacactatgtttacatatttatccgacttcattccttgaaatagataaactcattattggttaatgaatatgtgattctttcatgagactctttatgttgtgtgttgctatttctaaaggatccctgatcaaatatcatatgtggaacaaatatgatgattagcatatgtattaattgatgatcatgtctcatggatcatggtatagagataccaaattaataatgtggacacatgttagtgaacatgttgttggatagacccaacatgagacactgcaaaagccgtatgtgttgtgtcatcagtgatcttatttagtgttggtgttgaatccttagacctgagattatgatggttcccaacatgtgtagtagcttacttaaggactgctaaacgctactccgtaattgggtagttataaaagtagttttcgggtatgctatgaaacatgtagtgggatatgaataattaagatgggatttgcccctcctatggagagatatctctaggcccctcggtgttgtagattatagaagtgcatggccatgctaaaggtgattgaggagacaattacaagttatataatctatcaacaggttcgagtgaatgattgagctattagaggatggcacatatctagccttgagcttaatcgatatcgtgaggcaaaggggttcatacaagtatacactagaggttcagccgatatgatctttgtgtatgcccagtgggtaaatacgttctgctaggggccgttgttgacacgtggacagaaaaggagttttcgggttacagccgagtgtacatgaacctacagggtcgcacgcttaatgggccggaataaggggattggatggagatccaatatgagcttaattcggatagggatccgaataggagtcctacgggccttggaggctcgagtgatggatcctatatattcgtgaggggtgtgaccgacgaaagtattacatcacatgagaaaccctagccgtcacttccctccccgagcaaaaccctagccacgcgcgggtgctagcacatctgtgcgtggcgttccgtccctgtacgtgtggataccagtagaggcgccgctggtttgcagtgctgatcgacgtgggagtacggcgagaagaacgcacggggaggagaaggtcgagccggtgcaatcaactacttcctctacatcgacacgtgctacttcgcgagagttccttcgacttctcagtgtcttcttccgcagcgcgtcgagtgataacgatctatgatctaatacttgcatggttcctggtttacgcgatagaaaattttgatttatgctatcgtagcctacgcgtaacccaacattgtgcactaaggaaagagttggaaaatatcgtgtgcagcattttgtgcgtatgcaagtagttgaagaattccaccaagttctgctattgtgctattgtacagtaactattgtgctattgtacagtaactatagaagaatggaacttagttcaaatttaggggatatatgctaataaaagtacaagggaatgatgtgcattcaatttgatatagttcatatgaatttcactttcttgaaaatattgagttttggttttacttgttaagccttcatcaaaatgcagaaaacacaggatcaaactaatctaaatcaacatctctccttcaagttttctaatgtcagggtggcctttccttttctgaatgctgtaaatacaactgtttccctctccgatgatctgtttgttttctacatgcttgcataaattgctctgcttgatcaagggaaaatcaccacaaccagcaggtgttgtttgaaaagtttagcctaggttttggtaaattgaaatttaccatgttactatgacatgtacgagaatttaggaatatgaaattatatttggggccaaatatattacaacgatatactatatatcattgtttggttttttgggttttgagacatttgaacttaatttgctaaaatatgtatcttttagcatttgattgtttaattcgcattactaaatatcgatgtagtgttagcatgggcatattagtcttttaagtattcattgggactgtataacaaaaatggttgttttgcctagcacactgtagttgcaagtgatgttttgttgtgcacaagtttcgacgagaaagatgtatcatatttttctcctgtacttttgcataatctctactattttaaaaattaaagatgtttttgccggtactttagtacgtcatccgtgcatttgtcggtttttaagtttgttcgtttttggaaatacatatccgtatttgagttagttttgaagttcattcgcttttggaaatacataatgaatcatctacaatatctcttaaaaaaacttacatgctaacttgaaacgattagactgctaattgcagctcatgattttcttaaaaaaaatccaaacgagttctgatttcaccttaactaaacgtataacaataataaagctaaaattgccttcacccgttgtaatgcacaaattgctttcacccgttgtaacgcacgtgcattttttctagtttaattataaagtcaaaagtcattgtgttcacaaactgttagttatgcatatattattgtttgctattatggtatttacatatacggtcctattttttagagggcttttacagtacctcccactggtactagtagtgtagtaaaaatcaaatccaacccttgattgtaaaatgtgtttttcagttttactctaataaggtggaaggatattttgataatttattactagcctcccacgcgaggcaagacgactgatctcgttctgctcaactccccgttctcaggaccgccgccgcctgatgactgacgtccaccttcgcctctctcctcaactcctcctcgcggctcaagtaaccacgggcacggcggcgccgcccctccacctccctacgcgctcaacagccagcgcccctccttgtgcgaaccgatctacggcggcaatgcccatcctcctctacgcgcgtgcgacgaccgccgcttctccttgcatgaatcctcgctcgtggtctgtggaggcagcgctcctcttctgtgcactgtgctctcaatctcctgcactgcattcgagacgtcaactcagctgccatgccgccagcacctaagtactgaaggaggaactttggccttccatgattcctgcagagaaattcagtcttgcctactccagagaaatgatcgatgtttcaccaagctattttcttatcgtactcgtttctaccatattaactcccatataggacttggaagaactgatacaaggctgttaatttgctttactggaacaattcactgttaagccattggggagaatgttgaacagagaagggagctttgtacttgtagtacagaaactctaatgcccttctctaatatttgtacatcattatagttttttttaaaatacaaacgcagacgttcacaaacaacataacatatagttttcccttcatatgtctacctgctccttttgaatcatttttgttttcgcctcccattctctttctcttctagttatttttattcgggtcacaaaccgatcgagattgcaagtgtctaaagcagcaaatctaatgtaacagaccacactacctacatgtggctcttccatgtggcacatgcatggcatctgaactgattaaattgtactactgaattaacatgttgagcctgaatctgaactacgtaccttcctactgaacgctagatcaaccctggcaactaaccaaaatcatatcatggggaaagaaacaagtcagtacatgtacagcaccggtggttatttgtctcatttttggctaagcacgcccatttctcgaggcagattcctgtggcagcaaagacactagctccaaagaaaggaagagagatctctcactatatttattattatcagaacaagatattatttaacatgttcagaaatatccacaatttacatgcacagctagctccttgcatgtgtcctggtctatcctgtaggtcagttggatcagatccaccagaaagaatgtaccaaacatggtccggcccctgatcttggtctcgttaaggataattatgcatcaatgtctgctgcgtacatgtaatatgtaccatgcgattgcatcattgcgatttgattcttttctacgctccagttgtacccacaagtggatctatatatgtatgatcgatacgtctctgtcaaggagcgctgatccattttatcatgtagcccatgcaactagctacaacctagtgatcgatgagattgttttgtgttccatggtcggctatgcgatactgttagattagattctttcccccgtgctctacagagcatgtaatttaaggatcaactacagctgcaaacttcatgggaactatggctgctatttgtgcaacaacatgatatctgcactgtattatacctaactgtgtttttctatgataagagctacgaaaaatcatactaaccattaatgtatacattttattaataaattacagcctaaaaaacaagtgattatatatacttttttttatccttctaattaaatttaatcaagaatgttaatcttgccaaaaggtgaaagaaacgcccattcagaaattgggggacctatttgtcaatttatattcaaatgttaacaaatttagtccaaattcaattctattcaaactaaatttgaaaaaaaaatgaacttgaaacaaggttgtattttcaagtctcaaattgttatatgtgaaagaaaaattaagagtaaatttcccattgaaactacatgaattttgaccaaattttgtaaaactacagatttaagacgttgtatcacaaaccatagatttaacacaagatttatcacaaaactacatatttaaggccaaatatcacaaaactatagatttagtactatagttatcacaacactatagattttacaatttcaatccttaccaccagtgttatgttagagttataaatgttgtaattttgcacttaacatgcatggtgtaaaacatgtagttttgtgataattttaaaactatatatgtagtttggtgatagttcatcttaaaattgtagttctttgataaaattggttctaaatctgtagttgatacaccttcttaaatatgtagttttgttataattttatcaaagtatatgtagttttatgaaatttactcaaaaattaaatataacttaaaatttcaaagttatttcaaaattttggtttgaaaatggaagtagaatagcatttcaattagtctatttattaaaatttcactcgaaatttgaactagcagatatttttttcttggtattaatagctatgtgtggactaattattgacaataatagactttaaatgataagaaatgaaatcttgtcactcaataggccgggaggtaagagaaatattaagccttggataacatctgtttcctattctagcctccgatatccgaatatgattgaaaaggtacgatgattgatgaatgttcaatggttccatagatgtttttcacccacccatggatacgcaataagccgtcctagcataatggagttcacaaggatttggtgtaactctagaaaattccaaattatgatatacatcaacactacgtgttggcggttttgtcggtttttggttggccaggttttctctagtgatgtagcaatggactaggctgagtggcggggcatcgtgccaatgagcagagggtgggcggctggcagcatgatgacgacggtagcggttgaggaggcaggatttcacagcgcaacaacgaagatggtggcggtggcagggatagtgcttccaatggtgatggccctagcggtggtgactactagttcgggtgcccctacacccaaatcaggctgtgtgacaacaagtgtaaccattgaggcaatagtgctttctagcgtggcatcgtggatggtggtggtgatggctctagggatagtgcctaccagatcgtgggcttccgtgtccagatccagccgtgtggattggaggcaagctcaaaggcagtgatttgacagtacaatgacgaattcaatggcggtgttacgacaatcgaggtgggtgaacccaacatccttttggtgagcaaggtgaggagtggaacgaagagattgacgtaggtgccagcgatagtagcggttagaccgcgacgctagatccagggcctaagtgcccctagatcggatgtgtttgtgccaggatccgttcatgcaacggtcaagggcaatggctcttctctgcctttcgtggatggcgttggcgagcgaaggcactagggggttgggagctatccggtttgtcaaatggatgtggtcgtcagtaggggcagttggacgaagcaggaatcagttgaaggtggatggatcgctaatctatctatctatctatctataataattatctacgagctctcacgttaatcagaaaaaatctgactgttaattagaaggatcgtattatacaaccgtatatctttaatccaacatgtgtttaatataaattattgtaggccaattctaaagcccaaatctgttgtgcgtcatgtacgtatatcttatcgtctccctacgttttttatccaatctccagtcacgctacctacactatacaagttgcttctttcacgataaaagtaggacgtgtctacaacgagaccgttctctgtatggtcataaccagctacctcaatctatctagttgctactagtatactcaaaagtgtatgtatttttttcttcttatagaattttttcttagattactcatccgatttacgatccgattacaccattgtgttcataacaattagatctttataacaagatctcacatgactatatttttatgaaaaaatacaaattacttttataatacatctaaattacttttagattttattaaattacttcttagtcataaaagtaatttaataaagcttaaaattaatttacctatattatagaagtaacttaaaacaaaagtaaagtaacttgttacggcattaaaagaaatctatacattcataatgttattcataatattgtgagttgtttattttataatcatttttagtcagtgacgtaatttgtgcttattaaatttaatttctatatagactcatgtttttacctctataacggatttagttttgatgtcgtgataaagttactttttctttttgttttaagttacttttataatttatgtaaattacttttagactttactaaatttacttttatatgtctaagaagtaatttagtgaaatctaaaagtaatttagatatattataaaaataatttataatttttcatcaaagtataatcatgtgagatcttgttataaagatttaattgttacgaacacaacggcgcaatcggaccacagatcggataagtagtttaagagaaaatttaatttgaagtataggtggttcctatttgcttgaaacacagggataaactactctctctctagcgtaacagagtgcgtcacgtggcttccgattcggtctgttctggccttctcggcaatatcggcatgtggaatagacgactacaccagcgtgtgggatcggacggccctagatgcgtcgcgtgataggaccagatcgagaggcctctcgagatagattttacgataaaagtaataacatatacctgataaatggtatcttagttagtttccaccgttatcatagctggtagaaaccatatgctgttgatggattggcc

SEQ ID NO: 35995 - DNA, 15058 bp, Oryza sativa
  unsure (1)..(15058): unsure at all n locations
ttcttcgggatcccccattacatggccctatgagactatttatagcccctattacaggttcttactactagggttttggttatacaggggaatttacatggttacccttatgaaaagggaaatttacatgggtacatagtgtaattgaggttcatgggctcctgatgggccgtcgggcgatcgtcggcccaatagcccctaggcttgatgggccgaaaaggcttcttcagccctcgcgggggcgagcttgctttggcaaagtcatctccctttggcatatactcttcgcgctgcatccttcgcccaagaggcctctggcttggcagagtacccgtgcgatccctcggctctcgctgtccttgttccatagtcttcgccatggggggacttcgccccgactaactttgacgtctcgggcttgaatccccactcttcgcatagctttcggcagattttggtcgaatggcctcatgccataccgccaacaagctcctcacgggcaagggtgagattggagcttcggccgagaccgtgcaaaccatgtggtatggtgtgtggcgccccctttcgatcgatgctcctgccgaaacctacattgttcctgcaaataaagtttgttgtctgtgtggctggtattgttttgccactcttcgcctcctgcggacggtggtatattatttttatctttcccgggccaaaaggaaacagtaatgggccttccctttgtgggctttttactttgcagctcggtcgatgggaatttaccgttttgcctaccctcgcgacacgtggcgctttattactggtgggtaggcgaaccgttgcttcggtgggctatatattctccccccgttctcttttcaccgccagacttgtcactttcaccgctcgtgctctcttcctccgttcttgctctcacggtaccccttggcccttcagacctttcgctcgctccctttgttcgccactgcacacaccattcaccactgcatatgtccttcgtcatggctccccgcaagcctaaccccttttcggtgaaagggcccgaccccggccggattgacgatgacaccaccgcctatttagggatttctctcatagatgacggcgagcaggagaagttggtcagctctgggacgttagtcgagggacagactttcgccctggggaaagccgttgtaccgaagcccgtcgacaaccggacggtggtgttcgccgtgttttttgaggcggggctccggttttcgtgcaacgcgttgttgccggagatccttcgccttttccaggtggagctcccacagttgagcccgtcggcgctggtccggatcgctatcttcgactaggcgtgttggacttccggttttgagcctagcgccgaactttttggcgccatatttttcgccatcgtgaattcgaagacagtggttacccctgctgggacgaagaaaacagtgttcgggagcgtgaactttaatgttcgccccgagcggtccgatctctggccagtgaatgccgccatgtcgaagtgggaccgccattggatggcgaggtggttttaccacaccatctccttcgaggctggttctaactcagcgaaggccctccggtgccagcgcagggcgattgcgccgaaccaaaaacccaatatcgccgtggacggcgctatggaggcgcggttcgctctgctgcgtaaggtttgctcctgccttagctgtcgcgacttggtggaggaattctgcatgcttcacatctttcccctctctcaatcatggcaagtcgcagttgatcaaggcaaagaggttgatggtttgccgaagttggttctccccgagggaacgaatggtaagagtgctctttcactacgcactcctgcgctttgctattttgatttgttcgacgcttgatgtggctacacccgttatttttgcagtgttgaccctcgaccaggctgacgccgaagcccgtaggatgatcggcgatgtgtcagtcgtcgagtatagccagctgctgatgtgacaagcagctggccgagcgaaccgggtttacaacggcgaattgcctccccgggcgaacccccacaaggcggacgacgatgcaggaccttcgcgaaagcgaacgcgcgggcaagtgaagcttgtccctaggaagcgaagggttcctgcttcctccgattccgacgccgacgatgaggaggacgtcgaagagcgtgacggcgaggaggaaggagaggaagaagaggagacggaggtcgtggctgacaaggccgcggacgagacggtcgaaaaccgcgtcgacacccctggctacactcctactccaagtccaggtcacaacgagaccggggtggagtcgaacagctccccccttcgtcgaaaggatttggatggggcgaaggcgctaattgcgttttcggcaggcagggcggcgaagggaggtccggtcaaaaagatctccaaaaagaaaggacttgtcgatgtcgctcgtgtcttcaacgatgacgagtcttctgacgagactccgacttcgcccgctagccgcagcctggacctttcaaccgtccccattcttttcctcggcgctggtggggcaggcgatagtgccgccgccggggcttcagcctctgcggaatggatcgtgacagctgcggcgagggtcttcggtagccctctgcgtcagccggttgtttcgccgctagtcaaagcgaaggggaagggtgcggccgtcgaaacatctgcctcggagtattcccttgtggcgccccattttgcccctggcgatttcgagacccgagcagagcttattctctttgttgagggagtaagcaatcttgtcttacctgctagcaccccgagcctattcaccgaattgaatgagttcgatgaagggtgttctgctattagaagcttggcggttcgggtatgctttttctctcttcttgattttcttcttattttttacatgtcacataattaacatttgttctctttacccgttcctaccttgcatccagattcttgcagctcactgttcgacagagcgaaccgtgcgggcccatcttgacggattcaagaaccatcttcgggccaaggatgacgaaataggccgcaagaacttggagatggaggccctcgccaacaccctgaaagaggcgaaagccgaaaacaagcggctccaatccgagttggagaaaggaaaagaagctagggccgaggtcgatcggctcaaggctgaactggagaaagggagagaggccatagctgaggttgatcgtctccaggccgaattgaagaaagaaaaagcccattccgccgtgctgacagattattttaatcttactgagccgaagattgaggctcttcgcctggaggtcagctgtggaggagtcgcagcggttttcgcgggagatggcgaaaactaccgaatccgcgagaatggcgtgccgaacgcttcgcctcgcccttactgacatgggtgcaaagatgcgaggggtccctgccgaagttgcctcggccttcgacttctccgagtggacccagcagaccggtggttcggtttcggactgcgccactgcgtacggcgattgctgtgcgtgcgtatcggcggcctttactacgggccatctacaacagttcggctatgaacacgtcgccgagttccctaactatgcgaagggggactgggagatcagtgcgcagaacatttcgcccgcgctttgtgcgtggctaaaacagatatggcagaaagacggccggtccaccgccaaggcacgccttttggagcaactggcgaaggcagaggcggcagaccggtgcgaagaagaggacgcggcagccgaagggggtggaggcgatgcccaggatcacccagaggtgtgaggccctccgccccttccttagatttttgtagtttcccttcttctttttgtgtttgccgggaatggcgaatgatgtatattcggcaggctgccgctaatcctccctattgtagccgaaaaaagggcccattggatattttgaatatatgactcactcttagccacttttttgtggtcgaagtctttggcgtatttatgattatgcacatttcacattatgcaatacttttttcgcctattctcactatgcaattcgtcttttgccctttttgcactgtctaccagggtgttcgccgaaagttgtgcattcggcccccttctgggagttggcgaaaccaaaacgagaaattctaaaatcaaaggtgtttttgattattattctatgatgaacaattgggcattggagattattggttttgttatttggaatttattcacggagtggttttggagatgattggattcataggtgatcgcaggattcattatttcatgtgaccggtcagactgggctctggtagctggtcggactggcggtatgcgcgcggtcagactggccagcccgtgctctgaccggccgacactgtgttggtttcggtttcgggttgtttgtttggacatccgtgattattttatgattatgacttctagatggatactatacgtatgtaatactgttgtttgctactaatgagtcaagttggagatagcttggtctcggaatatggtttctttgtttgttccatgtgtaggtgactcgatgtctcgggatagtatttgtggtgatggaccgggagtcggcttggggataagacgacgtccgtggtggtcagagatcatgcgggatacttaggctagagttgatgcacgtgattgatggatattccatatggcatacgatggagttattgtatgcgtatgggatgcggagtcaaatttggtatgattggttatgtaaagtttctttcttgtactagagggtttcctaaggtgtttaggactcttagtataagtttggttcgtggctttaggctgcctacctcatgtataaatagagagggagcgtgaggcttccctgtatcgctttggagagcaattgagttgagttttgagttagggtttcgagtttagtcagaatttttgtaaggagtgctgttggtgcactttgtaaacatagagagaatcaataaagtcatcatttactttaagatttcttcgatttgtgtttaccgggtttcggcggtcagaccggcgggagcacggcggtcagaccggcggcggcgacacagcgagcagcagctgatctcggcggtcggaccggagatataatcgcggtcagaccgacggcaaccaggctgtcagaccggcaggacaacttcggtctgaccgcgatccgtcgatttcgagggtaacttttattttcgcttaaagttttcggtttttgggtataccaaccattcaccccccctctagttggcttagttcttgtgattcgatcctacaagtggtttcaaagccttgttttcttctttggatttttatcgatccaaagtttttgccatggctactcctgctaggttttcaactaagcctcatgtttttgatggaacggatttttctcattggtgtagtaggatgtaatcttatattatggctgaagattatgatatttggagaaaagtttctcatccttatgtgattcttgaagctattaatactgctgctgaaaaaactgcttttgaacaaaattgcaaagctcgcaatattcttttgagtggtatttctcgttcagattatgatcgtgttgctcatcttcaaactgctcaggagatttggagtgctttgagtaattttcatcaaggaacaaataatattaaagaacttcgtcgtgatcttttcaaaaaggagtatattaaatttgagatgaaacctggagaagctttggatgactatctttctcggtttaataaaattttgagtgatcgtagatctgttgattcttcttatgatgctaattatccacaatctgagatttctcgccactttttgaatggtcttgacatatctatttgggagatgaaagttacatctattcacgaatctattaacacgtctactttgactttggattcactttatacaaaattgaaaacacatgagatgaatgttctttctcgaaaagttgattctaagtcgagtgctttagtttcctctttggatgttgatgcttcttcatctaagtcttcttttcttgctgtttttaatgccacatccgatgatcaactcgaacaaatcgaggaggaggatttggctttggtttcttatttgaaaaattctttgctaagattttctgatggtaaaaagaacctcaacatgattttggatcaatcagagattagcacacataaccgtggtttaggttttaatccttatgctcacaattttagacatcctcctgttgtgttaggtgttggtgctagaagtggcaagattttggttaaacttgatactaacaaaactgtgcttaaatctgttggtgtcatatctaatatgaatgcatcttcttcaaaatccaatgttgtgcatgcaaaatctcatgttgttgctcatgttgataaatctactagtgctaccaatgtgtctaatcatcgtgaaaaatatacttgttctttttgtggcaaagatggacatattgttggtttttgtttcagattagttcataaacagaaaaaggagagagagagattgcctttgcaaaatcaaagtggcaaaaatctggttttcccttgaggaaaccggtctgaccgcagtgggtcccgcggtcggaccggcgaccggtcagaccggctgaacagcctcggtcagaccgaccaccggtcagaccggctacacaccctcggtcataccggcctcggaggaatttttctgtaaattctaaaattgattttgcacgtggatatatgcctattggatcttctggtcgtgtgcctcagtactgacgcttcgacttctgcttgtgtgtaggctttggtggcaaggaaggagaatgtgtggatcgtggattccggttgttcgcgacacatcaccggtgataaaaattggttctcctccctaaagaaggcagctaagattgaatcgattatctttggtgatgctgctacaagtgccgttctcgctacaggtttggttaaggtaaatgaaaaatttcaatttaagaatgtagctttggttcagcccttaaagcacaatgggctttcagtttcacaaattattgatcaaaatttttgaggttcactttaagaaaactggaagtaaagtttttgattcttgtggtgattctgtgttgattatttctcgctatggaagagtgtttaaagctgattttgaaaatcctatttcacctatgataacatgtttggttgctaagtttgataaagatgtgatgttttggcatcgtagacttggacttgttggttttgatcatcttactaggttaagtggtttggatcttgttcgtggtttgcctaaacttaagaaagatcttgatttggtttgtacaccgtgtcgtcatgctaagatggtttctacttcacatgctcctattgtttctgtgatgacggatgcaccgagacagctattacatatggacactgttggtccagctagagtgcaatctgttggaggaaagtggtatgtgttggttattgttgacgatttttctagatattcttggcttttctttatggcaactaaggacgaagcttttcaacactttcgtggtttgtttcttcgattggagcttgaatttcctggttctttgaaaagaattcgaagtgataatggtggtgagtttaaaaatgcttcgtttgaacaattttgcaatgaaagaggtcttgaacatgaattttcttctcctcatgttcctcaacaaaaaggtgttgttgaaaggaaaaaccgtgttttggttgagatggctagaacgatgttggatgaatataaaacttctagaaaattttgggctgaggcgattaacactgcttgttatatttcaaatcgggttttcttgagatcaaaacttggaaaaacttcttatgaacttcgatttggacatcaacccaaagtttcacatttgcgntgtttttggtgccagtgctttgtcttgaaatctggaaatttggatgagtttgaggcacgttctaccgatggattgtttcttggttaacccgcacatactcgtggctatcgtgacttgttttggagaccaacaaaggttcttttgatgaggctagttcaggtactagacccgatattgcaggtacactctcacaggtttagggggaggatggtcatatttttgaagacgagagcgacgacaacgaccacgacgaggtcagctcggccggtcagactgggtgccaggccggtcggactgccggcacacctccggtcagaccgacccatgaggagcggtcagactggccagggtcgtcgggttcgggtactgttgatgctgttcgagatggtcctccagagattacaacttcgaccagtactgatacagaacgtggatcaacttcagaagtcgctgctcctttgcacatttagcgacgacatccgccggaacaaatcattggtaatataggtgagcggactacaaggtctaaggtaacggctcatgatgtttgtgcaaattctgcttttgttgcttcttttgaacccaaagatgtgtcacatgcattaactgatgaatcgtggattaatgccatgcatgaagaacttgaaaattttgagagaaacaaagtttggactttagttgaaccatgtcacaccctaaaaatcccaaatatataaattgttgtctaaattggaattattagaatttattttaaaagcctagaagagaagatctagttttaattaataaattccaatataaaatggggccagataaaatttcattaaatactttgcttaaaatttcattaaatactttgcttaattctataattgctagatttttctgggatttatttgagctaaggaagtatttttaataaatggaattgcatttcatgaataatttaaattggaaaaggttttaaattttctcttttggctttgggccgaaagtcggcccaaaaccttccctctctctctcctcttcggctcagtcagcccgcgcgcgcgctcggccgctgacaggtgggtcccacctgtcggactcgtcgtcctcctcgcgtcgaaaccctagccgcgccgcgccgccgccgtctccttccaaattcggccacccctttccttttccggtgaaatcaatagaggggaaatgatcttcggaatctcctctaccttttctcttttggaatcgtcggctaaaatcgtttggaaatccgtggattcgagtttgattcgaatcgatctctctcctccgaaccctagactttccttcgcgtcgccggtcgccgtgggccttcgccgccgcctcctaacccctataaattgacccccaagcccgccgctacccgccgccaccctcgccttcgcctctcgtcgccggtagagccctagcgccgtgtagcctagcgccgccatcgccgtcgttcgtccagccgtgcgccgccgccactccggtcgtcatcgtcgctcggggatgtcaccatcgtgatcgccaagccgtcaccaacctcatccgcccctccgtaggtcgccggagcaccgccgtcgtcgtcaggccgaaggtcgccgctgcttcttcctcgacgccatcgccgtccgttgatcttccgccgccgttttggtcaccggtgagttcgccgcgtcgccctctacgtgttggttccctccgttcgcgctgtcatgccatcgttcgccggcgagcatgcatgcccgagccgccgccggtggtggcgtcatcgccgacgtcatcgttgccatctgtcgtaggccgctcgtggaccgatagatctcggccgttcgtttttggatggatcggtctcggccgttcgtttccgtgagccgtcgccgtgcacccggtccatcgcgaaccctagctgctgacgcaataattcccttttccttttcaaaaataattcattattgcgtcataattcaattaaaatccatataagtgttttaatccgatttaatctttaaaaattcataactaattcatcttagctcggatatagttggttgaagtctctaaatttttctaaaattgagatctacatgttaaaaatatccacatgtactgttcatgcttgtttatgtgctgttttggtgattttgctcttttctctttagattccgacgttttcggagagtctgagtttgcaggagaagaatttgaagagtcccaaggctagcaaggcaagtcacacagatcccaaacaaccctttgagcatgttgatcccatttaaagctattgtttctattcaactattgcatttattttcgaatgtcattgggtggaaattaacctattatttgttatggcacttttgttctttgattactttattccttgataccttgggatattgtaacttgactagttgagctttatatattggttcaactagatattagatatgattgcttagccatgcttagaaactttagcacactattgggataacttatgactcactattatttaatgatggcttaatgatagttcacgatggtcaatcgtgattggttaattaattaaattgccaactaaaacctgattaaaggtgggttgtgagcacatggttttgttggtcgttctcatgacaattaaggatcggttcacgagtttcggttgtgagacattaaccgtgccaaccacaagccagcgtgggcaacggctttaccttttgtataacatggttcattgcggggcaccagactaagaagtggcggaggtaagcccacgggggttgctggggagtccatgccttgtttataagggggtgattatgatccaggaacggtgcgctgtggtggattgtgttgtgtgaggggtactgtcacagctcctttccgaggtaccgtggtggtattgaggcacatggtgacatgttgtggggctgtgtcttgtgggtatagtggtacacctctggccagagtaaaactattcgaatagccgtgcccgcggttataggcgggtctaacaatgtctttcgtgattagtctcacacttctcatcataataaaagatgctataattggtaataatttgattagctcctggtttggaatggttaattcctggtttggagatagaactgtgcagccgggatggttgttcagaatggttgggcctatgcaatagggtatgttgtatagcgttggattaatattgtttaattattacttaactgttttaataaattctgaaatgtttattaaatgttgtttatgcaaatgaaaccctactatgccatcctttgttatcctgtgcacttgcatatttgctgcgtggcttgctgagtatgtcatatactcaccttgcaatcattcttcagaggaggagttctacagtgatgctgatggtgtgaaggattaggtgtagccctggtcaagctgcctgtggagtagagtcgtctgcgccgtttatcttatttttccgctgcttagatctttattgattgagaggaactatctacctctgtaatgacattttattcgcttattaattagagtaataattgttctctattattgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcattaagaagaaatttgcagcggaaaataaaatctagcgaagctccggctccactcccacaggcagctcaactggggtataagccaaacgtcttctccttctggatcctttttcttcaactgaggttgattgattattgcaaggatgagcatataacatactcaacaagccacacagcaaatatacaagtgcacaagcataatataggttcatttgcaaaagcagcatttagcaaaacttttaagagaagtaaaaacagtggagtaattaatcagaaattttaatcaacactgaacagcacacccatgctgcacaggcccaaccagctaaacaaattattaccaggtataacatccataattattgtgagaggtgtgggactaatcatgaaaaacattgctcaacccgcccataaccgcgggcacggctattcgaatagttttactctggccagaggtgtaccactgtacccacaagacacagcctcaacatcatgtctaccatgcgtcgcgatagtggaaagtacccgaatagaggctgtgacaataccctctgcacaacacaactcaccacagtgcaccattcctggatcataatcacctcctcaataaccagaggcatggactccccagcgacccccgtgggcttatctccgccacttctcagtctggtgctccgcaatgaaccatgctgtacaaaaggtaaagccgttgcccacgctggcttgtggttggcacgattaatgtttcacaatagtagctcgcgaaccggtccttaattgtcatgagcacaactctcaaaaccatgtgctcacaacccaccattatcaatttttagttggcaagtaattaattaaccaatcacgattaaccatcgtggactatcattaaaccatccttaaataatagtgaataataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcacgacgcactcacgaaccttcgcaacgacggaaacgacaagctaacacgcaaaacgaaaaaaaagaataataaaaaccaaataaacaatacataaaaagtaaacaaacatgtagatcataattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccatgatggcgacctcgccggagattggatggtcggctgcgactttggaggacatgtacacgtagaggacgacgagacgaacccaaaggtactcaccctcgaaccaaacgacgaacgacgacggccggcgacgaggtctagcggcggcgcggcttcggtcgacggcggcgacggggctccggtgaccggcgacagcggggagggagcggccgagcttgcccacacctcggcgcaccttacagcggtgacggcgaccgacggcaacggcggaggcgacggcgcgacacggccgaagttcggccggcggcggcggcgaacttggcggcggcggcggagaggctatggggcacgggagaccacgggagaggggcaaacgaaagaggaagactagggggtcctatttatatccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaacaaaattggaaaaaaggagcaacggggaggcgagattggtgggaggaggcggcggcactgtgcacgggctggagagctcgggctctgtctggaggtagaagaaggagcactgtagcgacagggacgaaaaacagacttctatgcgggctgagaggaagggagagagaaggggaggcaaattagacttttcgtgttgggctggctgaaaacaaagcaaagaaagaaagagaagggggaagctcggctgggccgacttgggctgtacggccgagcacacaaaagagggagatgggctggaaagggcccaagactaggaagaggattattattacttttcgaattaaattaatcaatgaaatgatctttgaattgttaaaaatacttccaatgcccaaataatttcaagaaaaatcctgaaaatacttggactcaaagtacttaacaaaattataattagaccatttaatgattaatttaatatgtgggtaattactgaaatgctctttgtatgattaaaattaggaattgagcttcgaaaaatctgagaaaattccagagagtataattaaccatggagaatttaataaaaattaaatccatccatgctttatatttaggaaattttatttcccacatttaacttcacttgtaaattaaagatcatttaatataaattctaataataatttattaaataatttataaatcctgaaacgaaaatcaggatgtgacaattatcaatttgttattgtgtgcctcggctgattcctggacgagggttcacacatatgtaagcgtttggaattttggatagaaattccgggcgtgacaaaccaccttctggacataatattattggaaccaagtgggttttcaaaaataaacaaaatgatgatggtttgattgtgagaaataaagctagacttgttgctcaaggtttggattttgatgaaacttttgctcctgttgctagaattgaggcaattacacttttgttggcttttgctacttcaaaaggttttaaattgtatcaattggatgtgaaaagtgcttttctaaatggttttatacaggaagaagtttatatcaaataaccaccaggtttggaaaatccagattttcccaaccatgtttttaaattgtctaaagctttgtatgccctgaaacaagctcctagagcatggtatgataggcttaacaactttttgcttgcgaaaggttttacaatgggaaaggttgaaaaaacgctttt

SEQ ID NO: 35996 - DNA, 32663 bp, Oryza sativa
gtagattttgctgagattatgcgcagggaatttgagatgagcatgatgggtgagttatcgtactttttgggattgcaaattaagcaaacacctcaaggtacttttgtgcatcaaacgaagtatatgaaggatcttttgagacggttcaagatggagaactgcaagccaatttcaacaccaattggttctacagctgtgttggatcctgatgaagatggtgaagctgttgatcaaaaggaatatagaaatatgattggatctttgttgtatctaactgcttctaggtcagacatataatttgctgtgtgtttgtgtgcacgctttcaagcttctcctcgtgtttcacatcgtcaagcggtcaagcgaataatgaggtatttgaatcatacacatgagtttggaatttggtattctacttcatcttctatatgcttaagtggatattctgatactgattttggaggttgtagaattgataggaaaagtactagtggaacatgtcattttcttgttacatcattgattgcatggtcttctaggaaacaatctagtgttgctcagtcaactgctgaatctgaatatgttgctgctgctagttgttgttcacagattcttggcttttatctactttgaaagattatggtcttacttttgagaaagtacctctcttttgtgataatactagtgctatcaatattgctaagaatcctgttcaacactcacgcataaagcacattgatattcgttttcactttttgagggatcatgttgagaagggagatgttgaattgcagtttttggacacaaagttacaaattgctgatattttcactaaacctttggattctaatcgctttgcttttcttcgtggtgaattaggtataattcatccttttggtatggtttgagggggattttgtacctcatggttttatcgagcaataatatgacaatgagaaaaattgagaaaagagagctttgtttatacatatggtattttcttgtacatgctagcaatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttgactgttgattcaagcataattgtaaaatctttggttcatggttatactttaatgcatgattgttatattatagatgggtttatattctttttattgcaacacatgacttgatatgctatatgtatgctaaactcttgaacattaatgaacataattcctatgcttgatgaaatcattgtccaaagggggagaagtaatgtgaaaatttttggatttttggagaagcaagatgaatttttggagagttgttgagaagagcatgtttctggttcaattgggaatttcttactttttaaaaacggggagaagttttcttttggatttttgagcacgatgtgtacatttgtacgaagtgtgctttttaccacttttgtttttatttttccaaacaccaaaacattttttatgggtttgccaatgtgttcatcaaggtggagattgtaaaatcaaaggtgtttttgattattattctatgataaacaattgggcattagagattattggttttgttatttggaatttattcacgaagtggttttggagatgattggattcacaggtgatcgcaggattcattatttcatgtgaccggtcagaccgggctctggtagccggtcggaccggcggtatgcgcgcggtcagaccggccagcccgcggtctgaccggccgacactgtgtcgatttcggtttcgggttgtttgtttggatatccgtgattatttcatgattatgacttctagatggatactagatgtatataatactgttgtttgctactaatgagtcaagttggagatagcttggtttcggaatatggtttctttgtttgttccatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgatggagttattgtgtgcgtatgggatgcggagtcaaatttggaaggagtccaaattttgtacgattggttatgtaaagtttctttcttgtactagagggtttcctaaggtgtttaggactcttagtatgagtttggttcgtggctttaggctgcctacctcatgtataaatagagggggagcgtgaggtttccctgtatcgctttggagagcaattgagttgagttttgagttagggtttcgagtttagttgaaatttttgtaaggagtgctgttggtgcactttgtaaacacagagagaatcaataaagtcatcatttactttaagagttcttcgatttgtgtttaccgggtttcggcggtcagaccggcgggagcacggcggtcagaccggcggcggcgacagcgagcagcagctgatctcggcggtcggaccgaagatataatcgcggtcagaccgatggcaaccaggcggtcagaccggcaggacaacttcggtcagaccgcgatccgtcgatttcgagggtaacttttatttccgctaaaagttttcggtttttgggtataccaaccattcacccccctttggttggcttagttcttgtgattcgattctacagaaatttgtggcattgaaggatttaccgaaggtgcgatgcccatttcggcctgtttatcgtgaaatggtgataaacggccgcagctataaggtttttaaggttgccgaatggcttcgggtgcaccccgggcgaaccttagaagactacgatctttgttcattcaagacgtttggaggatatggctcacttttggcgaaaccatcaaaagactgatcggcaggaggcgatctcccagcatcgttacagtctagtctgtgtttcaccctcttctcctcttagggttgtgtatgatattagtagtgatgacgaacctagttcgcctgattattcctaagagagagagaatgtgatcgcgggggcgaagatgtaatttatctgtaagctgggctgtaacgccattgctattttcttgtcacttgtatcattgtaatgggtttgtatttttcgatacatttttatttaaaatcaataaaggtgcgttttatttccttttcgctatttttgcattgtcacttcgcgtgcttttcgttgggtcggaacgtgtcggctcctttgcatatattagcgaaataggttttgacttttcagctttcggcttccgttttcgatccgttttgttctacgttgtaggaagcactcgtgctttccttttgatcgagtgtaacggtgttcggctagttgttctccgaaacaagctgttgcggtttcaatcgtttggcgagcgatgcttcgcctgattcgtttcgcccccctggcctttttcgctgatcaggcgtttgccttggggtttttccacaaattatcaatcgcacaaacaaataaaaagaaggcagaggacatagagattttatactggttcgggccttcgtggtggataatagccctacatctagttttttgtctttttttcattttcatcttttttttctcttttttttcttaccgaagggcttacataacgatatatacatttttacaagttggcgatatgggtgccatccgttctagacataaaaacgcttgagagaggcagcgttctaggaatggtcgaactcttcgccttccagtgtcgccagtcgaaaggaccccgtcctggacttgtgcttgatgaggtacggtccttcccacttcgattcaagcttgccaacggctatcgggttcgccttcttccttaagacaagatgaccaggcaacagctccgtcggtcgaacttttttgttgtaagttgccgaagtgcctatggcatacttgcgcatgtgctcgagtgcttcgactcttaccccctccaagagttcaagcgacacctcgcgcccctcttcgcccccagagaacgtcacccttggtgagttagtccttagctctgttggggtcattgcctcatcaccataaagaagcgtgaacgggctgaacttggttggtcttgtgggggtcgtccgaagggcccaaagaacagatagaattttctctggccatttgcccttcgctgccccctcaagccttttctttagtgcttttaggatcttaccatttgtatgtatggccgccccatttgactgcgggtgcatgaccgacgcgaacctgatttccaggttaagcccttcgcacatttctctgaacttgtcagagttgaactgcttgccgttgtcagtgataaactcttttggtactccaaaacggcaaacaatgtttttccatacaaacttctgtactgcggccgaagtgatatgagctagcaggctttgcatgtattgctttatctcgtcgaacgctgcttggcattcgggtgtccagttgaattttcccgtgccctggagggttttgaagaagagcaaacctctttcggctgcctttgagaggaatcgactgagtgccgcaattcggcctacgagcttttgtacttaacgtacgctcgacggaggcttcatttgctgaatggcatcgattttctcgggattcgcctcgatgcctctttcagaaacaaggaaacccaacaacttgcctgcgcgaacgccgaaaacacacttcccaggattcagtttcatacccgctgcacgcaagttgttgaaggtctcctgtaggtcggacgcgtggttgaaagccttccggctttttacggcgatgtcgtcgacataagcttccacgtttcgccccaatttcttgtaaaggaccttgtacaccagcctggcgaaggttgctctggcattcctcaggccgaaaggcatcctgaggtgacaaaaggtgccaaatggtgtgatgaaggctgtcttggggatgttggccgtgttcatgtggatctagtgatagccggaatatgcatctaggaagctcatgagttcgcagccaactatcaaatccacgagctagtcgatccgtggcaaggggaaatcgtccttcggacatgctttgtttaaatatgtgaaatcgacacacatgcgccatttgccgtttgacttccgcaccagcactggattctccagccactcaggatggtcaactcaggatggtcaatctcttgaatgaccccagccttgagcaatttttggacttcggcttttgctgcctcttggcgatcagcggacatcttgcgtagcttctgtttccttggcttggcatccggcttgactgctaggtgatgcatgatgagatctgtcgaaacacctcctacttcatcggggcctcaggcgaagatatcaatgttcttcttgagtacctctaggatgttctcagcttcttcttcgcccatgtcgccccccagcgatacgagctttgtggggtcggcatcatcaatctgtatcttgattatcttgtcgtgtggggcgggctttggcgcgtgcttcgcacggtcatgcggttcggcctcaacattgtgcactacttatggccagatcgccttttgaagcagccaaaggctgaagccccttgaccacgatcactcctgtcgggccgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccatgctgaaggctaccatcaactgtgcttggccaagaacttgaactgcttctccgctatcagggcgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccgtgcggaaggctaccatcaactgtgcttggccaagaacttgaactgcttctccgctgaaacgtcggagcgatgctggtgctggggtaagggcttgggtggctaaccccatcttggcatatgcttcggcgaagatgacatcggccgaagtccctccgtccaccaggattcgccggacctcgaaaccagctatctcggctgagatcaccagaggatcttgatgcgggaacattactccttcggcatctcctggcctaaaagaaatttgctggttcagatactgcggggccccttcgccagccaaagtgatattgtggaccgttcgtagctgcatcttcttttgtcgcttcgacagctggatcggcgggtcggcccttgtaatcacttggattactctgcgctgcgcgtcttggcactgttcggggggtgcttgttcttgagctgcttcacgaggtgcttcgacagctgctccctgctgcggccttggatcttgcccgctgacacgttgccgaatgtttcggcattgctctgtggtgtgtgaagagcgtctgagaaaggcgcagtagaggtcttttcggaccttcttgcggacaggctgctgatggttgcttgcttgctgggcgtcgaactccttgcggagggcttgcacttctttgacagccatcactgccttgcccgcacggtcggttctgaacttcctctagatcatgggggggggcttgaccttgccttggcggttgtccttggatggctggggctggcgaacagcgagaggaggtggttcggcaacttgaacttgtgcttgggcttgggctgcggcgacggaagccttatgatactcatcttgtattgcttgccatcgcttggaatcctcttcgccccttgcgtacccgtcaatgatgcaaagtaggtgctcaagcgtctgtggctccttattggcgatttttcttatgagttcaccctcgagtagaccggtcgaagcggcgtttatgacagatgcctcggttatgtcttgaacttggcaccgggcttgcgagaagcgacgcatgtactcccttatcgactcccccggcctctggcgaatgccgagcagatgttgctgcgtcttcggctcctcataggtgcctcgaaagttaaggacaaagatatcgcgtaattgctcccatgagtaaatgttattggctggtaaattgaaataccaagaacgggcaatgccgtctagagcgagatgtattacctttgccttggtattttcgtcgccatgagccgcttcgatcgcggactcataaatggagaggaattcctttgggtctgtttcacctgagtagcgtgggacgggtgggaacttgaactagggtgggattggacgggtcttgattcccccactcagcgatagccccttttcgctccctgccctgttcacggcaccttgctgcgggtatggcgtggcgaagggcgaaatcatggcttgcgcgtgaggttgggccatggcattcggctgcccggctccgattggtgatgcttgctgagctaccatggatgggtcaaaagttggctgtgaccgtgtcatggcgacctggtttggtgcctggtttgctccgaagcctgacgttggtgcttgcggccgaatggttggtgcctaagaagcattgatgaagttgaactacggtccttgactccacggcgaagctcccagacttggctgattcgacggcaaccaactcggtgcatcatgacttgtattcccctccgggtgtgctgaaggggctatacctgaaatgctatggggttggctgagctgctgaaggaaagcttggagctgcgcccgcagagccgaagccccttctgccattgtttgtggtgcttggccaggtggttgaggttgtacttgtgtaacaccctgcctccaaaatccgcattagtccactctacacgttgagcggacccactttcgcatggtatcgtgcttacactttcgtcctcgcttcgtgtaaaagggttaacctggggataccatggttggagcaccaaggcttataagtaggccttcacccacctaaacttccaaggtggtactaaaccaccactacacatccacttctgggccacatgggccaaactcacactactaacaggcttcaaacgggttggggtgttacattcacccccccttaagggctgacgccccggcagctcaccgtttacacggcagaggcctagaaccccctccggtgcagaccatggccttttaccccccttaagggctgacgccccggcagctcaccgtttacatggcagaggcctagaaccccctccggtgcagaccatggcccaaagcacatgcatcacacaacggaggtttatgctctgataccaactgtaacaccctgcctccaaaatccgcattagtccactctacacgttgagcggacccacgttcgcatggtatcccgcttacactttcgtcctcgcttcgtgtaaaagggttaacccggggataccatggttggagcaccaaggcttataagcaggctctcacccacctaaacttccaaggtggtactaaaccaccactacacatccacttctgggccacatgggccaaactcacactactaacaggcttcaaacgggctggggtgttacaacttgggcagcgaccggctgagcttgcagctgcacgtgaggggccggatgcgctgctgcggtcgatggctgcccgacgaagtacattggcgcttgcgcgacttgtggcggaaggggctgggtcggcacttgtggatagacttggggtgggacataacctgccgaatactggaggattggtgctgaagcgaccttggatcgtcttgccgtctcgtatgcttgctgttgttcttgcatttggcgaagcatgtcttggagtcgtgtcatgttctgtcgcatggcttccatgttggcttcggtttgtgtttcggggttagggttgacttgggcttgcacagcggtgagcgcagttggggccgctgccgactacgacggagcggcttggggcaccagcagttggcttgtcaaaaggatctccgccctggtctggagtgcccttgccgccgcagccgccttcgccataccagccatgttcggcacctgcacagaggtggcaggggccgaaggcggtagtgatggtgcaggtgcggaagctgatggcgctcctccatcttcggcaacgggcgccgaagtctctgctccctcttcggtggccatatccgccctgacgtcactttcctttcgccttgtaaccttctccttcacgaccttcttcggtggcattcgctctcaatggtttcgcttggaggtccccacgatcgacgccagctgctgtcgaaacgacaaccgcatacgtcgaaagacgtggtcactcaacagtggttgggaaagaagttgtcacgtcctgataaatttatcccgaaataaaaatcattctctaaaaggaataatagaattaattaaaaatcgaaaagaaattgacaaacactaaaatacgtacaagaaaaattcgaatatggtccagagaatttttgttaaattctccttggtctaaaaggagccctcaaattttacttgaattttcagagcaccggaaataattattaagcaacaaaaacaattaacaaagtttactaaaaagaaaaactaaaaataatccccctcctccctttgggccaagtctggcccaaagtcctccctctctctctctcggcctgcggccaaagtcctcacttcctccctctctttctctccctctcctcctctccctccttctcttgggcctcctctccttcccctcggcccagccccctcctcctccctctctcccccaggtcgcctctccctcctctcctcctgggccggccgcccggcccaaaccgcgccacccagccgcccctcccgcgcacgcgcgttgcacgcgcgctaactgcgcgcccgaccggtgggtcccacccacccggtcgtctccttcctcccgcccggcatcctttctctcttctctctcccgtgaaacctagcgtcgattcctcccctaaatccacgcgaatcaatgcccttccttccaaattgattggggggaattaatccccgttccttccacatcaattccccctaatttcccccttgattcgtgcccccaatcgtcgggaacgcccacgccaaccccggccaccttccaaggccgccggccggcttttccgccgttgttccctcctctcccgtccccggctccctctcctaccctataaaatggaacaccctcgctccgttctatcgttttagccccctcctgcgctctcccgtggcctcaccacctctccccgcagccctcctctctctcccacaccgccggccaactccagccgccactgccgcgccgctcaggtgcgggctggccgtgccgtcgccgccagcggcctcgcagccgcctcttcttccccggcgtcgcctccgtttcgcgggaaattatcggagcgacgtcctcgcagacgaccagtggtgtcgccaccactccaccgcctccagccgcctgtgccgcctcgccggtgcagcggctgtcgtcatcgccatcctccctcaacgtcgccgcgtcgccctccacccaggactgccctcggtttcgccggaacgccgtcgcccgtggcgcctctccctcggtctcgccggagttccttcggcaacccctttcgctgtgccagcgacgcatcacctccggcatcgcagcggcgagccagcgacgtcatcctcagcatcgccttccctccatctgaacccctccactgtccatcgtcgtcgtctccgttcgtcctcgtcgacgactcctccggtcggtcgttcgtcctcaccggctcatcgtctcgcggcgccgcctccgtcttcggattcacagcggcgtgttccatgccgtcctcgtcgccgtgcagccactgccggctgcccacgtcgcctcctcgccggccccggtcctcgtcatcgtcgtcctcccgtcgttcccggtcgtcgtggcgttcgtccctccgtcaagccgttctcgttcgtcgtcctcgctacgtcaagtgccgcagccccgtcattgtcttcgtcctcgcctctgcgtcgccaagcgttgcgccggccacgtctcgcctttgtccaaggatcgccaccggagtcgtcccctcgcctttcgtctccatcgttcccggccgtctccgccgcgcccgttcgtcgttgtcgttccctcgcctcgtcacgtggtggtaaggatctctctccctcgtcgccctcgtcctcgtccttttggtgtcgcccgtgcccgttgtgcggttgtcgaccccggtacccgtgtactggtgtcggtagtcgttcgcttgtgcgtgtggtgaccgtgttagtgtgcccgctcggtagccgcgtggtttccacgtgtgcagcccgcgtggtgtctagtggagtccgtttgtcggccactcgcctcggttgacacatggggtccgcttccgtcgacccgtggaccatctctgtgtacccggtctgccgtggtcccttaggttgacaagtggggtccgcatgtcaacggcgcagccttcctgtcttttccaggctagcgcttatacatgttttatagttgtaaaacctaattataataatccgcaaatctccatataacagcattaaacttcggatgaccatgcattggtcatacgagctccgaatcgatccgttcaagtctcctaatgtttgttataacctaaagaaccctgtgctttatttttatgtattgttattgcttctttataggcttgtagctttgcttgtgtgcttcgcgtagcttctgtcgttcctgagtttcccgaagcgtggttcgcggtcgtcgccgaaggttcggaaggccattatctttgagcaaggcaagtcacatcatccttgagcatattgaatcccagtttataaaattattttgatttaaattattgcattatcgctttattcaaattcccgcattatcactattttatttagccatgcctatttatctttgttatgaccttatcattgttgttattgttattattaccttgttcaccctaggataaacaaaactccaactagtgggtaccctattcatggttccactagtatgaatttaggtagatgcttcgctgactaattaggcaacattaggtggttttataactttagactttgggaattctcatatcatttggacactatggtatggttggcttatgttggaattggacacacacctccccctctattcaaaacccccaaaatggttttaggctgggctcgaggtccgtggttgggttttgttagtcgtacctcgggtactataaggattaagctcgggcctctgttggaaagcactaccgtacttccacatgtctagtgggtaaggcttagtttgtggctcagtctggttataaacaaaggtacacggatggagatggacgaagtcgggggtcgatggacatctctaggacaaataaaggctacacgagctgcggcccggtagtcgagatgtcatggcacagggctggtgtcctgctgctaggagctcaatcctgcctgcctgtcccggaggttccggctgtagatggggctgggtcggtacttttgtttatggctaggatgggttgggaactatgtgacgtcttccgtccgtatgccgtggtggtatgtggcacgtggttacacgtgaggatgatgtgtcttgtgggtaaagatgtacacctctgatcagagtataatctattcgaatagccgcgccctcggttatgggcaagcctagcaatgtacccaagttagtgttttaattcttaaaacctgcttaactactaaaatgtggaatggttggcctgggttggcttgggatgagctgggacccagggtcgggttgccagttcggtctgaatcatcgtaggccttgaattaaggcaggttcgtgggggtttacggccttgattaataacactttgtagctctaggatcatctttataaaatggctttgggcaactaagtgacttttaaatgctgtttactgcaaaacttaacccctatattattaccccttgcacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatagagccatagtcccgctagtccgctgctgtttatttttgattgtcaggccttaagtgcctttgtaataatgtaaatattatcgatataataaagatgtgtcttttgtatcatgtttgtgtggtgtaccccgacttttcctgggacggggattaatacactagcgttcgggaaaatgcatttttctcagtcgcgacagaagtaaagtgtattaattagagaatttttcttcgggatccccccattacatggccctatgagactatttatagctcctattacaggttcttactactagagttttggttatacaggggaatttacatggttacccttatgaaagggacatttacatgggtacatagggtaattgaggttcacaggcccctgatgggccgtcgggcgatcgtcagctcaatagcccctagacttgatgggcctgaaaggcttcttcggccctcgcgggggcgagcttgctttggcgaagtcgtctcccttcggcatatactcttcgccctgcatccttcgcccaagaggcctctggcttggcagagtacccgtgcgatccctcgcctctcgccgtccttgttccatagtcttcgtcatggggggacttcgccccgactaactttgacgtctcgggcttgaatccccactcttcgtatagctttcagcagattttggtcgaagggcctcatgccataccaccaacaatgatatccatcaaaactatccaaaatgcgagaggcagattaccatagtaactctcggtaagcacttggctgagtgagttgcaagtactgttcatgtacttaatgatacctaaggaattaatttatatacggagaaattaaacatagtgcagcctgttggtctgtggcgttgtgctcattttttcagaccaccaccctttcctcgatcttacttgggctagcgctcttcgctggtccagcgaaaaggagatagcagtcgagagtcgagatcgaaggcctaattatttttagagagcaatggaacgaacattgatgggtatagatcagtcatttaattaggtgttgttagctgcagtttagtctcatgagtttaattatgcttgtactccatccgtttcataatgtagcattgtccacatttatgaaagtaatttttataagactaatgatgacaaaactatagaaatcttttatcaaacaatgatttatcataaaactatatatttatagcaccgaagttattatagaactacatatttgtggtgcagtactacagatttaataataaagttaccacaaaatcacatgttgagcatcaatttaatcagaaaacttggatgctaattattcaaacataacattattgctagggatttaaaccctaaattttgtagttttggaataattttattattattattaaatatgtagtcttaagatatttagcctttttactctttttaaaatttggttgccctcatgggtcggtcagtgaaacactgcaggatttaaacgacagctagagctataatttaccttatcagatcaagtaggtcctgtctgattcatggttcgatgcttgaactatcttaagttcttgacacacatgaacgttacaaaagattagtatttggtgtgtagaagggtcaacgccaagccggttaattagtgcaacaaactatgtgtttgcttgcggcacgattgcagagagcacaccatcgtcatggcatgaacacaaacagacccgtaggcttaatcatgtgtgttaggtgaaattaacttgatagatttgcagttcattatctgcaattgacacgataaattacatccttaaacctgctggcaattgtacttagataatggtagcgtatcctcacagatttagcacagctagcaaggcgggaaggaaacaagaaagcattgggatgccatcatctgtaaagtacacagcacagtactgaatcaatggcaatccatccgttgcctcccatgtatgcctattgtctactgtactaaccaagaagacatggaggacaagtccagcgcatgtacgcatggtgcccaagaggacagatggaggatcagatcatggggcaggcacatgcatccacatccctcaaaatcatgcccttgtctccagattcccgggcttggctgttaatgcgtgagttgtctgaagaagctcgcatccctccaaggcaggcggcatatatacagttcaggatcatccatttcttaatgctacttcatcattctgatctccaaaagggcctttctcatcaggacaccgctggtgatccccatccgtgtctcagatttatcatgctagctgattggagtccattgtcgcacgtggcgacgatcgggtttcttggaaagctgggggaacattgttggtgctgggtcactaataatttagtttgataagaaaagagatggagagaaaaattaagccggaaagggaaggtaggacatgcaaacatctaagtagaattattctgtagttcacatgcaataagtgcgcgtcatttttcaaatatcgaattaggtggattggaattagcatcactaattaatgtgaaacaccgtttatagtttaggttgataacaccaattaattactaacatacatctcccgtcagaaaaaaaaaacaaagaaagaaagagggggggggggtcatgttattcagttagagaagtgtgatacctgaaactgaatgtcatgttcagtttcagactttaagaggaggaacagatcatcaaattaacttgaagcttaagctctccaggacgactgcatttactcatggaagtcgacaagatccccagatccacaatggttataaacaatcttgggtggcaattattaatcagtcatgtcattcaactagattgagaaataaaagaaagaaaaaagggggtccgtactgttgtagtatattcctgagtgggggaggggaggtctgtgatgtcaacaagttaggagcgaggagcatgattccagggcaggcaggcatgcacacatgtgaagtgccttggttactttagctgttcctgtctcttggttcgggtgattctttcttcctttctggtgtagtgccttcctttaaatctatttctggatagatacaacacaagatggatgcacacatatttatagcaagtgggggttgctatgtctccctgcttttctagtctgcttgacattttgtggtgggggcatcatccctttcactctcaaatgcttcagatttcagtcaatccacactgtaatccccattgctagtatctctctctcgctctctctccgcctttaaaataggctcttgtggattgttgagaaagttaagtgcccctgttgcaaggttctttgaggcttcgatcccgataagcgttcgaactggtcggcctccacctattgtgagtaaaagccactcaattcctttctcatagtttccattttccttgcatccatctataaagatagctagggtgcaaaattttatatggttggtttgttactgccatggcagaaaaaaattgagcgtatgcatccatcgagagagagagagagagagagagcaatctgttgatctcgcactgtattttgcagctgtgatttggcttcaaagccagccaaaaaaggtctaattctccggccacaagaagatgtcaaggtacctgaagcagtacgagaaggaacacatgaagatggccatgttgaggcaggaggagacattcaagcagcaggtaagataagaacaccactccatactgaaacttccaaactcttgcttccttatccagtaccgaaccttcaggcctcaagcaaataacagcagctttgttcaggttcaggagctgcaccggctgtaccgagtacagaagctactgatggacgccggctctgcaatcacaatgcaaggcatcagttgcatacctgaagacgattatcatgcagaggagaacgaggcagggtcgagcaggccatggcacaccttccctgggagcgacaatgacaagccacaggctcacactagtgttcttgaagagagcgagctggacctgacgctagcgatcgggaggacgacgacgaccaagaaggaggcgccgtcgtctagcgtggactcgaggacgagcaactcgtcgtcgtcgacggagtccggcagcaccaactgcagggcggtgatgccgcaccggccatctcggttggggtcgtcgtcggcggtgaaggttgttgctggtggccccggtgttgggacgacgcagcagcatttggacctggagcagcaggacgcgctgaagcagcctccttggctccaccgttgtctcaatttggcacgataagaggatgtatagcacacaacttcttaatttcttgccgtgtcatccctttactattctcaatcatgcttgctgctcgccctcgcatttctcgatcgtttgtcctcactttacttcacttttttttttacttcttattttttttacttccccaccaccgtcatgattaagaagtcgcgctcagcaggggaaagaaaaaagagtcgtgcacccggagccgacccgcttgatgattccaagccttatcgttttccttatataaaatcagccgctataaaaatttaagtttcagacttacttttgctgttgataactagccggcggctacaagtcgtcggatagttattagcgagtactagttggttggcaagattagttagcttgctgcttgctccaccattataatttgtgagatataaattataaatttataattgaattagggctactacctatctcgggggtctgaatcaacacaaaaattcgttgtctttagattactttaccgcaatctcacgtatagcttagtcccaacgtccaccatactatatagataccgtagtcaggtataaactgttgatagtagcgtgccaagtagggggcttgatgaaaaaagtttcgacgagatgggtacaagagacggattttctaacaatggcctctataatcagcttggccagggcggtccaacccagctgatgttcactcttctgcatgttggatccgtcacattcccagtcttcgctgttacgtcgttgttagtatttcttacgatcacagacaaaatccgcaagcgcacggatataccgatgtagcacttctcctacggagtattccaagggtatcgaatccaagagaacatgtgtggtcagatcttcctccggttcatccaaggacaccaagcaaatgataagccaggatagagaggatttaatagtgagaaacattgttagggaaagcttaattttaatcctaatgcaatatttcaggcactggcaacccgcagttcccagatgtcgctctactacgtacccggacagggaggacttaagtgatctcgagggctgtcaccacctctacacccacctcaaacatactgtgggatacgcagcaattactggataataattacctaaacaccacgtctaagcaattactatctactttagtgtttataactcactaaagcaatcattatattttagttgattatagtgaacaataatcccgtatgctacttcggaactaaccaagagataattctcacaagataaatctaaattactcaagaagaatattatattgaattcacagtaataaacagaataaaagaaataggggaagattactgacaactccggaattcttccgactcctactctactcccttccttcctattctagtatacaatatagtacaatagagcctcttataattcagctcaagcttggaagtatgtgtgagagtgaataaagtgaggtctatttataggacaggtatgacggttgtgagaaggggaaatgtccgaactgccccgcaaccgtctttgggagagcatctggagcgtcgatgccaaaccctaggatcaacggcgatcagaggggttcgcccgaacctaggctgggccctcctggcctggccttcggtctatggactccctgggctcttctctatccatttctcagagttttgggttaattcactgatgttttgatgaagttcacaacccctccttgtatagatatataattctcctcactttagtctaggtttcctcccaacatcagggtatatcatctacatacaaatatacaccaacacttgtggaatatgtgagattaagcacctatcactatgttggatgttttattatccgaactttatgcagatgttggcggtatagaatcgacatttaacagccgccaacagtcgttgatctaccatccgacttccaccgagaacaaggagccgactgcgaagtctattgggtttactcccacatcggtaattgaggatgggggagcactttttaaaaggtggagggagtcctcacccatcagactagttttttgggttgtgtaggcctgagacctaaagttgtggctctggttgagcctgtggtggagcaggcccaatatgaccgggtggcccatggttggtggactgggctgcgcactctaacaagtaatatcagagtccaggtttagaacctggaacaatttccatgggtcacatgatgggggaggccaggtaacaagtcttcagggtcacatgggttaatgtgacataggagattgttgggcccgatgtgtgacgacggtggagattgttgagtttagtctcacatcggtaattgatgatgggagagcacgacttaaaaggtgggggcaatcctcacccatcaaactagtcttttgggttgtgtaggctcaagacctagagttgtggcttcggttgagcctgtggtggagcaaactcaatgtgacctgagtggcccatggttggtgggctaggttgcgcactctaacaaagtccaatcacaagattaggaagaagtggtgccccattaacaaaacgagttctcactctctagatgggtgcagtgttatgctgaaggacaaaactggatgcaacggttgcaaacttgatgatactcaacgcatctcctcatacaaattatgccccatcgacaagacctgagtggcccatggttggtgggctaggttgcgcactctaacaaagtccactcacaagattaggaagaagtggtgccccattaacaaaacgagttctcactctctatatgggtgcagtgttatgctgaaggacaaaactggatgcaacggttgcaaacttgatgatactcaacgcatctcgtcatacaaattatgccccatccacaagacaaaatgcgtactttgacagggtttaaggtattcatcaaagttgtcgaatccatgacctcgtctacgtcggccagttcttctcccaagcattgtctgatccactcccgatgacatcaatccatcaatttgggatcatacgatgatatgtcagatgacttagcttgtttggtcggctatctgggactagacccccatgaaccatctattctccatagtctggatccgctcgagtcctaggtctcaattcataccgtagggtgaacatcgttgagatcgtggacctagcgtcccgtgacgacattgttgacggtcgttatcgattagtttcgaccgtcaatattactaaaatagaggagaactagtggtgcttgcaatgcatatatttgttagaataataatattccattagtattaggtatactaaccttttgcagagaatgacaataaagtggaggagaatcgacatcaactcagacgataaatcaatcggacgatgtcgagaaccagacttatgtatgaatgggccaagaactcaaaaataacacgacacattgggccaaaattcacaagtctacggaggaggacaacaaaggaggccgccagccaaagatgggctgggttgggccagcccatggtgtttcgaccgaaccccccatagctccgtttgatccagggttctcctggacggctgagatggctccccaatgacggttagagggtattaccgacaattccaaccgtcacaaccgtcattgggaggctataaaaggagctctcatcctcacttcactcacacacctcaagcaatagctctctcatttctctcaagtttagtttagtagtatctagctggtggaataggaatagagtagaaatcaggagtccggaatccttaggaagagttcgggtatggctctagtagcttttctcttctcttttgtaagccttgtacttttactagaatactcttctaaatatatttatggtattgaaatactttccgagtatatgagtacctactttacattatgttcatgttatgctgaatatacggctagcttatctgggagatgctttggtgcgggtatagtgtttccttatgcaattactctatgtcatgacgatgatattagagtagtacgtggtagtttagacgtggtgtctagattacgggatatcattatttagggttatatattgcggatgagaggtgggccgctgatggtgacagctcagtacgggtattcctccgtgccggtatataatcctaagttaattccctgggagggtattcctccgtatttagccccggttgtatggtcatgacgggctgtcgtaaggaactcagcagtcaggggtggcttctcgaagtaccaggagggtatcggatagagggtattagctagtatatcggttaactagaatgtatgtatactatgtatattaaaagtataggaattgatttttgaagtataggaatagattttctctcttttctttccacttagcttagatgatatattatgagaatgagtagttaatgcttgtgtgtcactctacccttggattatcttaacccctacttagaatatgattatcacaagtaatatataaattattagtcaagttttctctacatgatcttcccacgggataaaataaatacgatacccttggaatactctcaggtgaaatgctacaatggtatatccgtccgcttgcggatgaactctgtaaccataatataccagaagtatttctgcgccattgttgggaattatatttctagtaatatcgttaagaaataccaacaagcatttctggtgccgttgccggggaagatttataatagtgattacttgaactaatactttatttttacctttgtataatcattttcctttgcaggataaaccttggttgtttttactttttgttctgaaaacaggttagtgcatgactggtttcaatttgccggaaaacttcaaagaaaatccagaaactttctttcggagcgttaggccgcgagtcgttgctccgcagaaaactctaccaatagagaaaccagccataccggcgccaccaaccttcaagactatggctaacaagactctccgcgagttcgctgctttctctgctgacaatttggccatttggcagctggtcaacataggggacgtggatttcgacttgaagtccagcctcatcacgatggcgccggctagctcattttgtggcaagcctaatgaggatgccaatgctcatttgcaatagttcctggagatctgtagcatgtacaccatcaagggtgtcagtcctgacgccgtcaggctaccactgttttcgttctcccttctcgggagagcgaagcaatggttctatgccaaccgtgctgctgtcaacacctgggataaatgctctataacattcctctcgaaattcttcctgatgggcaaaaccaatgcccttcgtggaaggatttcatgtttccagtaggcaagcgatgagtctattcctgaagcatgggaacgtctgtaggaattcgtggccgcttgtccttatcatgggatggacgactggctgatcccggttgacttcgtggtgctggacatggacacggggaaggagacaccgctcatcctgggacgcccattccttagcaccgcgggagccaacattgacgtgggaacggggagtatccgtttccacatcaacggcaaggaagagaagtttgagtttcaaccgaggatggaacaatgctccatggtcagaataaagtacgggctgaacccagagaatattcaagtggtcgaagtggagccacccaaaatggacagcctggtgaaattcatgcagaatttcctagagaaggaaacaacgatgcctaggaaccgttattggaagacgccggtaaaaccacccataccagccaagaagatagagcagccgactcagaagaagccgtcttccacaccaaagccaaggaatgtgtggaaggagaagccaaagacgcccgctccatcacctccggagacgggtggaaaatccacgaactgaactggatggaggtacagtcttgcacgtcggactttaaatgacacgaccttcaccaacaggtaaattggtatgtatccgcatatttgctttcaacaatttgaatttttgtatcatcacatgtttgaatttcaaagttgcatataggatttttgaattttgaggaaattcttcaaatgaatttttcagagcaaaccaaaataaaattttcagtgaaaattcgctgtgccacgaccacactgaccgttggaacccaacggccgaaagcggggacggttgggcccaccatgggttcggccaaacccattggttcggtcgaactagccaggccaacggttggctgcctccttcattgaggcaacggctagtgggcctcacaggtcggttttgaccgttgtgggtgcactacttaagccaaccggccgagagagggaattccaccccatttcaacacatcctgaacgacatcgacctcgaccttgtcagtgatcgggagagacaagcctactacatgctgagcgaccgggagtatgctcacacacgagaatactcaccggagctgctaaaaaagataggtatggatgttgaatttcgtactatttagaaagcggttggttggcagagatttgctgtggtagatgagcctggttcttgtttgcttactttgcaatttttgtgcactttgaaagaaatagaagatggaatttcctttcgctttttccataaggagtacacacttacatgaaaggcttaagtacacttcttggttttcacgattcctgtaaaatcgatctctagaaaggaatttctgggttcgagaaaaataggttttgggaaaatatttctggtgctccaatttgcaagaaacctagaacgaatgatatccataatcctacacttaggctcatgcacaaatggattgctatgactttgtttcctagaggtgatctaaggcccataggggagatgaattgattatcatgtttgccttggttagaaagatcaaaattgctcctgtgaattgtatgataaggcaattgttagaaagtataaagttctctgctcctgttgagtgcacttctctgattactcggatagcaaaagggctaagggtcgttagcgacgtgttgatgaaaaacacgaggcctaggagatctgcttaactccagtgtaggtccaaactcgccttcgggtatgctagcatgccagttgatttgatcctgcaatcaacaagaaataaaggcaaagaaaccatggttaaatctataaatgatacccgatcagctatgtgccgatgacatatcatttatccttgagccgatgtcatgtgtaaatcgatcggcagtcataaataaataagaaagaactatatccactcgatcggctgtagatattaacaatatatattccttatatcgatatatatttaaataaagtgattgggatagatcggtcgtcatgccgagacagtataaatcatttagatcgaaatatatattaataataggattatatatgttgatagcatagccgatcaaatggatctagcatgtatcggctaatactatgataccactctatactaagatattaagagaagtagaatatatcaaataaaagtctaatatacttaaatgcaacaagatcttaatataaaggacagatttaacatatcaatgaagcatatagagtaaatatagttaaatcagataagatcgactgaaactccgatactaccctaatcggcaaccagaagacaggctagagattgatattctaagcacgacttaatagatcaaactcaactgatgcagcattaagtatgaaaagaagaacaatatctagacaatcaagcccatggaagtttcatagagtggtggatatcctatataatctaagtcaacatcgatgtttaacctaatcggctgccctctaccgacagatgttagccgaatgtaggttatatagcgatattgccagagattatgtaagatatatgataactcgacgaattacataaacaagatcagagtatcataaagatggaagcactaatcccgagaacgtaagccgtcataacaagttttacctcttgttgaagatcgaaaccgatgcagctcaacccgaaagcaagaactcgtcgaaataaaactaaagcaaaagggtggcgatgcgccgaaattgtattgaacgtgtgtgttaattgattacatggggttcggggtctatttatacccgaaaattacaaacaatgtccatatcggacacgactcttatctctaacaaactctaaaataccataagtctttacggcagacttttgcccaaacatatctctaaggaaattacataaaatatcctaattaatagatacaattgccttctcaggactctatccatgtgtggcaatcatcttgaagcatatcaactcaacccgatgtcatacaccaagtcgtattgtcggaatcggccgtatcacctaacccagtctgactcggacttagccgatcccaatcgtagccaatccggactccagccgattcttacactattctcgaatcgatcttcgtctttgactcagctttgacctaatcctcttttccgatgctgatatcaccaaattcggtcattaatacaagcccgccaagtccggaatatttggtaatgtttcggatttgctgtacgtcaactccaagcaagtttcgcactttgccgttttctgaccgttactcccatgctttaaatactaaccgtcaccctcgagagatctcgcaccgtcctcttccgtttttactgctgaaacagactttgccctctctctctccggcgactccgccgacgcaaaaggcgattccaaagcgattccatctcctgccggacctccgcctgcgatgatgtcgtcctccgccagcccgtctaccgcgccatcagccgagtacgccgaggtaagttctcatcggctagatcccttttcttcgtaagaattcgatttccccttccctcatcttgtttccttcttctcgaatcctttggatttgcagcacctctccaatttagttgcgattcccagcctgtcgcatgaaaaccattactttcttggtccaatcggcaacttagaccctactgatttcatcatcggcgaaaccaacagaatcccctttagattagccaaccctaacctaggtcactggaagaatacttttaagtcttggccatctcttgagaaaactactcctgagaatagttggaccacatggtacaagcgcctatcagctagcaagcgaacacattgggatgaaatcggaatcggccaagcgcttgcccttaccatagccaattcagctaaggatgaacctctgatggccgccgccacttatttctggtccaataccatcaatgcctttctgttcaaccaagggccgatgactcctactctgattatgatcaccggactagatgtaacctcatcggccaaccctatgagcatgaataccaagaatcaatttgattttagaaccaaaagcataggtggctggtctttctatgtggccgcatacatgggccaaggatctgttactcctcgagaacatgtggcctttctactcatgtggctggaaaagtttcttttctgtggatctagctgtggtcctacaaccaagtggcagtttgcagccgaagctcttgagtcaaaacgagaatttcctctaggcaaaatcctcctcggctacttataccaaatgctgaacaatgcatcggccaaaatagccatcggctcagtggttggagcaggtggaccatggtggctgctacaatcctagctcaacttaatggtcatgaaggttgtcaattggccatcagtaacagaagccgaattcccaaggctggagccgattgtagaagatgatggagaagaacgaacccatcgtaggtgcatgtcttatgtagattatgcatccacaccaaccgttgccggagcaaaactatcggttgagctgctcaaggattggttttgcagtgtcacgcctcgaactagtcccaaccggaactagcccgtgacgctccaaattaacctgttaatcaataccagtcccaggaaacagtgctggtatcacaggaagacagaatatcacagcaacagaggtctctttattatagagtaggagtacagtcatgttgggctgcggacagatcccgagctcacaactgcattactaaatggaagcggaagccaagacttggaccaaacatcacaggcgcgacttgggaactaggccgaaaccctaaaactcatcgtagccggcttgctcctggaagaactccatcttcttcagcaactgggggggggattatttatatagagcaagggtgagtacaggagtactcagcaagccatgggaaataagtgtttaatgcaggcttcaaagaaaggccgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggtacccggccaacagctttcaaacggccacccgggcctggctgatcccatcagccgtagattttccaaacatcaaacctattccacaacagcaaatttcacaaggcagtagtcaaacaaaactacgctaggaatcacctcacatccgcccatgaccatgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacattccccgatccgcagttttggaaattcatttagtttgcaagcaccgacccaggtgtcgggttttctaagtcttttgtaaaacccaagttttacccaagatgtttctcagattttaagtttgaaggcgaccgtcgatacccgtgcagagtgcacgattaccgaggcgcaactaggtgggtacaagcgaacatggtataacaattacaatggaagggtcaaatgcaacaaattaggtaggtccgccaatctgccttgcagacgggacaagcagattaagtgtgatcctatcaatgcataatatttttcaggcaacataattaagttcaaatataggctcaagatgttcaaaggtggcttgcctcgctcgagatcttgagcttcatcctcgaaatcatcgcactgcgggtcttcgggctccgaaactacacacgaaacgggacaactcagcaaacggcgaaaataaagccctattattgacctctaagcatgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcggcccaagagaatggggcggctcggccgagcttaatgggccggccggccaaagaaggcggcccaaggcgcgcgcgggcggggaggggagagagccggtgggccgggtccatcccgcgtggtcccgggtgggacccgcttgtcggcgactcggctcaccgtgagcgaggtgcacgcggggcgtgctagggtttggggagggaggcgcggcacatgcgcgcagttcgcggaggacgcggtgcggcgggcccacgcgcagcctcacggctcgcggtggaccgcgcgcgcgagggggcggagggaaacggcggaccggggtctgcttgtcgcggccgaggtggcgccaacgtggcgcctacgtggctgccacgcgggccggcgggaggtagacgactacgccggccggaacggacggcggacgacaacggcgagcggcggagcgaaccatggcgatacaggcgaaggcgagcacaccgggatgttgcacaggacgaggggagacgagccaatggctcggattcaccgggggatgctcgacggcggcggattgcggcggcggcaaccgacggcgggagaagggggaaacggcgatgaggtcacgaggggccgattcccggcggtgagagcatctacgcggctacgggaatccattgctagtgtcgaattgggcggagctacgccgaacgaggccggtgacgagcgggcgctacggagcacgggcggcgacggtggtgagcacacatcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacgacacgggagtgatctctccggcctcgggccgggggagaggaagaagtcgagcgcccggagtccccttccttgtcctcgctcgtgccggctcctccgacacgcacgatggcgaacggcgacagcgaacagagcacgggaggcggcgacaagaggcgaatgggagaggaaaggaaagggggggaagcttgggtttatatgggcgacaatgtcggtttgggagaggggaaccgagtttggacggtcaagccagcgagctggcgctccggctagcggccaaatcggcgacagggaggaggggaatgacgccggtggaggaagaaaaaggaaaaggaaggaagaaagggggcttgccccttgccactttgggaaaagaaggaggggatgggggcgacgcggcagagggaggaggggctctgcctccgtcccttggtggctagcgcacggagagaggcggggccgtgtcgatgacgacggcgatgacagcggggcggtttggagcggagcgatgacacgggcggcaggcgcgggcaggcgcggcaggcgctgacggcggcggcgactggccgatcggccaccacggcgcgcgcgcgcgggcggcacggcgatttgggcggcatcggcgggaacggcagcgggggcggagagggaggagggctcggcgcggctcacgggcagagcggggagagagagagagagagagagccggggagggagggggagatgggccgagagggattcggcccatcgaacccgagagaggctaaatagacttttgcggagggatttgatttgggaaggatttggattcgggattgaacttgacgatagatcggggattcgagatctgagatggcacggacacgacaacaagcaaagaaacggatttggcaaatagggtttttaagagatagttttcccgctaggcgccacgacggaacgggcgctacaattaggctcttgtttgatatattttacttgttttagtatcctgatatagagtagtatcggagtattagccgatacatgctagatctatctgaccggctatgctattaaaatatataaggctgttatcaatatatattttgatctaagtgattcatactgtctcggcatggcgatcgatccatctttggaagaactagtcccaggaatatccgcaaccacctttaccttatacttctgcaccatagttcccttacgggtttgcataaatgaactcaagaactggttgcgtgcttgctgcatcatcgcttcaaaatccttcttttgatcgggtgtcagcttgtctagagtgatgttcacgatgttgccttcattaacttcagataggcccaactgttgtatcttctcattaacaggaccggggctagccgaggacggcgatgctggcggcttgtcatccatgagaaaagacttctgacttcttatatgtcccaccaggcgtgccaaaagcgtgttaatgaaaaacacgaggcctgcgagatctgcttaactccagtgtaggtccaaaactcgccttcgggtatgctagcgtgccagttgatttgatcctgcaaccaacaaaaaataaaggcaaagaaaccgtggttaaatctataaatgatagccgatcggctaagtgccgatgacatgtcatttatccttgagccgatatcatgtgtaaatcgatcggtagtcataaataaataagaaagaactatatccactcgatcggctgtagatattaacaatatataatccttatatcgatatatatttaaatcaagtgattgggatagatcggtcgccatgccgagacagtataaatcatttagatcgaaatatatattaataataggattatatatgttcatagcatagccgatcaaatggatctagcatgtatcggctaatactccgataccactctat

SEQ ID NO: 35997 - DNA, 33226 bp, Oryza sativa
tatggtagacttttgcccaaacatatctctaaggaaattacataaaatatcctaattaatagatacaattgccttctcaggactctatccatgtgtggcaatcatcttgaagcatatcaactcaacccgatgtcgtataccaagtcgtattgtcggaatcgaccgtatcacctaacctagtctgactcggacttagccgatcccaatcatagccgatccggactccagctgattcttactatgttctcgaatcgatcttcgcctttgactcagcttcggcctaatcctcttttccgatgctgatattaccaaatttggtcgttaacacgaccaaattgcttttatctcagccgctcgtctgtgtattgatgagacttatctagtgcaagggcatattctgaaacatggagtagatggatctttgatttactttttctctggttgtacaaatgaaatcccgttgccaaatgcggggtatcatttgtacaactgccgtgaactaaccattcccctgcagaccatagaagaatctcgtgcaggtggagcatacagggagacgcgcaacatgacaagaaatgaacgagaaagttcatcatcctcaacacctgtgcagatgtatgaggcaggttgggagccaattggggatgcacccggatggacccaagctccacgtcacagtatcggagtctcaacctgggcaagtgccagtgaggaccggtggcgtgcgcctcatgacatccaatggggggacaatcaaccttccagatcaagtggtgcgcctccatctccaagtgaatggcgctcaagttcctctcgttgggacttgggtgaaatcactaggaggatggacactcttgatatgcagacgtcagagatacagtacaacctcacggaacacatagcacaaacgcaaggatggcaacaatctgctgatgcgcagttcgccaacttcaggaacatgatgcagcaacaggacgatgaccttcaagagtacttccgctttcaggggttcaatccttatcaaggaccctgagcgaaaaccatgcttgggggggggacatctcttccccccactgaggtaacttgtatcacatcgcatattttccctttccaattgcatcttataaaacttgaaaacaacataaaaatttgcaaaatagaaaataccaaaaagataggatatgcttgagtcatgctaggtaagacaagctagttctctttgttgaaatgatgaatagttgctctgttttatatctcttatatatgggttcttggtaagtgctctctcaaaggtcaaatatgagtagccaacaattatctgggaacatgagataaatgagttgcacttgctgatctaagtctaagttattgtgagctatgatatagtaaataagagttactatgatcctgatcctagtttgacttgaattccggatgttttgtttttcaaaattataaaatggaaagttcctcatttgatataaattcctaccagagccaaaaatgtgctatcatgtttaaaccatatacattttggttacttgtcattccattgaactctgtcaaactcttgtgacttgtgtagaaacttctcatgctctatgatcaagatcatacatccacatatatgcagatgccaaactcctacactgggagctaagcaatattccattccatttccttattaccaccaaaataaattctccatgctttcatgtgctttctcctcctagaaagaaagaaaaaaaaagagaggagggaaaggcatgattatgaaaaaaaaaagttatgctccatcaagcatgagcatgatgttgaaaaaaaatgtaatcataccctctcctaatcaataaaagaaggatttttgggagaagaaagtaagcgcaaaggagaagctttttctttattttccttcatgtaccacttttatcatataccacacacattttgcacgatcttgatcttgagtatgtttagtcatctgctttagtctaagtttttgatttagtaataaatgtgaatacaagtatgccatgtttgatccctactgaggtctacatattaaaaccttagagtaggaatcaaaaaggcaacaattggtaaggaattcattttgatacacttggagagactgagtgaatcatttgaggaacttggctttcttttgcaaaatcatttgaaaacttccagaataagagttgaataaatattgggtgattgatgctctaattactgttctatctttcaatcgctcaaggcaaggaaaagcagtgtcttgtgggaatcaggggtaagggtaagccaccgtgccaaagattatttaatttgagagatatgcagcatagtagcaactcctgatcaacaaccaagtctttgtttcctttcgtccttcactcgggacgagcaaaggttcaagcttggggggttttgttgatagtcgttatcgatcagtttcgaccgtcaatattactaaaatagaggagaactagtgatgcttgcaatgcatatatttgttagaataataatattccactagtattagatatactaaccttttgcagagaatgacaataaagtggaggagaatcgacatcaactcagatgataaatcaatcggacgatgtcgagaactagacttatgtatgaatgggccaagaactcagaaataacacgacacattgggcccgaattcacaagtctacggaggaggacaacaaaggaggtcgctagccgaagataggcatatatgctacgggacagtagaggtgggccactgatggtgacagctcagtacgggtattcctctatgttagtatatattcctaagaaaaattcatagggagggtactcctccgtatttacccccggttggacggccatgataggttgtagtaaggaacttggcaacccggggtggactctcgaagtaccaggaggacactgttagggggtattggccacacgattgtatagtaacatatgtaaactagatattgagtgtatacttgaagtataggaattgagtgctttatgtttcttgttccacttagttaaaattaatttattatgaggatttgaacagctttgcttcttgtcactctacccctatattaaatataacccctacttagactttgataaatacaagtaatatatgtataaagtgtattagcaaagtccactcatatgatctttccttgggattaaaaatacgataccttggaatacttccgggtgaaatgctacaatggtatatctgtgcgcttgtggatttacttctgtaaccataaatatacgaggactatttctggcgccattgctgggaatgaatatttctagcaatgtccttaagaaataccaacaagcatttctggcgccgttgccgaggatgaatatttctagtaatgtcgttaagaaataccaacaagcatttctggcgccattgctgcggaagattaataatgagatgactataagctaaccttgattgttttcacttgtgtcgtgaaaatagggtagtgtatgactggtttcaacctaccggaaaactttaacgagaatccagaggccttcttctggagtgtcaaacctcgcgtcgtccctccgcagaagagactctccgaaaagaaaccagccatcccagtgtcaccaagtttcaggaacaaggccgagaagactcttcattaattcgttgccccgtctattgacaacgtgcctgctggcccagctgtcaacatcggagacaccgatttcgaccttaagaacaggctgctaactatagcataggcaagcccattctatggcaagcctaacgaggacgcaagcgctcatctgcagcacttacacggaaaagggtgtcagtccggacgccgttaggctatgtctgtttccttgctcactcctgggaaaggcaaagcagtggttctacgtgaaccgggcgacagtcaacacctgggacagatgctccaccgcgttcctctcaaaattcttcccgatgggatgatgccgcttattttctgcagtgatccatgtggaactaaatgaacagtagatagagcaaagggataagcacttgctggtagcaacttgcaatgatcaacaatattgttgaggcgcattttcacaaaacaataattttctagagtatggcatgaatcttggcacatctaaataagtgaaaagatagtcctttcttgcaaaactatgcatccacgccggtggcaaaatatagtccattggatatagacgatcagaaatttcaaccgttagatcatccacatcaaaattttataaagccccgattgagagacttctatttcagaagggtcctctgaccttcatgtcggtctctgttgtcgaaacgacaactgcatacgtcaaaagactggttacttaacagtggttggaaagaaagtagagtgtatataattgagaattttttcttgggatccccctgttacatggacctagaaggctatttatagcctcattacaggttcttactactagggtttaagttatacaggggaatttacatggttccccttatgaaaggggcatttacatgggtatacagtgtaattgaggtatatgggctcctaatgggccgtcaggcgatcgttggcccaaaggccactgggccttcgtgaggccgaacttgctatggcgaagttgtctcccttcgacatacactcttcgccttacatccttcgcccaagaggtctttggctctgcgaggcacccgagtgattctccgcccttcgccgtctttgatccatagtcttcgccatgtgggcttcgccccaactgatcttgacgtcttaggcttgaatccttactggtcgcatggtttcggcaggtttggtcgaagggcctcatgccaaaccgcgaactagcccctcatgggcaagggtgagataggagcttcgggcgagaccgtgcagaccatgtggtatggtatgtggcgccccctttcgaccgatgctcctgccgaaacctatcttattcctgcaaagaaagtgcgttgtgtcttttcggttggtattgttttgtagctttcacctcttgcggatggtggagttatttttttatttttcctgggccgaaaggaacagtaatgggctttcccttcgtgggcttattactgtgcggctcggttgatgggaatttaccgtttcgcctacccttgcgatacgtggcgctttattactggtgggtaggcgaaccgttgcctgggtgggctatatattctcaccctcttttcccttttcaccgccacacttgtcatttttgccatgcgcactctattccaccgttctttcctttcacggtgccccttgacccctcatatctttcgcccattccctttgtttgccactgcacacacccttcgccatggctcctcgaaagccaaaccccgcttcggcgaaagggcccgatcccggccggattgacaacgacaccacggcctttttggtgatttctctcatagatgatggcgagctggtgaagttggtcagctctggggcgttggttgaggggcaggctttcgccctgggaaggccgtggtaccaaagcccgtcgacaaccggacggtggtgttcatcgtcttttttgaggcggggcttcggttcccgtgcaacgtgttgttgccggagatccttcgccttttccaggtagagctcccacagttgagcccgtcggcgctagtccggatcgccatcttcgactgggcgtgccggacctccgggtttgaatctagcgctgaactctttggcgccatattttttccaccgtgaatttgaagacggtggtgaccccggccggaacaaagaagacgatgttcgggagcatgaacttcaacgttcgccccgagcactccgatctctggccggtgaatgctgccatgtcgaagtgggatcgccactggatggcgaggtggttctatcacaccatccccttcgaggctgggtccgagtcggcgaaggcccttcggtgtcggcgcagggcgattgcgccgaaccggaaacccaagatcgccgtggacggcgccatggaggaacggttcgccttgctgcgcaaggtctgctcccgcatcagctgccgcgacttggtggaggagttctgtatgcttctcattttcccctctcccattcgtggcaagtcgcggttgaccaagatgaagaggtcaacggtttgccgaagctggttcttcctgaggggacgaacggtgagattgcgctttcgctatgcgcttatgtgtttcgctatttttcctggctcgacgcttaatatggctacaccttttattttcacagtgttgactctcgatcaggccgatgccaaagcccggaggatgatcggcgatgtgtcggtcatcgagtacagccagctgctcacacgacaggccgctggtcgggtggaccgggtttacgacggcgaactgcctccccgggcgaacccccacaaggccgacgacgatacagggccttcgcgaaagcggacacacggacaagtgagactggcccctagaaagcaaagggtccatgcttccttcaattctgacgctgatgacgaggacgacgtcgaagagcgtgacggcgaggaggaaagggaggaagaagagggggcggacgctgcggccggaaaggctgcggacgaggcggtcgaaaaccacgccgagacccctggctacactcctactacaagtccagggcataatgacactggggtggagtcgaatagctcccccgttcattgaaagtatttgcagggggcaaaggcgctagttgcgttttcggcgggaaaggtggcgaaggggtgtccagttaagaaggccgccaagaagaaaggactcgtcgatgttgctcgtgtttttagcgacgacgagtcttctgacaaatccccgacttcacccaccggtcgtagcttagatctttcgaccgcccccgttcttccgatcgacgctagcggagcgggtggcagtgccgccgccagggcctcagcctccactgatcgtgtcgtgaaggctgcagctagggtttttggaagccctttgcgtcagccgattgtttcgctgctagtgaagccgaaggggaagggggcggccgtcgaaacatctgcccctgaatattctctcgcggcgccccacttcgcccctggcgatttcgagacccgggcggaacttattccctttgttgagggggtaagcaaccttgtctctcctgtcggcactctgagcctattcaccgagctgaatgagttcgacgaagggtattctgctattaaaagcttggcagttcgggtatgctgttcgctctctcttcttgtttgtctttattttcttcttacagatcccacaactaacatttgctctcttcgtccgttttaccttacatccagattcttgcggctcactgttcgatagagcgaaccgtgcgggcccgtcttgacagatttaggatacatcttcgagccaaggatgatgagattggccgcatgagtttggagatggaggccctcgccaacaccctcaaggaggtgaaggcgcaaaaacaagcgactccaagccgaactggagaaaggaagagaggccagagctgaggtcgatcgccttaaggccgaactggagaagggaagagaggctagagctgaggttgatcgcctcatggccgagcttaaaaaggagaaagcccattcggctgtgctgaccgactattacaatcttactgagccgaagatagaggctcttgacctggaggtcagcaaggctgaggcaagcgctgcggaggagtcgcagcggttttcgcgggagatggcaaaggccaccgagtccgcaaaaacggtgtgccaaatgctccgccttgccctcttcgacatgggtgtgagggtgcgaggagtccccgccgaagatgcctctgcctttgacttttcggagtggacacagcaggctgctggtgtagtttcggactgcgctactgcgtacggtgattgctgtgcacgtgtatcggcggccttcactatgggccttctgcaccagtttggctgtgagcacgtcgccgagttccctaactatgcgaagggggaatgggaggttagtgcgcaggacgtttcgcccgcgctccgcgcgtggtggagcagttctagcagaaggacggccgatccactgccaaggcgtgccttttggagcaaccggcggaggcagaggtggcagaccagggcgaaggtgaggatgcggcggttggatggggtggaggcgatgcctaggatcacccagaggtgtgaggccctccgccctttccttagatttttgtagtttttcttttttttcgtttgccgcaaaagacgaacaatgtatatttggccgatggccccttacccttcttaatgtagctgaaaatggccttttggatatttggaatgtatgactcagtcttagtcattttttatggtcgatgcctttggcgtatgtgcttgcgccattttcgtattacgtaatatttgctctttttcgcccattcttactatgcaatttgccttttgccctgtctgcactgtttagcagggtgttcgccgaaaattgtgcactgccccctctgggaattggcgaagcaaaaacgagaaattcgtggtgttgaagggtctgccaaaagtgcgatgcccgtttcggcctatttatcgcgagatggtaaaatacggccacagctataaggtttttaaggttgccggctggctgcaggcgcaccccgggagaaccttagaagattacgatcgtgttcatacaaaacgtttggaggatatggttcgcttttggcgaaatcatcagaagaccttagaagattgcggttttaacgtttggcgagcgatgcttcagccgattcgtttcgcccccctagcatttttgctgatcaggcgtttgccttagggcttttcccacaaattatcaatcacacaaatagtaaggcgaaaaacacaaagattttatactggttcgggcctccgggatggataatagccctacatccagttttttttgtcttttttcattttcctctttttttttgcattttcgtgccgaaaggcatacatagtgccgaaaggcttacataacaatatgtacatttttacaagttggcgattcgggtgccacccgttctacacatagaaacgcttgagagaggcagcgttccaggaacgattgaactcttcgccttctagtgtcgctaggcgaaaggaccccgtcctggacttgtgcttgatgaggtacggtccttcccacttcgattcaagcttgccgaccgccaccgagttcgctttcttccttaggacgaggtggccgggcaatagctccgtcggtcgaacttttttgttgtaagttgccgaagtgcctgcgacgtatttgcgcatctgttccagtgcttcgactctcaccccctccaggagttcgagcgacacctcgcgcccctcttcgccccaagagaacatcacccttggtgaattagcccctagctatgttggggtcattgcttcatcgccatagagaagcatgaacaggctgaacttggttggccttgtgggggtcgtccgaagggcccagagaacagatagcatttcatctcgccatttacccttcgctgccccctcaagccttttctttagtgcttctaagatcttaccatttgtgcgttcggccgccccgtttgactacgggtgtgcgatcgacgtgaacatgatttccatgtttagcccctcacgcatctctctgaacttgtcaatgtcgaattgcttgccgttgtcagtgatgaactcttttggcactccgaaacggcaaacaatgtttttccatacgaacttctaaactgctgccgaagtgatcgcgccaagtggttcggcctcgatccatcaggagaagtattcaatagccacaattgcgaacttgtacccgtttcgcgccaccgggaacggcccaatgatgtccagcccccatctggcgaaaggccaaattggtgcgataggctgcagctcttattggggcgcagtttagcttcggccatggcgctgacagctttcgcatttcttgacttgctcaacacagactttcagcacggtgggccagtacacaccttgtcgaaacactttggaggcaactgttcttgcggcctgctgtgtgcctctgtgaaacaaattttcggcaatatgcaaagggggtagcgcacgagacctaaaagtagatggatgcagagacaaaggatttagacaggttcaggccctcccgatgagaggtaataccctactcctgtttggggatttgaatccgccgggtgtatattgatctgacgatcaagttgtctcattctcatgccccctagagggcctcctgccccccttatataggatggggggcaagattacaagatagaaaccttaaccaatacggtatcggtttcctaaatctactttacaatcttatcaaaccaggactttaggccgttccacaatatacagggaaacgtaatacccaagtcatgatccgttacatatttcataaatataagtcatcccctatagctagtcggataaccatgccgtgtggatatggggtaccataatctccacagtagcccctgagaccttcacagtcaaaaagataatcttctctcgaactagattactccaaagctgagtgctttaatcatcttcgctatggtctccgaagtacttttaaatatgaagactgtggagggctgaaaaataaagtcaggtgcatcgactagatgcacctaataggtgtagccccccgactatgtggttagctaaacaaactaagcatatagtcaaggaataaataatccaaccaaccgagtggttttgataattgtaatcaaccaagtgacttgatatcaatatatagcatatgcggtgtgaatccctgaataacatgatccgagtgatatactgactgttttgtaaaatatgatgagtgtaacctaaagttggctacatcattgaaaattcacatagcaaaacagctataaagaagtttgtatgttgtgaataaagaaatttccaaagtattgggcatacaccatgcgcacacttctttaacagatgtgcttgagtccataaaagacacatggtttcaccacacctagaaatatatgccatatgtggtataaaatccgagtaaataaactcataaggatttatcaatcgtttggaaaatgaccaaaatatataatcagcctaagccataatattggtcaataaaaatgcacacttacgtggcaaaaagcaatgatattgtatctaatcaattgctttatgaacccaaacagcgccttgacttatataaaaaagtcagcggggagctatataaagcattattgtttggcaccttttaaaatgtattgtaccaactcctaaaaagttgagtaactgcggtataaaaggattttaaggtattgggcacataatcacgcgcacttttgcctaagcaaaaagatgcctaagtccctaaaaaaacgtgacaggccacacctgaaaatatgggctgcagacatattaggcctaggccaaaaaatatgccttcgacaccctttaaaggatcacgcatgtaacatgctcccgagtaataaatctttcgggtgatatagaccaagtgtagctcatatgaatagcttctgatctgagggattatcctttatgggatactccaaaatagatataacaattgaatttcgactggcgcaagtattcggttaataacccatacggggaataataaatagtccagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgatgcagttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaaccgttaggtcagccagcaatgaatatgaaggcacccagcgataaagttgtgtagccataccagcgaaataattagtcggtgacagacgatgcagctggtgaagaagatgaagatgcccattagtggcgacataatgagccatccatgaaggcgaggataccggtcggtggtgacgaaagccagccgacggtgaagatgtaggcacgcatcaaaggcgatgacgaaatccaccaatcatgaagatgaagaaaatagtcggcgacgacaaacacaaccgacagtaatgatgataagcagcaatcatagatgatcaaatataatgacgaagttgcccatcaatagcagtagagtgggctatgttgaagaggcttgataggatgttgataaagatgacgatgtcggtgatccagtcaatagcagtgtagcagccgatgataatgacgatgactctcatcagcgtttgcatagtaggtcaaccgtgaagacgaaataacaagtcggtgatgagagttgatgatgataaaagtaaccgaaggcgaagacgtagtcgccccttagcaatggtgtaaatgtcagggccgatgaagtacacatgctggtgatgatgtcagtgacaataatccatcaaattggtgttatagctgttgcagatgcttcacttggaggaaagtagatgatgttgtccaactggtcgaaactgagctgattggttgataactctgctctaaagcaaagacgaagataatgactcctggaattgactcgttggctgattaattgattacttcagcttgtcgaattttaagagtcttgtatttgtgtagcccccgactctttggttagttgggaaacaactgaacatagagtcgagaactgtaacttcttgtcgtcgagtagtcattacttgagtgaagataaatattaaagattggaacaccacttgttgtaataaaataacacggcatcatatttggtgacgtatgccgaggtgtcgaaactcttgtagtcgtcatggttggtgaagtagaggcaatagagtttgccgatgccgaagataataaaaatgaagttgctccaccatggtgacaaaattgcatagccgtgatgaagtcaacacgactcggtggcaacagaagcaaaccggtagtaaagacgcgcatttgtgaagataaaagcaccagtcggcggcggcataaccagtcgatgacggaagacgatgatgtccatcagtagttgtagttgtgttgaagatgctgacgcctattagcggtgacggcgatgtagccagccgtgaagaagatagcatcagttggcgtcataacaggccagccgtgcaggcggtgacaccagttggcggcggatgaggcggccagtcggtgaagcggtcggttggtgaagacgtagacgcccaacaacaccagtcggcggcggaaacaccagtataataggccagccgtgcaggcggatgttctgactgatccattcctggagcgtaagagataagcttaaagccatgaatcccttttatgcatatctggatctggatcctacagaacaaacatataggatgagtagtatctgatataaatataatactcgagaaaaattcaagtattttaaaatatttataaatatatatttcttctcttgtcaattttgatttccccgagcagatgactcattacgtttaaacattctgcccgactagtcatagccaccaaacaccgggagtcggcctaagcactttccaaacatgcatatgagtgacatgagttcgtcattaatggaacaaagtttcacgggtcggagtttactactcgggtacttttgcaattattaagagcagaaaataaattatcttatctctatgcttttgatttattctgaataatacttagcaccttgcgttattcggtccatccaacaagcccccgggtgctaggaatcagcccaaaggcaactatccattggcaaaccaaacggaaagcataggaagatggaactccataactcgataggcacttttgtactcagaatatgtcgcaagcaatcaagataaatattatgaaaattgtttaaaaaaaatgatataacatctatagcccccgactcactagtcaacggcgaaccagttgatgtagtgaggcaaaggaaaaggcaaaatatcatataaagaataaaataaatgatgacttagctttattgtattccctcggtgacagcaaaagtagccgatgtgggaacgaagcagtctatcaatggtgacaaaaacaccagtcggcgccagtggaaccaagccagtggtgtagatgatgaagcccattaacggtggcgaagtccgccaaccatacaggcggaaacaccagtcggcagcggacgaggcggccggtcggtgaagacgtggatgcccatgaacggtggtgtgaccaaccaaccgtataggcgaggacactagtcggcggcgacagaggcaagccggcggtgaagttgttgttgctatcagcaatggcggtggcgaggacaagccggcggagtggactcgcggccgatcgaccggaaagctgagacgcctcgaatccatgaccagcatcaatcgcctcaatagtgccgcgtaattatatgcgaacaacaacaaaaaatagcaagagattaatctgacattaaaaatcaatatgataaataatgataaaactaggcgtccggcgctagacgagtagttagcatgagtagatataaaaaattgctcaatggaaaatatcacataaagaggaaaaataaaggcacttagcttttttctcagtgtcctccgtatatgtgttaatggatggacaggagatcatatcggcagcttgtgacagacatgcaatacatgcatgagtgctgcacttccttgcgcgaaaattgctcctattggttggctcacattccacgtcgactccaatttagattggtaattgaatatcaccaggagatttaacgtcatctaaaaaaaacgctggcggttgagaattgatccgttgcttggtgatccgggtagattgatatcgccgaacagattaaaccagatgatggacacggcatgtcatacgatcaagttgacgactgacgtcccatcggaattttcggtggtggcgatgcaagccaaactccagaagagaagaaccagtccgaagatgaaggtggtgctgacggcagccataggagattgaatctgaaacttgccgtggtagattgttgtaatccctcgattgagtttccccctgactaatttggatcaagtcagagaagaggagcttgaagaagttatcgacggaaaggaagtgaaaactcccgaagctaaaacgaagtcggcgactcatgaagttgattccatcgcgctcgttgataggaaactcgacgcagcccctacctggcgcgccaactgtcgaaacaaattttcggcaatatgaaaagggggtagcgcacgagacctaaaagtggatggatgcagagacaaaggatttagacaggttcaggccctctcgatgcgaggtaataccctactcctgtttggggatttgaatccgccgggtgtatattgatctgacgatcaggttgtctcatgccccctagagggcctcctgccccccttatataggatggggggcaaaattacaagatagaaaccttaaccaatacggtatcggtttcctaaatctactttacaatcttatcaaaccaggactttaggccgttccacaatatacagggaaacataatacccaagtcatgatccgttacatatttcataaatataagtcatcccctatagctagtcggataaccatgccgtgtgggtatggggtaccataatctccacagccacaaagcccctggtgtatttcctttgccatttcctcaacttcggcgaatgagatgcagcgaagcaaaggttggagcaccccagatcgatatagttggcccgagaccatcttgtactttgcggctctgagctgtaagctctttgcttctgcttcgtcctccggaagccagccgctcttgaggtaccttatgaacgggggtcgccagtcttctggatcttcgcccagttctacctggtcgattgccataatatccaggctctctatgggcacgcttggtgcgtgtaggacttaaaaaagatgccaggcgaatgcgggcccctacaagcaacagatttcgccaaggcgtctacttcctcgttctggtctctaggtaagtgttcgaccgttatgccggtaaagcatttttccatagaccgaacagcctccaaatacttcttcaatccttcttcttttgcctcaaaggacttatcaacatgacttgccaccaacttggagtcggttcggatgagcaagtgccgaacccccaatgctttcgcatttttcaggcccagaagaatggcttcgtattctgccgcgttgttggttgtgtcgaaatgcagccttgcggcataccgaatcggcacgccccctggcgaagtgagtactgccgtagcgcccgcccccttgtgcgaccacaagccgtcggagtacatcacccagggttgttcgacgggctcaggctcagggtcgaacgccggtgtccattcggccacgaagtcagctagaacttgtgacttgatagcagtgcgagcgacaaaatgcaagtcgaagggagatagctccgccacctatttgctgagccggccagtaacttccttgccccggagtaccacgcccaaagggtactgtgatggcactgtgactttgtgggcctggaagtagtgtttaagcttgcgcgaagccatcaccagtgcgtaagcaagcttttctatttcaatgtatcttatcttcactccttgcaaggcttaggagatgaaataaactggtttctggcctgactctgtctcttggacatgggcagcagtgactgccactagcgaagctgccaggtacagtagcagttcgcttcctggtgctgggcagatcaaatcgggtgggctttgcagatattgctttagctcgtcgaacgctgcttggtattcgggtgtccaggtgaattttcccacgccccggagggtcttgaagaagggcaaatttttttcggctgcctttgagaggaatcgactgagtgccgcaattcggcctgcgagcttctgtacttcacgtacgctcgacgggggcttcattccattttctcgtggttcgcctcgataccccatttagaaacaaggaaacccaacaacttgcccacgcaaacaccaaaaacacacttctcaggatttagtttcatacccgccgcgcgtaagttgtcgaaggtctcctacaggtcggacgcatggtcgaaagccttgcggctttttacgacgatatctggtggtagccggagtacgcatcaaagaagctcatgagttcgcagccagctgtcgaatccacgagttggtcgatccgtggcaagggaaatcgtccttcggacatgccttatttaggtctatgaaattgacacacatgcgccatttgccgtttgatttccacaccagcaccggattcgccagccagtcagggtggtccatctcttgaatgaccccagccttgagcaattgttggacttcggcttttgctgcttcttggcgatcagcggacatcttgcgtagcttctgtttccttggcttggcatccggcttaactgccaggtgatgcatgatgagatctatcgaaacacctcccacctcatcagggccccaggcgaagagatcaatgttttaattgagcacctctaggatgttctcaactttttcttcacccatgtcgccccccagcgatacaagctttgtgggatcggcatcatcaatctgtatcttgattaccttgccatgaggggcgggctttggcgcgtgcttcgcccgatcatgcggttcggcctcaacattatgcactgctctgttgattatggccagatcaccctttgaagcggccgaaggctaaagccccttgaccacgatcactcctgccgggccaggcatcttgagcttgagataattgtggtgggaaatggcttcaaacttgttcaaggtcgcacggccgaagatggcattgtagttgtacgggatgtcgacaatgtcgaacaatatttgctcttcgcgtctgtttttgcctatgccgaaagctactagcaattgcgcttggcctagaacttggactgcttctccgccgaaaccacaaagcgaggccggtgcttgggtaagggctagggaaggtaatcccatcttggcatatgctctggcgaagatgacatcggtcgaactccctccgtcgactaagattcaccggacctcgaagccagctatctcggccgagatcaccagagggtcttgatgcgggaacattactcctttggcgtcttccgacccgaacgagattttctggtttagatattgcggggccccttcgcccgccgaagtgatgttgtggaccattcagagctgcatcttcttttgtcgtttcgacagttgattcggcggatcggcccttgtaatcacttggattactctgcactgcacatcttggcgctgttcggccgggggtgcttgttcttgaatggcttcgcgaggtgcttcgacagctgctccctgttgcggccttggatcttgcgcgttgccacgctgccgaatatttcggcattgctcggtggtgtgcaaagagcgtccgtggaaggcgcagtaaatgtcttttcggaccttcttgcgagtaggctgctgatggttgcttgcttgctgggcatcgaactccttgcggagggcttgaacttcttcgacagccatcacagccttgcccgcacagtcggttctgaatttcctccaagtcatgggagcttggccttgccttggcggttgtccttggttcgccggctgaggctggcgaacagcgagaagaggtggttcggtgacctgagcttgtacttgggcttgggcagtggcgacggaggctttatcatactcagcctgaattgcttgccgtcgcttggaatcttcttcgccccttgcgtacccgttgatgatgcgaagcaggtgttcaagcatctgcggctctttgttggcaatttttcttgtgagtacgccctcgagcagccctgccaaaatggcgttgatgactgacgcctccgttatgtcttgtacttgacaccgggcttgcgagaagcgacgcatgtactcccttatcgattcccccggcctcaggcaaatgccaagtagatgctgctatgtcttcagctcctcgtaggtgcctcgaaagataaggacaaagacatcgcgcaattgctcccatgagtaaatgctgttggctggtaaattgaagtaccaagaacgggcgatgccatctagagtgagatgtattacctttcccttggtattttggtcgccatgagccgcttcgatcgcggactcgtagatggagaagaattcctttgggtcagtttcgcctgaatagcgtgggacgggtgggaacttgaactggggtgggatcggacggatcttaattcccccactcagtggtagccccttttcgccccctgccctattcacggcaccttgctgcggatatggtgtggcgaagggcgaggtcacggcctgcacgtgaggttgaaccacggtgttcagttgcctggctctgattggtgctgtttggtgagccgccatggatgggtcgaacgttggctggggccacaccatggcggcctggtttggtgcttggtttgccccgaagcctggtgttgtttcttgcggccgaaggtttggtgcctgagcagtgttgatgaagtcgaactgcggtccttgactccaaggcgaagcccccagacccggctgattccacggcaaccaactgggcgcaccttgacttgtgttccccttcggctaggctgaaggggttgtacctgaaatgttgtggggttggctgaattgttgaaggaaagcttgaacctacaccgaagccccttctgccatcgcttgtgacacttggccaagcggttgagagtgtgtttgggcagcgaccggctgagcttgcagctgcacgtgaggggccggatgtattgctgcggtcgaaggctgcctggtgaagtatactggcgcttgcgtggcttatgacggaaggggctggatcggtgcttgtggatagacttgggtgggatgtagccttccgaatactggaggattggggcctgaaagtgtatctaggcccctaatgattttgatgattgattacaatgcgattagagaggactaacacttttattcaaacaagtgtgaaggttgttatgtcctcgacatgttgtaatgagatgcataccccatgaatgcgacatcacgatgcaatgcggcaatgatcaaatggtatattgtatcttttaccttgcattatgtcgtactattaagagggataccacatgcatataattggtagaacactagtgctcaaaatgcttcatctttgtgtgagttgaaaaacctaagccaaaatttcaattccgagttgttcacttgtcacaacacttacaccaggtttctttgcaagtttttcaacatctcttgaaggttttggaccatgttttatgttggttttgatagcccacgaaactagctttccatagagtctaagatcttcgaaatcggagtttggagtaaaaagttattgcatttttactggagcaacatcagactatccgatttgaaatcagactatccaatgtatcggactatccgatttttcacaaaacttcactctctgtctttgtttgaaaaatactttcgagtgagtttttctatgtgtcggagtatccgatgttggatcagatagtccaatggtacagagactccgaaatttcatggaacttgagtctctgtttgaggacgaagtttttgcttctaaaatatcggacactctgatttaacatcagatagtccgatgtcttggaaagtccgaaatttcatcgaacttcgttctctgtttctcgttgtcttggaggtttaaaatatcggactatccgatcttgtatcggactatctgacgtgggatgaaagattcccctccaacggccacattttgggggggtctataaatatcccccacctaatctttttctagggtgacccaactcattcattcacattcactttgggttgagcttggtgctaaggtgctttcgatctttgagctctttctccctttctcaaatccctcctcattctttctgtggtggatcttggtggttgtggatttggtgtttgagggcctagtgtgtgtttcactcgatcttgaacactagggtttgaccaagagttgtgtggtgtttgttactcttggaggttgaggactcctagatggctaggtgtcactctcgagccaccgatcaacgtgtggttggccgggagaagtttgtgaaggccggatctcgcctccgcaaagaaagaggtaccccttagtggaaggaggagtgcttagtgcaacctcttgaggaaagggttagtagagacccggctcttagtgagctcctcaacggagagtagaatcccctcaaggatttgaactccgggaacaactccgggaacaacggagagtagaatcccctcaacttcatcgttggtgatatctcttcatcttctctttagctttgcttaattgtgccgctatagatctagctgttgtttgtgctatactcttgtttgtgcactagatctgcttgttgtgattctttagtggatcagacagtctgatccaacatcagactatctgatattttcggatagtttgactgtggatcagactttccaaccctaactcaggtttagcttccgcataaagttttaaattagcctattcaccccacctcctctaggcctaattgaccctttcaattggtatcagagcctaatctcctaattaggcttaaccgcttggagagatcatgtcggaccaaacggggaatggcaaggatggtgaaaagggagctacgttttattatgactatccatccacatcaacctcttatgtgagtacttatagcggcaaagctccgtacttcaacggcacggactatgccgcttggaaacataagatgaagatgcatttgaagtctattaacccatctatttggagaatagtcgaaaagggctatgttttgcagaaacccgaggatcccaccaatgaggatgacgagaacgagcattagaacgctcaagccgctaatgcaatacttagcgccttgagcggaagtgagtttaaccgcgtggacggcattgagagtgccaaagtgattcgggacacgcttcgaaattttcatgaaggcacggatagtgttcgcgagtccaaggtggagatcctcaaagggcaatttgagaggtttctgatgttggatggagagagcccaagctacatgtatgaccgtttgagcaagatcgtcaatgagatcaagggaattggctccaaggacatgaccgatgaggtagtggtcaagaagatggttcgagcaatcattccaaggaactctaccttggtaactatcattcgtgagcgtccggactacaagactctcacacctcatgatttgcttgggcgcatccttgcccatgacatgcttgtgcaagagtccaaggagttcatccaatacattaaccaaagctcaacgacaagcatcaagaaggaagacttggcattgaaggcaaagtaagaagaagaagagagtcgcaagagcaagagcaaggcggagatcgatgatgaagagatggcactcttcgtcaagaagttcggcaagttcatgaagcaaagtgtcttcttcaagggaagttcgtccaagtattcccctaacaagtcaagtggaagacacttcgcaagggtgtgctatgtgtgcaaagagtccgggcacttcattgtggattgaccccacatcaaggattgcccccacttcaaggaagacaagaagaagcttgagaagaaggagaagcacaagcatagctgaacgtgtagagatgtagcctagagagggggtgaataggctttcctgaaattttctcaacaatcacagcagttaaattaatagggctcggaacctcctggtgatgaacaccggaacatccgggcaggatgagtagcccggaacttccggagttcttgagctaggaacttccgagcagcagagataaattaaaactgagatgaaaaacaggtcctagcaagggaagtttaggcacacagaggaacaagatgaagattgcagaatatcagcagattcacacaaagatcatgcacaagagagacaaagacgattttttcccgaagttcggatcacatgaatcctactctccgttgaggtgctccaaagagccgggtctcgattaaccccttgcctcacttatgcaaagatctcagaggaggtccacagccttcaacttaacacttgttggcggatgacatgaggctcttcgaccagatctgccgaaacccgtggcgaaggctatggagcaagaacggcgtgaggtgaagagtcgcacgagggccttgccaggccaggggcgtctcgggcgatgggtgcaaggcgaagactatctgccgaaggaagacgacttcgccatggcaagttcgcccccgcaagggccgaggaagcctttccggcccatcaagcctaagggccggcaatcgctagatggcccatcaggggcccatgagaccctataacattatgtacccctgtaaatgtccctttcataagggtaatcatgtaaattcccctgtacaatctagatcctagtagtaagagcctgcaatagggctataaatagccccctagggccatgtaatgggggatcctaagtgaaattcaaaatttagtactcaacatccttcgacgtatgcagttgtcgtttcgacaacaacacttctaggtcattttctagaattgagtgaccaccaagatcaaactcaaaattccttctagaaaaggccacaagtgcaagttgctctacataggacaacctctgaaaactcagcacaagaatctttactcacttatctcgtttccttgtggaggtgaggaaaaccctcacaaactttcccgggacatccacaagatctttggaagctcacgggcgacacctaaccgtctaggagaagatctctgagagtatccaaagtgacagcccacaaggtatccaaagtgctcaattaaacgtaatcttcaagccatctccaaaacactcctacactctcatctaatctctcaatctcacaagatagactacagatttgagtggaggaagcaaaggaagcttgggagtggctagaaaaccctagaacatgacagaactgaagtggaatggccaaagggtgacctggggacgaaatccatatatataaatgctaggtgacgtcatctagccgttactcacaagtttgaactggaaacctgccaggaggttccgggcaaaagtgccaggaacttccgggcagaacttaggaatttttttgtaaataaacggcgcccggaagttccggccagaacctctgggtagccctctctgtcccggggtgaaaatcatttttcaaaaatgattccaaaaatcttttgactcatggatatgactaagagcactttgtataccctagaaccacacttgaaacccctcttaatagtacggtttttcctaaactcaatttcgaaagtgaaaaacctagtctaatcaccttcggtgtttttcgcacttaggaacattcaaattgggaggtctccttgcattcttagccatcaaaacttggtttgggactaaactcctatgaataaacttgataaacacgtttgtcacctttaaccaccttgtcattaatcaccaaaacccactagggggtttaagtgcatcttcaatctccccctttttggtgattgatgacaacatggttaaagcaaataaaaagacaatagaatttaaattttgaatgatgagagaagtgtgaagctccccctaaagatatgcatataaagaactagaaatgaaaacattatgcataagatgaaggaaagctcaaaagaaacctcacactacccttatcaaagaagagatgcagatgaaagtgcttgaatgattagtgatgcaaatagaaagactagatgacatggcaatcactcaaaaagatgaaaagaacacaatcatcacatcaaaatgcaacatccatatggtctaacttactgacaaaaagaataataaagcatctaatagtcattacatccaaccataatagaatacgattacatgtccataagagagggaaaatagaggggagatctgcttggccggaacctccggatcacaggacccggaacttccgggccaaatgaccagacaacagtcaaggcagcaaaaaagatttaaatgacccccttcaattcacaatttctccccctttggcatcaaggcaccaaaaagcaagaaaccatgaagagaagaagaggatcactcatctccatctccatcggagggaacaatctcggtatcgtcggagagatgagattcatcggactgtgcaacggtgtcaccctcatcaacatcggtgggagcatcctctgcagctgcctcggcgtcaccctcatcaccatcatcatcatcatcatcagaatgggaagattcttcattgaagaaggtggatggaccttcaccggcaacgttgcgggctgcctcataagcctcaaatggatcaacatagacctcatcctcagaatcatctgacacttgcttcccagcctctcttctatcttccttctgacgcctttcgatcttcttcactttcttggcagtcttagcacacatacagaaaattgcctgaagagccttcttgatgggagaagaactcgaggaactcggtggggcactagtagaaggaccagctgaagtacaaggaacagatcgagggaccactggagaagaggaaggtggagcatgagggcgaaaaggattatggcgcccatctttgatgtagaacaccccagtgattgtctcaatcatcttcataatgaaaggagcatagatgcaactccgcttaggctcaagaatggtgttggcgatctcataccaaatcaacttcatcacactaaaaggaggctgattgtagcgcatgtgactgagaagatgagcatgcttggatggcaaagcagtagcatctccaacctttggaagcaaagaccaacaaaaatggagtacaacaccttgtagttgggatgcaatccatgagtagatcccatgcaagtcctaggtgcatcctttgcatacatgaacttggttttgatcatggggaggggtgcttcactatgaatgttgggcctattgagatcctcatcatctaaccccaacatctcagcaaactatgccatggaaatcttgtgcctaacaccctcagtcaaccacttcacataaggggttcccttccttgtagtaccaaagaatgttttcacattgaactgtgcaataacttcctcattccagtcatactccatggcgagaatatctccaagattcttgttgtggcacacttgcgtcacttggttgaacacttcattgtttttcttcctcatgtaagcccaatcaatccacttcatcccaaccactgaattctctctagccataatcactgagatataccaatccaattgagtgaatgtcctaaagcgaggatcctgtgactcctcaggctgtgactctggatcaatcaaacgatctcttctacacttggcaagttgatgaaggtagttggacttgggtcttccaatgtggtgcataggagtggtgtcaaaaacaagagtcttgtagagccgaataggattctcacgagatcctatagggaaatcatgagatgccctttcagccccagaactgcgaccaccacctctcccccgtcctcttgtattaggtgcatcacttccttgaccactgtcagcatccctaatctgaacaggacggttgctggattgccttgtaaacctgggagaagtacgagtgccactgccactgccgccctcaacaactttctctttacccaaacgaccacgaggaaactaaataggaggactctcatcaccggacacatcctgagaggctttctatattttctcacgagtcatagtgcttactgcaacaggaatcaacaaattggagtgcagtagttaggcaaaaattgagagaagcaagaatgacaggctggctggacaacgcccgaaggttccgggtgcaagaacaccggaacttccggccggcaaaaatgaagaacagaggtctcaaaaatagccagtgcatgtgaacaaatcctatagatcggtgatccacaagatagcagaaacaagactatccaagtggttttctccctaggttcacagatttagagatcgggataaaaatacaatgaactgagagagggaatcaaaaagtgctaccttgagagaagaaactgcgaatcgatcacaggaagaacctcccagccaccaatgtagatgaatccacggagaagaatcgaatttgattggagggaaaagaaaatcgccactcggggcactgtagcggcggctagggctggcgttggggagggagaagaatgaggagagagactagggtttctaactccccctgagtatatatactccccgacacccggaggttccggacagggaggcccggaacttctggcctgacagataaagggcagtcaggcccaaaaacaagaagaagatgagaatccaacaaggggaaataaagaactatggacatgtagagacttatgatgcatatgaccagccaacaatcaacattatataataatggtcaatatacaccacaagaaggggataaaaaccaaattttcaaaataaaaggtacacaaaggattttgcaaaaattttcacaaaaggggtttttggatgaaggcgaatgtttgagctttattcctggtatcaagatcatcttctaccaagaagtgatctcaagacacaaaagctcattttttttaatttacattttagtgatacatgtttgactataaattagctaaccacccatcacctaatgttgcgagaatctaagatattgagctcactcctaagctcacaaaatcttttctcatctaaaggcttggtgaaaatgtcggctaattggctttcggttctcacatgtgtaaggcatatgtctcctttggtcatgatctctcaaaaagtggtggcgaatatctatgtgtttggttcgagagtgttgaatgggattattggctattttgatggcactctcattgtcacataggagtgtgatcttggtgaagttgtagccaaagtcttttagagtttgtttcatccaaaggagttgggcacaaaaagaaccggcggcgacatattcggcttcggcggtggataatgcaatggaattttgcttcttggaggaccaagaaacaagggaccgcctgtcgaaacaagatttcgacaataataaagggggtggctatcaagctaggaaagtggatgggtttggagacaaggaattttatacaggttcaggccttcttattcaagaagtaatactctactcctgtccgaggatgattccgccgagtgtattattgattgtatgattgggagaaaaaagaatcgtcccgagaggaacccggacccctccttatataggggaagggatccgtattacaaagtacagtccatatcctaacggaatatgggattgtagataaaatacaatcgtaaccgactaggatcccgggtattttcttgacatacaagtttagaatctaacccgagtcctcataaagatattctatctatatttggtaccgtatatccagctggaatataaccgccatgtagatatggggtaaccataatctccacagtagcccccgagaccttcgcagttgaccaaaatagtcttctcgaaacaaaaaacaataatccgagtgcttcaattcaacttgcttcggcttgccgagtgctaaaagactgtgaagggcgaaaataaaacatggtgcatcgagtagatgcacctaattaggtgtacccccgactatgtgattagttgaaaaactaaacatatagtcaagaaacgagtgattttatatcgaagcatgcatggtactcaataaaatacccagccgactccttcttacttgaatatatcaaggacaaaaaatatgaaaagggccgaatgataaacactcaaaaggtccaaaaatagatatatttggtaggaatccgagtaagaaactcttaaaatgatccaccaaatatgataaagatcatggtaattaagaagttcattagcctaggctataacccttaccataatcaaaataagcatataacatgctaggagaatgactactaataaactagtcatctcaaattaacccaacaacttttgtagcctaaaaaagcttacaaaaatggtataacacctttctgtcgggcaccttttcatgtgcatcataatcattccaaagaattattgaatcgcgtaaaaaagcattttaacagcatcgggccacatcattgtgagcacatattgccaaagcaaaaagcgcctaagtccctagggatcacaacgggccacgctaaaaacataattgggctgaaatactgtacaggcccaggcccattagtactcccaataccctaaaaacaccgaagtccaaacattgtttcgtcttccccgctgagactctcgccattccccactccgtgctacagtacagaaccgcgccgacgaagctagggttcatcaatctgctccaacccaccctcaaaaacttcacgaaatttctccccacgtccaccactccgattccccattcctctccagccatatctcggaccaaattaaaacatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgttcggcgaagcattcccgacccccgacacacacgaaatcgtggtatttgctcatttcttctatggcggattttctcttctaacctcaagattcttccgggggattctgaacttctacgggattagcttgcatcacttgaatccaaactccatagtgcatattgccaaatttatccatgcctacgaagcttttctgggcattaggcctcatttcgccttgttccgccgcatcttcttcctcaagccccagccaaacaaaagcacaccgtgcgttgttgggggagctggtttccaactcagaggaaccttgagccaaaaatatttctccatgcctttcaaaacctcaaacaaaggctggcatgcaaactggttctatgttcagaatcctgagcgcgcactccccgagtactgctgtcttcctccagtttaccaggacacatggaactcattgcctatgggagatgaagctgctcaggcagtggaattgatggaacgcatgctaaaactgaagtaacaaggtttgcaaggagaacagatcactcggcacttcatcaaaagtcgattagctccaatcaaagaaagatctcgcacagccttcgaatttgacggcaagcatgacccaaaccgtgaagacccagattctcttgacttcaaggtcatgaaggaaatgatgtataagatcatttcaaacgccattgttgtcagctactcacacttgctgccagtcgtaccgttcaatgcattcaatcctcctccaccggtacgtattcatacacttcaacctttctcaaaatatgatcttgtcttcttgttgaatcagttaacaatgaaggatattacactcaggaatttgctttgatgaagtcggatctcccaatcgctcaacgccgatctccccgccaccaaactgggcaagggagtggaggaccaagaattcggtctgaaactcagccaagtgcttctgatccagtcggccagtcagattctcgaaagagcaagctggttctaagtgacgacgaagccgatgataccaccaggaggcctggagaccgagagacaaccaagaaactaccaaaacaggctactccaaggaagaaagcatccagtcgccctgcgccaaagatcaggaagtcttctaggtataactcatataacaatctctcttgcattgatgcgcatccattgcggcaataatactgataatcaaatttgcaggaaaccatctgatatagatccgtccgggaaagactctaacccgactaacgtggacgcaagttcttccaaagaaaccggaccaactgctgaggatcatccaagtgacaatcagccggcaaccgataatgtagaacccggtgatcaacccctgaccggaaaccagtcggacacaggggcaagcgaagagattccagaagtcaaaacccatgcagacaaccctcgtggacaagacgccagcaatgaccggagatctggatctcctttaaaagcatccgagtccactcattgtctgaaaccatgtcgacccaaataactctgaccaattgtctaacctttgttagtggatacattagggccaatgatcagtgatgaagaagaaattccccgcatacaagcagccgaaggttcgtgccctcccattctggtcaagtggtgggatgacaacttgcaacctcaaggaattgtaataaaccggcaaaaagaagatgaagaggtatgcctactgaaaaaggcactaaatcaagcgactcgcattgtaaatgtaagttccttaacgcctgacctcagccatcttgtttaccgtctggctcgagcgctgattaaactgctccgcaaaggattcatcttaggaacgaggcgaaaaccgcaaccctagagaaactagttccttatcttggaaccttcgaagccaccaggagtcaactgcacgaggccagagaacttctgtaacatcctgaaaattcaagacaatgaaaatcacgaaaatttcgaactttttaaaacttttgcatcatgctggttgttatgattgctattacttgccaaactgtaaatgatcaccaagaaagtaaagaaaagaactacatttaagcaatagatatgatttatgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgattttgcaccaagttcctaattgcatttagggattgaaatttgatatattaaacccctccatataaaataaactaacatatagataaattgaggtaatgtgctattgtgttaataacggtctcattagaaaattatagaatctttaataaaccttaaatattggacaatattaaattttgggcaaattcacatttgaacacttaatacggtcacctaaatgcttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttcatttatacaaaatctaggatttataaaatcaaatttacacaaaaaaataggctaaaatggggattaaataggaaaagacactattcatcggccgccaggtgttcgacgaggtcccctaacccagcccctcctctttccccctctctctgtcacctgccaccgcgccgacgtcgccatcgccgtccttgccccgcgctgccgttgccgtcactgcctcgcgccgcgcgccgacaaaaacacgccgccccgcgcccgcgccccacgccgtgccgcctgccgtcgcgttgccgtcactgcctcgcgccgcgcgccgtcggtgtcatg

SEQ ID NO: 35998 - DNA, 6612 bp, Oryza sativa
  unsure (1)..(6612): unsure at all n locations
cctggtgctgtcgtgccgccgcattcgtgaccgccgcgccgccgcctcagtgtgccgcgccgtgcgccgtcgtcgccgccgccgtcgtcgccaccgccgccgtcggtgagccgctgccccccccccctatttgtcgccgtgccgccgggtagagagggagccgagaaagagagaggaagggagaagccgagggagagaaagaagagggaaggaggagagaaaccggaaaagaaaagagagagaaaggagaagaaaagaaaagagagagaaaggagaagaaaagaaaagagagagagaaaggagaggagaaattagagtgggccccacgtgtttagtgaatagtaatccccttcttaatcattattagttgagtctattacatgtgggtccgggtggttaaaaatctaattatagaagttttatggtctcgagtttatgacatgtgggccccacttgtcattagctcttcctatttccctttagaaaataattcagtaggaaaaaggaataaacccggggtcccacttgtcaatggatatgtcttggattaaaaataaatctattatgaacagtagcttttcgcaatttctcggattaattcaaagttgaatctttacactagcataacttattcattttaactcggatttgagtgaaacttgaacctaaattcatctaaattcataagctttccaatgatatataattcactattcaataaaatatatttataattataaattaatcaatatcaaatgattagataatagttaacctaaatagtgtgccaataaataaaaaaaaatggatattgtacagtagcataattatctttaatatgtcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattactttatcctcatattttgtaactaaaatataaacacacatagatgagtctttaacttgtttaggagagtaatcacagagctagttgtatttggaccacttaaaaaaattagttgatacaatgtcatgtgaagtagaatatatatatatagtcggttgatatccattagttaaccaaatagagccatcttaaaatcaacatgtattgtatagcttacagtaaaaagaaactactcaaatatatgatccaataataagatattgttgcttacacatatactatacatcccattatagtggtacggtatagtattaatttgcgtattgcatatatgaaattaagagggagtgtatgacaaacatgtatattagataaatactagttataaatcttgacctcatataattataattatagttcaactgtaaattaggattattcattgtaaaattatgtgatgggataatctgtaaccataatatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatctatccggcaacaaaacctctagtgtataaccgttctatttagatagatgcatgaatagccatttgctagactaaaccacatagtagccagatacgtatctcattcatactacattggctagctcctaaatagaccaccatgataacagaccaccatgataacagaaagattaagaaactttagcccttagcatgttggaacccattagcaagcgcgaataatatgagcaaccttaggtttaacctcaacaaatatattttgtttgtgcatatttgattgttgcttgaatattggtttttctcgcgtataataaactttgtgtatcggttagtcgtgaggcaatgtcagcaacttccaggaggtgaagattgatcaagaattatatcaagaataaggactatcctgagcaaggcaagtcatccctattccttgaacatgtggatcctaattgcgaaaattgttttgttaacaaataaaaattgcatgcaatgatgaccatcctacttggattatgccatgctttggttattgtttacccttaaatatttgcaaccatgtttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaatcaaaacaactgtttaagactggggcggacggaggatttgggtggtatctggaaaaggctagtatcgtccccagtcaattaaggactgagccatgaagttaagcatgaaacgacccccgtacaaccgtactactcgaatgggtatagacctagcggattagatagccgagcggaggcagtatccctgcatagatggttcacccctgagtgaggcaggtgcgctacgatgggacagccgttgaggtagggccgagaggcgtgccctacatcggtgttgtcattggtaggactgccatgagtgtgtgtgagagagaacttaacttgaaccataatttaatatgtgtgtgagatttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggcgcatgtgttgggcagtcgcggagtgcgggtaaagtgtacatccattgtagtgtgagtaaaccaaatctattcgaatagccgtgctcgttgttattgagcaccgggacatgtattacacttggctagactctaaattctttaacttgtgtgggatgggatattgcatgatgatttttatgctgatggagccacttcctgagaggcgggaatgtggacgccctcagaaaaccataacgactcaatggcgggaagctatccttgggatcataatggatagtggacagaaccgtcgttgtttaatgtgaatattggtactaaaatttgatcagtctatgctaggtcttaggcttgtgaaaagaattgcaaaactagctttatgcaaaagaacctgaagccattccttgaaataccctctatcatatgcatcgttgctgtggtggcttgctgagtacggttggtactcacccttgctaattatatatcttttaggagagtgttgaagagaaacccttgtcggtacgcttgcgtatccaacaagatgatcggagtgcggtcttgttctaggtctcgttccccagtcgactgcctgtggcatgttaaccggacccttatattatttggtcttccgctgttgttctctgatagttgttggcctacctggccctaatgtaagtatttaactcttttagcctgaattcattcgtgatatgttgtgattcaactatgtatgtgtgtaccaactactgatccagggattggtacggataaacacagatgatttccgatttccaaaatcgggggtccacaacttgccaagaagaatgaacacgatctgagggatcggattgctgagctccaggagtccaatttcgaactgagtggctcatcaaaaggttcgcgcaaactctgcccaactaatttgttatctctgtaatcttgattaaccaaagttgatgtagtgcaagctgccaagatatcttaactagagaagcagatccatactctggaaaatgacaaggcagagctggcaaggcagagggattcggctataaaggaggttgaaggtaccaataatcaatacctcaaaagccattatcttatatatgctgattcattaatgtgaatctgttgatgcagaccgcaagatcaagtctcaagcacagtttgatgtcttagttgacaagatcaacaatcttgaaggagccagggataaagtcgctaatgccgctactcccctcatccaggccatgttcttcaataacgccggttcaagtacacttgatgctaccgaaatcttcgacaagctgagagtcactccagatacttatttcaagaacatcaaagaagctggaagtatgggagcaagtctggcgttggcgatgaccaaatccctttatccaagggttgatatggatgccatcgatggctttgcagacgggacgagcgaagaagctgctcttgacctcatcagtgatgcgcagaaagcnnnnnnnnnnnnnnnnnnnnnnntagttgagagattccaagatgtcgaccttcggccgacttggtctgataagtctgatgatgaaaaaactgatactgattgatataacaataattttgatgattaatgatgacggaggcacaatttgtacaatactgatgaatttatgctatgcttgatatcttaacttagttcctgatttcttaaaagtttttgtcaaaccttgttgatcctaaaacccacaaaagttgttaaaaaactttcagtcctcattgactaagccaagaaatcaaacagggcaatgatatatcaagtaagcaaattgaattgatataaatcacacaccattattattatagtagccccctgactgaaaacttcaaggaaaaacttgaagttagcagtcaaagaggaaagatacaaacgaaatgcctaagtgtaaaatcaacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaattttcctcagaaccaggtcaccgactaaaaaggctcgcgatcgaacattctgattatgataacggcgcaacccttgcaaatatcgagtcgactgaattaaagctgcttctcgggcttcttctagtcgattgatgtcatctactcggccttcttcatagccctcctcgttgaagttccgaaatcatagttattcaaattccacttcactcggcaacattgcttctgcgccataaaccaaaaagaacggcgactggccggtagcccgactaggagttgtgcgtaaagaccaaagtacggacgacagctgatctacccacttgccagcgtagggacgtagtcggtcaaaaactcgtgctttgatcccatgaagtatcttgccattagcgcgctcgacttgtccgttactcctagggtgtgccatggaggcataacaaattttaatgccgaagtcttcacaaaagtctttaaatgctccgccagtgaattgagtgccattattagtgatgtccgattaggcaccccaaaccgatgcacaatgttgatgaaaaaatctctagctttatctgctgtgatcgtgatgaccggtttagcctcaatccacttggagaatttatcgatagctacaaagagatgtgtgtaaccgccgactgcccttttaaataggccgaccatgtcaaggccccagaccgcgaacggccaagacaacgggttggtttgcaactcttgggctggcaaatgagtttgtctggcaaaaaattgacaaccttcgcatgtgcgcacaatcttgtccgcatcagacacagctgtaggccagaaaaaaccatgccggtaagctttgccgacaatggtccgtgcagcagcatgattaccacaaataccggaatgtatatccttcaacaactgtctcccttgttccacagacacacagcgctgcagtattcctgatggactttttttgtacagctcagtctcatgaataatgtaaagtctgctgcgcctggaaatccgctcggcttcgtttttgtcttgaggaagttcttctttgctcaaaaattttataaacggttctctctagtcagcttcgatcatgcttatgcctcgagtatccatggcttcgactgtctcttttctgggcacggtcggttcgtaaagatgttcgacgaacacatctgaaggagctgcttcccgttttgatccaaaattggccagtctgtcggctgcctcattgttatgtcggaggacatgggtgagctcgagtccatcgaatttattttccaacttgtgtacctcttgtcgataagcggtcatattatcatctggacatgaccactctttcatgacttgattaacaaccaactgcgagtctccacggacgattaaccggcgaatgcctaaacagattgcaatccttaatccatggagtagcgcctcgtattccgccacgttatgggacgcagaaaaatgtatccacaatacgtagctcaatctttctccagtcggggaaatcaagacaaccccagctccagtgcctgtgagcctcttcgacccatcaaaatgcatagtccaatattccatcttttcctctggcatgtcttcttggcactcggtccactcggcgaggaaatcagctaaagcttgagtattctata

SEQ ID NO: 35999 - DNA, 3389 bp, Oryza sativa
caaatttctagtagtactagatggtcagctttgcgaagaagaagatgtcgtcaatttctgccgaagctccgaaagattgcgggatccgctagcgaagtggagaaagcagtgaagccagctgtgaaggagtgaagatcttggataacccgtcgcagaacctaagccaccctctagggtagagtcgttagtcgtgtgttcctttgcttgtatgtgtagcgcgtggtttgcatcagtgggttgtgatgtaaccatgctaggttgtttgcttaatcaacttgcagaataagcaaaacaaacaacacatcaacaaaaagagttagttcctttaaggtcttgtccctagttctggtctattctttccttgtttgcttcctctctcaacctctacattgtgacagatggataacactggtaacaaaggctatgtgaatgatggatccgatgactcaagaacccaagccaatgggaatgagaaaagcatcaacgaaacctcaccagagctaatccaaattgtggttaaccaaaccaacatgttggcaacagcatttcaactattacagaattggaacaacccagcaggggcaaccaacgttcaagtacctacagtccagcaacagtgcaagttatcagaatttctaaaaactaagcctccaacctttgccattgccgtcgatcctatggaagctagtgattggttgcgcacagtcgagaagaagctggggttgattcagtgcacagaccaggagcgggttgtctttgcaactcatcagttggttggaccagcttcagaatggtgggatagctacgaagcatcacggccagaaggacataccatcacctgggatgagttttcagccgtgttgaagagatcacatgttcccgcaggaatgatcacactgagaaaacgagaattccgctacctgaagcaagaagatttgaccgtcacagagtacctgcatgagttccatcgtttggctcactatgtaccagaagatgtggaaactgatgaagacaaacaagagaagtttctctaggggttaaaagatgagatcgcagtgcaactactcctagaggaatatgaagattttgagaaacttgtggacaaaaccatacaactcgaaagtgagcataatcggatgaagaactgcaagagaaggattgtcagcatcccaacatttccatgtggtaaccaaagacagcgcactgagccacttcagatcaccggatcttctattgcgcatcaagagttcctgccccaagaagacggacacaatgcagacaataacattagcaatactaatgatgatgataccaccaacaaccatgcttcttgccccattagtgaccactagaatcaagcgtgcaatgtcaacatcattcaccaaggtgtcgacgatagtatcaatgatggcacccagaatgacaaccctagaaattgtgatagcaactatggtaccactgatgccaatgttagcaaggatttccaaccaccaattccaactccaagtcagaatgatcgtccccagacggacagctcaataaagaagacgttgatttgttacaactgcaaagaaccagggcatgacttgagggactgtctacaaccaaggcaaagtcggcctccacattaccgccaatttacacgaagcagacatcctaatcgtattgtggtcactggagcaaacgccatacctgtgaggcctcgtgttaatcataacccatagcagaaacaatgtaccgatgctaagcacctttccttttaggcagtgcttagtattcattaataagggagaaatttgtaatatagacatgttctatgaggattcttttggaagatgcggatatgggattatgtgtataattgcttactaataaaggagacctagggtctcgtgtcagaggaactatattctaacctcgagttaataaccaacctgttgatggaaaagaaaaccaattaaactgtgttggattaaaaagccaatgagacagtagttggggataagagtttggatacgccttttacggatcaagataaggattgttggatgaaacccataagggtacctcccatgcctctacattgataagttcggatatacctgcaaacagttaagaagatctaggagacatcaatatttgagaacatagtagtcgatggttggtaattagtctatcaggtatcagaaaaggttcaaaggtgatatggcagaagaacaatttggatgctccccatctcgaggaagcactaaagatgatcatcggcaattaaaccctagtggcatagatacagatagcaagcgatgtatttccctgaaggtagtcagtgcagctttttgacgaaccacttcaaggtttcactgaaaggcagcaggccaaaggacctcagttctctagccggaaagaagtaggccgaaaggtgattgataaaggataatcagaagcatgctttgcatcactcgaggaagacccctgatcaccctgcaatagtcaccttgtcattgaggtagaaaaaaaaatttcatgagtaagcaagatgacctaggtaaaagtgtttgtttgaaggcaaggaatgaaatctttaactcggtatcagatgctacacggagtgaaaagtgcaggcaccggttaccaggcaatgccatgtcttggaagatgatccaatgggaatgaacccttcaaggtcgaaggtgtaaaggaatacgttggatgctaaataatgacaacatgaagataatagtgggataagttggttctgttgagaaacataattcaaaggcgaaattatcgacccttgcatcgaatagcagaagtagctagcacccggagaccaggaaagctaatatgaggcagttggtggcaagttagaagtaaatgacaaacatgatattctcatgatgacaagcatggtatcctagtaatgacaagctgatgtcgacgcataacgtgaagtgggtaacttgtatgaggttgatgccaaagatatgaattataagaagttctggaactaaagccccatcttcaagtgccacatcccagtcgaagtcagctaaaggttcaaccagggacaagtcaggtgaagagaagattccatctgcaagaggagatcgagccaagcagtccagagtggagaagttttgctaggcaagtttgttatagaagacgcgacggaagaagtcagacaagaagagaagactgcccaacctatcttcttgctagcctcctcgaatctcggggacgagattcctgtaagaggggtggatttgtcacgtcctgataaattcatcccgaaataaaaatcattctctaaaaggaataatagaattaattaaaattcaaaaagaaattggcaaacactaaaatacgtacaagaaaaatttgaatgtggt

SEQ ID NO: 36000 - DNA, 748 bp, Oryza sativa
tgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggagacgccgaagctccgcgatgactcatgaatggcaccgacctcggccttgttggtgatcgggaaagacaagcctactacatgccgagcgaccgggagtatgctcacacacgagaatactctccggagctgctgaaaaagataggtatagatgttgaatttcgtgctatttggaaagttgttggttggcagagatttgttgtggtagatgagcctggttctcgtttgcttactttgcaatttctgtgcactttgaaagaaatagaagatgtaatttcctttcgctttttccataaggagtatacacttacatggaaagggttaagcacacattttggttttcacgattcctgtaaaatcgatcttcagaaaggaatttttgggttcgagaaaaataggttttgggaagatatttttggtggtttaatttgcaagaaacctaggacgaatgatatccataatgctacacttagggtcatgcattaatggattgctatgactttggtttctagaggtgatcttagacccattaagggggatgaattggaccatgatgtttgccatggttagaaagataaaaattgctcctgtgaaataaacaca

SEQ ID NO: 36001 - DNA, 663 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccggcaaatcctgcgggaaattgtaatcccattcaccagctcctacatttaataacaagagaactat

SEQ ID NO: 36002 - DNA, 330 bp, Oryza sativa
gcagaatgtggtggcccccgcccgtttcctgttccccaagaagaatctatactactccttttacacctcatcggtaatcggtcgtccgcgtaccattcaattcgttgatgatgcgggtgtaatcctggaggagcatcaactggagacccccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggc

SEQ ID NO: 36003 - DNA, 403 bp, Oryza sativa
atccgttggatcgtttgcttttctttgcctttcttttggatttctttccccaaccaatctaaactctagggtggctctgataccattgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgcgccccctcgatcggttagggtttatggg

SEQ ID NO: 36004 - DNA, 12125 bp, Oryza sativa
  unsure (1)..(12125): unsure at all n locations
nnnnnnnnnnnnnnnnnnnnnnnnnnnnnnnnnnnnnnnnnnnnnnnnnnnnnnnnnnnnataagactatctccctaaattattgggtggaccaaacttgtaaggcgtataagctgcaaactgttgtcttcagattcttacagcttgagttcaaaagctaagataataattaaagcagttgcttcgtggtagtcccttatacgttttcaattggtcagcctaatttaagctgagccaaatcaacaattaatgaaatactcatgcgttacaaatgaaataactgagcacaaatcaataagtagtgttgttacttcctgtgttagcaaaattaattgggaacaacagacctttcggcatgtggttattggatcatcagaataaaatggtggataaccaacaagcatctcatacatgattgcacccaaagaccacctgtagggcaaaagaagtacattgataaaatctagttatcaagaatcaataaatgtggctgaacataaatttgtgtacatcataccagtcacattccattccatatcccttctttagcagaacttctggagcaatatagtctggtgtcccaacagttgagaatgcctgtgtatcaaattgcattttaagaatgagaagggctgtcaagaataacagaagttgtattcatattttaagtgtgtatcccttccaagcatgggattccacatgatatcatgaaagaaaaacaaaactactgacaatacagggtcaatgggatgcttgttgtatacactgtaaagcagacataccagttttcttctgttcatctgccagtgctgaagttgttcatgttgacttctccaccttctaccatttgttgtttcagagaaagagctatcgatatccattgattccctcaaattgtcatcacccatcggttcatcttcattcaatgttgagagctttgaacaatcaattggcttgcacagcccaaaatctgacagcttcatgtgaccattcttgtcgagaagcaggttgtcaggcttaatatctctgcaaaaagataacaagccaaagcatgtagatcagaaaaagggtagaaacagaaaatatacaattatctttaaacaaaaatgttatagctggacattatggtataatatatcagcggcgtcacaatagagataagtcaggaattggcaagtgctacagcagttggagaatcctaataagctctctatttgagtttcatagttttgtagtaagagtcctagtagtatcaggttactagtatgtttccttttcccttatctagaggcacctcaatatataaaggtaggctagtattaacacaagaaatatctaaaggggattaacacacaaaaaaaagtaacctgtggatgtagttgtgtttatgaatggactcaatagcaaggatggtctcagcaatgtagaatcgagccacatgctcagttaaggtatcctctctcatgagaagggtcatgatatcaccaccagggagatactccatgataagataaaggtactccgaatcttgaaaagaatagtatagcttcacaatgcagtggctagcaacttcagccagcaagtttctttccgctctaacatgttccacctgacagatataaatgaaaggttgttaaacatatcataaaaggtagcagtctttttgctaaattaggtcttgagaagccctacaagtcagtttacaacagaagatattttttacaaacatgaaaaagcaattaactatgtgattctgttaataaaatacagtcatatagagatatcatcacatacgtagagtaactatgacaaagcagttagacatgaaaacaaaataccagtggaacccttgtggacttcacccaaacaatggactgaacaaaacaagaagattatacaccagcttttgctttctagcaacttcaaattcaaagcactaaaaaaatgcccatgactaatgcataacagcaatggtagaatgttactaaatgcaaaaggtcctacatgttatgaatataaacatgtactgccaatcttttgtgttatcttagttttaaatataaccttgctgtttcgatttcacaattatgtcatatttattactttgtggtcaaatcaacaaacgtggttggagatggttaaaaactatgcacatgctactaactcacaattatacctattaaaacataaaacctggaataaatccagacaaagttatcttacttgacccctgacaaccatatcagacttctttagctttttcattgcataaatgttgctagatgtcttctcccggcagagtcgaacctgtcgtatagttaccgcaagtcagtaaggggttaaaagcaacaggagcaataaaataaacattacaacagataagcattaagcaaatatgtagtagatcaatgtgcaaacctctccaaaagctcctctgccaataatggtgagcagctcaaagtcatcaacgcagattttgtgccttttaagccgcatgtactctgtttcctttctctccagatcttttagtagattgatttgctgctccctgggaacttgggaagattccagttgtcgctccaatctaaagcgcctgcaatgcataaggtcttactatgtgacacaagaagggcaaagatttctgtctgggcaggggaatgaaaatccacttagaatcaaatcatagtatctaagtatgatgaaggataaaaaaaatcactcaagttacacagtaatagaagatggttgacgactgaaactaaggtatgttactctattataagactaatacgtccaaactctaggggtgcaggccagattgaagccttgaggaatcgccagctttagttgatataagatcaatatcagaacaaacctccatagctggtaagttaaatcaactgtttgatttcgataaaagattataacaatgttgttagaaatgaaaattgccacccctgttacatacacacctcgtatactaaaatccattataaaatgatgaaatgaatcctactaaatcgtatctgccacctagcattgtacaaatgtctttcactatgatgtttcctttcgataaaaaggaacacacaggtcttctgcccttggtaaaatagcgcaccaagtcaccaagattgggcaagctattacgttacatggactctgactgcaaatagagtaaattaatagaagtgattaatgaaacacaggcatacgtcgtgaagtgcggtatcaaccacgtgtacacttatgaatcaaaattagtacgtcatcaatcacgcgttcactcacaattcaaactatcacataatatgctctatttatgcgcacctacttgctgaccaaccgcttaatacaaacaaatgatatgcgacaagtgtattgtcaacggcacttaaagacagacataaccgtcgcatccacacaacatttacagcacatttctccactgaaaaccttcatgacagcagcatacaaaatcaagtcaaccaactaagcaagctgttagatagtaacactaagctcagttcaatttttttcacgcctattactccatagaagcagttacaaccatttttgcttggcgcaaactgagcagacgctaagcattacaaacaactagcagaatcaagtaccctcacagctaaatcgtgctactccaaccccaaattgcttaccgagcaacaattcgagaatctacggttacgccacagtagaaacacctcaaatcgtggctagcggagctactgctacacgactcctactccccccgcattcctcaagcacacgcccaaaacttttcccccccaaatctagcagctcgagtccccgagctccagcgccccaagctctaaacccgcccagcgcagcccaaacccgtcgatcgagctcccaccactcgagatctaccccaaacccacgctcgcggcagcagcagcagcagcagctaaaattcgagcccgaaatcgccaccgcgcgggtggggggaggggatcgggatcgggggggtggattacctctccttgcgctcctggatgttcttcatctgcgagcggtagtggttctcgatgaacttcttcgccgcggcgacgcgctccatggtgagggtggaccccaccgccgcctccccgccttcctccccttcctccgccaccgccgccagcggctccgccgtcgccgccgccgccaccgccggtgccggcgccgcgtccgccatctcgctctccatcgccgccgccgccaccaccacccaccccctcgttgcctcgctggtgttttttttttctctcccctctttttttttcgctgcctcggtgagaatcgagtcgagacgatgagttgtttgttcctcctctcccttgtcgctgtgcgcgccggctgtatatatagagccccgtggactgcgccggctggagagttaattaattaaacaggtaattagtgtgggtgattaaggagctaatggtgggggattaactgcgtcgacgctggtgacagacagacagctccagttttttttttttttttgctttccttttgatctctctctctgctgtgttgtgttctggcacttttttttaattattttgtctttgcttgtgttgttgtgtgatctcttctgtcatgtcgcatgcggatgctgcgtagctgtacacacgtaggcaaaaggggtttgatttggagttcttcgttgggttaatcgatttcctttttgagggaacaagatgaacaatgttcacaagataaaatgcattggtgtctttttttccttctcttttgttctcggagcaacatgtatggacgttggcttgtaaaaaatagggggttttttttagtgaagggataatgatgacattcggctctggatgcgggatgccatgatcatcatatgatggatgtcttaggttgatgagtgtgtgaatgatgggcataatcttaacgtataatccaaaacccgatgaaaactatggaggattctttggatggaaattcaccacctatttattcttatataaaaggaatcaactataaatgtgtgttggtacgtttcttttaccctccccaccctccccccctcattttcagttctacatgccttgtttttactgcctttctaattatcaccttatattatttgctctacacctttaaatatatatttttcttaaaaatatactatatgttctattaaaaatttaacttgtcactacaaccaagaagatagtcgacatcaatcccacgataatctctcaagtgatctaaagaattgtcaaaggtagaagggcatgtatggtttttgctgtccatgacgagagagggttgcattggtaaagaaaaccgtttagctaacacctgtcaatatttcccttttcaggggtgtcttcggatgagacctgcctatcacgcgcgtaaaacaaaatgatccattaacatgtgattaattgaatattaactataaatcacttaaaattgatcaatataaattttgaaaatattttttctatatatatttattaaaaaaataccgtttggcagattaaaaaacgtgcgtatggaaaaacaattgagtacaggttagaaaaggggagtcccgaacggtgtacgttgcaccgcacacgcgacgcacgcgcctcggttaggtaggcagctcgaccagaccagaccagagcgggtcgtcgtccgtcgctcacggcagccgcagcgaccgacacggtcgggactgtgaaaagggctttacacaccacaccaccagggtccaggggtatcgcatcctcgtatcgtacgtgttgctcccttcgtcgatagcaccaacacaacgcatttgcttcaaacacatgtcggtatcgtcagtacgtcgtcgtcgccgcatcggccattcggcccaattagccggagtcgatcgattcgatcgccccctgtcaaatcgcagccagcttacgagctcacctaatactcctatctatctacccgtacttaattagccaactcatctagcttaatcattttctcttcgtaggccaaagcacggtagaagatgtggaggaggaataatttggcatcttcttgttgtgatttgtgaatcgagtgatgtaagatagcaagggtctgtttaggagagtttatgattctgagaaacagctggttggtagtcagttcgtgagaatctggaaaagctaggtttctaacttctgtcttctaatttatatttaaaattctatatctagagtttttagaatctgaatcaagagttggactgtttgaagaagtttctggtcctaaagaagctgcagcgattaaaatctctccgaacaggatcaaagagagagagaagggaagagagggagaggcatggcaaacggcatgggatgttggggcgcggcggaacagggcgtcgcgcgaggcagaaaaaataatgcggcgtccaggctgggcggctacaggatgaacaggtcgcgcgtgtgatgtgctctctctctctctcgcgtgtcgatcgccagtggacggatcgatctgtgctgcaagctgctggtgcagatgcaggtgccccagctcagatgccaggctaggccgcagctgcgcgagagagaggccaccattattttttatctccatttttaatgcccatttgccggatctccgaactcacctcacctcacctctttggattccaagcctgtccagcgtgttagttaggttttttaaatattttttttgttgctgtgtgtgctttgctttatcttacacacggatgaaaatgggtagtgaaaatcttctgattgatcaaggatcgtttcgtaaaagatataccatttccattttctaacattataaaagtttggttattctaatttctatcatgcgtcgtattataatcaccactaaatagttattaattattataatcaccactaaatagttaaattaatagtaaatgtatacattataaactgaccaagaatcattttcgtaaaaattggattgttttcgtccctaattttatggattttttttttattttgttaattaaggtggatccctgacggttggatcagcgtgtgtttcggagatgggtgtagtcgagattgagcccgtaagggcaggtggtacagtgtgttgtcacagtagcgtacgtttgttgcttagtacttcctccattccatcatttgtactacttttcatttgtcccaaaataaatttaattttatagtaatcattatatcgaagcttgtaaaattaggaaacggttgtactataaaaagataaagtgagaaataattgtattgagatttaataaagtagagatattttagttttcttatttttattggcatgtgtaaaattgataaaaaataaacttattttaaaacgaaaatagtaccactagcgtgagttgctggtgaatccgtgacagtgccgaactggctgttttccactcggcgcgagttcagacgatcggataactatactttcatgttgatgaggtgacatcttcttgtacagagtcaaataaagaagacatcgtcatcatgatgctctcgtagagtcaagagaaacctaacatttctcagaaaagaaaaagggggaaaaatcctaagaatgtgtgatattagccgaaggcccagagaaatcggcccaaactttggaaatagtcaaggggcccaaaaagggaagcgtatggcgtacggttcctgtctgaaaacaaagcccgtctgttgaaaatgtgaaggcccatgagatatggcccatatattggcccgtcatcttgcctataatgttcccacgacagtgagtccaaaacatacttgcacttcatcacgcgttccattttcagtttttttttctttccatcggatgtctccgaactccgaagagactcaggttttgactccaaatatgatacgcgcgcatgtggcttttgtttggattttttgcgcatgtttttcgtttgagataccacgagtttggtcctgtttggactgtcgacggagaaggttattccacacttattctaattgtcacatctcgttctaagtcggtcttttatgggacggaataagtatcttttcagaattgagttgcttccctgtagattttttgtcgtgttccaaaatagcacaatgccacaaattcaaaggtacccaccattttcagacgagaggagagcaactgtagtgattagtgctactattatcacgtaacacatgcataaccccatagtatatccgtatatatgcagctatgcttgaccgattgaccctgcagcctccgctgcgtccgaccagttcccccatcgccagccacagcccactctcatatatgattccaatgtgaccgaccgcttgttgccacatcaaccagcaccaattaaagctgcatccacacgtacggacttcagatttgagagtcattcgatggcgatgggattgaaactgcacgaattacggccagtctcgatcgctcagcttgagctagctaagctatggtacggggcacttctaagggcccgtttagttccaaaaagtttttcccaaaaacattatattgaatctttagacacatgcatagagtattaaatataaataaaaagaaaatctaattgcacagttataggggaaataacgagacgaatcttttgagcctaattagtccgtgattagccataagtgctacagtaacccacatgtgctaatgatggcttaattaggctcaaaagattcgtctcgcggtttcccgacgagttctgaaattagttttttcattcgtgtccgaaaaccccttccgacatccgatcaaacgtccgatgtgacacccaaaatttttttttccctaactaaatacaccctaacttgtgaacgacgagccggtgaattgactgaccagaggcctcgagtaatagtagtagctagctacttcctccgtccaaaaaaaaaccaaacttaacatggttgggacattacttaggacaacgaatctagatatgctttgatctttttcctattttaaacttttaagtctgactaaatttacataaaaaaattaccaatatctataccaccaaattagttttgttaaatataacattgaatataatttgatagtatgtttctttcgaaatgctactgtccttttcttttataaacatggtccaatttaaagaaattttacttaaaaaataaaaacatattataatatgaagaaggaagtacaactaatttgagatacttcgcatctaaggctgtgatcgggaacccctcctccccggcacgcaaaacaaagcacctattattgtatgattaattaagtgtttgctatttttttttcaaaaatagatcaatatgattttttaagcaactttcgtatagaatttttttttacaaaaaatgtatcgtttagcagtttgaaaagcgtgcgcgcggaaaacgagggagtaaggttgggaaagggaggtaacgaacggagcctaagtttagtgctttgattggagccactattgaactactcccttcatttcaaaatatatgacgccgtttactttgcgcataacatttgaccattcgtcttattaaaaaatatatgtaaatgccatttatctttttgtgacttgcttttatcatcaaatagtatacttttacatatttatattttaaatttttaaataagatgaatggtcaaacattacgtgagaaaatcaacgacgtcatatattttaaaatagaggtagtttatgacctaccctgtcagccacccagccgactcaatgccaacttgatatatatccggtccggcgaaaacacaatgcaaaaagaaagaagaagacaaagagagagagagagagccactggaggtcaggtccaaccaacgccctcttgcttcccccacacgtcgcagccggagaacccgacagcgacggcaagcgcgcgggcgcgaggacggacggcgaagcccagaaaccccccggatcgagctctctctccgcccacaccgcgtcgcgtacttttcggcctcgtgcaacacaattactccgtcacgagccgcgtcacccagccacacgtcacgcgtggctcccgccacgccccgccccgccacaccggccgcgtacgcgcgcgcgcgggcgtcgctttcccctcccgtccttttatttttgttttgcaaaactggtcaatcaaacatcccgcgcgcttgggttttctttaccagtaggattctcgccacgccacacgctgcgtctgcgtgagtgcgtgcgtgcgtgcgcgtcgcggaggggcacgagacgcgctgaccaccaccacgcggccggcgaaacgtaaaacgcacccccggcccaaacatggaatggaatcatctagaattccgtgtccttaattccacccccgtcaacacaacacgggtgtgcgacagtgtgagcgtctgcacggcaaattgggcagttggcaagccgtttctaaactaaaaacacgaatattaaaaaataagcaaatatcaaataaataaaaagggtgagacttcgaactcagactagctaactcaccatcttgtagagctagccagaagatctcttggcaagccatttctatggggttgtttcgtacatataccaaggaaaataaagatatattaaaaaaaatcaaaaatcatagaaatacgactgtaaaatactccctccgtcctataatataagagactttagatgtatgtgacatatctagtactttcaatgaatctggacaagccgtccaaatttattgtactataatgtgtcatatctacccaaaattatattataggacaaagagagtggtaagtatatacagtgatgtgtatgtttggaacggaggaattttaattagaagatgtatcaattactccatagcactaatcactttccagtcatacattatcatgaggcaagaggcaacaaccagcctcatcattaactgctcgttcctgcccagaggaaaggaaaacatgaggttggaccggacgtttttatttcctgtgtttttgcttcaattcctatgaaccaaacatatatatagctacgatagctttccatagaaggaactgccctctataaaaaaaattcaatcctatctataaatcgacatatgcgtacgtgtacatgttcgtagctagtaccttttaaaactccttggaaaatcttatgatccgaacggccctaatggaggaattgatttgagttcctaaacaatactacttctactcctacatgggccaccccccatggtccatggatctgaccattatttgtacgtacttggaataatgctgcaaaagaaacgtgaaacttgcctgctgtacgtatagatctgcagtacgttgcatatttggaagagatacctgtttttgcttgtgccatatcttctacactactgctccccagttatggatcagccattcatggccaccaccattaacatgttgctaatttggacataggaggagattgtaaatatgtgaacacgttcgagaggaaaaaaaaaataatggcagcttgtgatgcattgagtttgtgctccaagttaagtaattactgatgcacgagatatgttactattactgctgctccgttatttacttattttgggatcagagccttatctacgttattatactcctgctttggaagatatactatatttttttagatatattttaatgcttctaaagatgtgaacatgtttgagaaaaaaagaatatggaaactagctgtgtgcattgagttgatgcccgaagttaattataccgatccacgagatatggtactacttaatactgcttctctaaagataatcaggtttggctcatatgtaaaccagatagaaacattagaagtccattactatttcttatctaaaccagctagaaatattgaaagtctactactgtttcgtatcaaaattttgctgtagcgaaagaagttcattgtggtgttagggttgtctatggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgctcgacgtgg

SEQ ID NO: 36005 - DNA, 4805 bp, Oryza sativa
attccatcacagatttacatatagagcatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccgtagcctcatggcatgctataaactcggcatacatggtagaccctgcagtggtagtctgttttgagcttttccatgaaatagctcctactgccagggtaaacatgtatcccgatgttaactttatattatcttttgcaaagtcagaatccgaataccccactatctggagcgattctgcttttctgtaagacatcatgaggccttttgttccttgcaatcacgcaagactttctataccaatttccagtgctctaggcctggattacttttgaaatctgccaaataacccggtaacaaatgccaagtcaggtcgtgtgcacacttgcgcgtactgtaggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgctttaacccataaatggatctctttatacggcatcccatatttttgtttcctttcatgacaaaacctttcggttgcgccatgtatactttttcctccaaatctccatttagaaatgtcgtttttacatccatgtgatgtaattccaaatcataatgtgccactagtgccattataatcctaaaggaatctttacaagagactggagaaaatgtctcattgtaatctcttctctttgcgtgaaaacttttgccacgagtcgcactttaaacttttctatattccctctagagtcatatttggttttgtagacccatttacagcctactgttttggctcctttaggaatttcttctaaatcccagacatcatttaatttcattgatttcattttatctttcatggcttctcatggcctcttcatatgagatgggatcatcctccatatgcgattctttcaggccttctaggggcctcctattctggcacattatctgtttgaggctgtttcatctcctcctctgatgtggcaataatctctgttgaatcctgtagaacaggttcctcactttcattcattgttgccacaggagagataacaacaggtgttggtaccgcaacggcatgcattgctggcacaacattagcaggtagagagaagaaaggttcctgagtcgacggagcgggtacagacacccgcctctcctcaagatcaatttctcgaattaccgagctccccctaatcatttcgtcttccaagaagatgacgtgtcccgtttctacaaactttgtataactgtttggacagtagaaacgatgaccctttgatcttttagaatagccaataaaatggcagcttactgttttgggttaaatactttatcctttgcaggactcccccacacacggaggatccatagctcatacggtgttttgggcaccgatgcattctatgcattgtatgcattgttctaaaactgagaactccaatggaggaagaattacattcttaaccagtctctcaattctccccctcgaaatatggcctaaacaacagtgccataatttcgatgagacatcaggagttcgctttcttttcttttgtcaacgaggacacaacattcacattctcagaaagagataacaaataaaactgatcttgcaacataagaccaatacattcattattataccatagttcacatttgccatttccaaaatggcaatcatatctatcaaaatccaatttggatacacttattatcaagtttctttgcaaagaagggacataaaaacgtctggaagtaaaagtgtgaagccattcgcgagttctaggcgaagatctccaacagcctcaacttttgcttcaactccattggcaactctaatggatctttcacttctttgcatagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaggatgatctttcttggaatgtcttttcttgcaatgtagacactgatcttgtctcaactgtaaactgttgcttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccatctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttgtttacgctctgtaaaattctcccgttggttcaaatttaaacagagataaaacatgtaaaacaattcaaaattctattgtaatttgcatgaaaaatacaaaatacatgttcagaagcatttctcacatttatctattctctaaacaattttcacgttggttcaaattgcttagaaataaacacaatcattaaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttcgccaggccgcaacctgggcctgggccgggaaagtggcttgccgtgcgctcccacatgggccgatttcggtccggccgccgtcggccgtccgatcgctagggtttcgatcggacggtcgcgcgggcggatcgggcaaacaaaaccgcccccggccgccggcgccgaaaacctagctcctcttctcttctttctcttgcggttgcacggagcggcgtcgccgtcgccgaaaccctagcacagcgccggcggcggcatggcgacacggcggcgccgtcgcactccccttcgccgatgcgcgcactcactcaagggtgagtgcgccgccgtcgagcggttgtgccgcggcgccctctcctttctcttgcgggcgtgcgccgtgccgagcggcgtcgccgacgccggcagccttcgcgccgccgcgccatggccgacgccctcgcgccgccacgccctctattcttttctcttctcccccccccaccgtctcacccctccacgcgagtgaagagtgagagaccggcgacgacggagatggtggccccgccg

SEQ ID NO: 36006 - DNA, 60197 bp, Oryza sativa
ccacccctctttatatggcacagtgtgacgggggcccaccagccattgggctgggcgcccccgatcagggcgcgggtcaaggcccccttgagccgttgggctcaaggggagggagatccatctaacatgtggcattatcttccatgcattaatctggggataacgtgttatgtatcctgattttctatcccgaaacatataaacgtgtcaaatgtcgcattaatttgttcaaaaaaggacaaaatttcctttctttcaaaaaaagaaaaagaaaaattgctactccagttttctacattttcagatatatgtgttgctatgctagaaccccagcatttcacatctgtatagcgtgctctagagacaagttgaatctgtggttatacaaagttcttcagtcaacaatgatcagtagtacataattttgtcatggtacaaaataacaatactgatattgtttaactcgacgcaggacaccacctccttatattttggaaattaactatcaaactctacttataagtcattcgatctccgctcaccatccgtgcacctgattattataaaatattaaatacggaacatgtttgaatccacgataatgtatatagcttaaaccataataagtaattgcgcactaggccccaatcccccctccctgcgccataccatatttaatgcattcctgtcgtgctcattacgtaatctcgcacccacgcaaaaagaatatgcaaatgcgtgggaggatttttactacaaacccatgcatcgtcaacgagaaggggcgcgcgcgccaccacgtagattatcagaaacaaccacgtatacttcaactttattataaaaaaaacatacatatagcgaaatgccaaggtacgtagcagcagattgtggccgtagcaacgtagctcaaacgttggtcaatccatgtgcaattacattacctagtaaaataaaaggtaaaaaaaatgccaatcccaaacggcacaggcgcacagcatttgaatattacggtttagaataatccccaacacggctcatcccaacccgtacggaacagcttgacaacagcagagtacgcgccactcgtgtgtacaacccccgggtgacccaagccacgcacgccaacgacgacagcgccacctgtcacagaagaatctccctaccccctgtcactgccatgtgggcccatgacgcgcggccaccaccaaaccaccaccatcccgaccaatcaaacggagacgaggcgacggcgacgacagcgacagcgccgtggcagtatactccttgccagtagaagcatccgagacgtgacgtcacgtcaccccgcctttactcgctttctccgttctccctagccgcgtgagccgcggtttgcatctcatcttcactcgcttgctctctcttccacccgctttcctcttcctcctcgccgcgcttccgcgtgggcccccatccccgttacctatatatacccccccccttctcaccgtctccttcctccctccaagtccaagtgaccaaccatcatcaatcatcgctaagcccacctcggagatctcgagttcgatcgtcgtcgtcgtagctgtagaggtagttaattatctcgttttagatgagctcactgacggcggcgcagttccggtcgctgtttgagatggcaggaggggaggatatctcgtttctgtttggtgatgatgaggcggcggcggtggcggcgccggtggagttgcaggggaagagggggtgggaggaggtggatcaaggggaggggtctggggcggtggcggcgaagaggcagcggtcgccgacgagctcgagggagaatagtagcgggagtaatgagggtgggcaggaggaggtgtctgaggcggcggcggccatggcggcggcggtggggaggggtggggggaggaggctgtgggtgaaggagagggactcggagtggtgggacatggtgagtagcccggattacccggactcggagttcaggaaggcgttccgcatgtccaaagccacgttcgaggtggtctgcgacgagctcaccgcccccgtcgccaaggaggacaccatgctccgcgccgccatcccggtgcgcaagcgcgtccgccgtctgcgtctggcgcctcgccacgggggagcccctgaggctggtgtccaagcgcttcggcctcgggatctccacctgccacaagctcgtgctcgaggtatgcgccgcgctcaaggccatggtgatgcccaaggtggtgcgctggcccgaggccggagacgcgccggccatcgccgcgcacttcgaggccatctccgggatctccggcgtcgtcggcgcgatctacaccacccacatccccatcatcgcgcccaagtccaacgtcgcctcctactacaaccgccgccacacggagcgcaaccagaagacctcctactccatgaccgtccagtgcgtcgtcgactccaccggcgccttcaccgacgtctgcatcggctggccggggtccaactccgacgaggaggtgctcgagaagtcggcgctgtacctgcaccgcggcgttcccggcctgatccagggccagtgggtggtcggcggcgggagcttcccgctcatggactggatgctcgtgccctacacccaccagaacctgacgtgggcgcagcacatgctcaacgagaaggtcgccgccgtgcgcggcgtggcgcgcgacgcgttcgagcgcctcaagcgccggtggggctgcctccagaagcgcaccgaggtgaagctgctcgacctccccaccgtgctcggcgcctgctgcgtcctccacaacatctgcgagcgcagcggcgacgccgtcgtcgacgccgacgactgcgccttcgacctcttcgacgacgacatggtcgccgagaacgccgtccgctcctccgccgccgcgcaggcccgcgacgccatcgcccacaacctcctccacagcggcggcggcgcatccttcttctgatcaagcatcatcgccgttcttggtccgatcaacagcgataccaaacaaaccaccaaaaataaaaaagaaaaacaagattcagtttttaggtgtataggaggagcttctccattttttgtcggaaatggagcagtgaacagtttttcgctttatcgtcaggagggacaggaaagttcagagtcctagtagtctcaaagtaacattagtttcttggttggattttcgattgatttggttcttttagatcttgagagattgtttttcatggggttgtaattaattgcctgcataatcttgtatcccccagattatcaattaatcaaacctgaaaaagaaaatcatttttttgccaaccaaatgtatcagaatatctttcactctttctgcgtgggctcgtgcttggatcgattgtgctgttgtctgacggatatctttgaattgaccaaagtcagagcaagaataatcatccatctccttctttgtttaatgagaaatcctcaagatgtattaggtggcagcgtgccattcatagccgtactaatgacctctctctacctgataattggggatggattatgaaaagaaacagatggggcatgcccagtcaatgtacaagctggcaatgctgggataactagctttactattttactgaccttgaataattacaacgcagattacaaccactagtttactgccttgaataattacagcccaccttggataaggatgtgttcacagcttgttaccattagagaatggtaattaatgggggatctctacggtgattacacactgctattgtagctatggtaattaatattatttctctgttggttgaaaatggaaaggaggtatacacttatattacaggaaccagaaattcggggctcgaatctgaaatttgaaaaacgcaaaacctgctggcacatatatgctctgggctgtttaattcaagtatcctacaactgttaacaggtattccttccagacgaaattatttaacgtttcggacagtgaaaatggcttacacctagtagtatttagctgtcggaaaagtcagataaattcagggaatagaacaattgaagattaatcgcaggccaccctgatttgctgaatgtacaacctgctctttgcaatttcagtgtaccctgtcaatttcgtcttcaacaaactcgcaaacaaaagctataatcagaattggacttgaagatgttacaatcatggagaaaagaaacagtgcagccaagcatgtctctcatgtgactaaaatccatagatgtggatacacacgctgtaaagccatgtggatgcaatatgtttgagatcctaagaaatccgttgaccggattctataaggttgacctcttgaacacacacacaaacaaatacacaatgagattgtgtcactgtcagtctgtcactgatcactgctgatactgaagatctctcttgaagactagtactccacagtagtggatttcactcgagatttcagatcatggtttggtttggtagggtttgtgcactgttgagatgaaaaggaaagcgtttgctccctggaattaggcactgggaatggcatgccacggctgaggaaaccgtgccgaccaaggtgtgtatgaactcgcaatcaactttcagtgttcccttttggaaaaatgttacactgaagaagacgacgactggaagacggaattatatattagttaaaaattccatatcaatccaaaaggaggctacgtgtaagtgttgacgtttatgccaggtgaaaaagaaacgcgttgaccctacagattattatccagctagtggtcggcgtcctctgtgactctgtgttggcgagagttggtgtctggaattgggcttggtgagctttggaattttgggccggccttgtaatgccagtccaggtgttgtgcagcgagcacgggacatcaaaaaatttgttactgggccattttaaacgaaagataaagtccagtttgaacccctctggatgcatctggttcatatcctcaattcatctcctaccggtagatgaatagttgagggattatcgatggacattttccataatatagtactggaagaggcccaatcctaacgctaactttaataggcctccagtccatcaaggcccataatctctctctacaagtagaagagagtattttcctattttcggcgatttcgagtgcaatcagccaaagtaaaacgaaccctaggtttgctttcccctctcctctcgtgcgcgccttcgtcgtcgtcgtcgtcggcggcggcggcatggcggacgacggagacggcgactgcgtgaacctggagcctttcttctacgacgaggcagcgaccgtggccgaggcggcggcggcggcggagaggcgggagcgggaggagcaggagaaggcgcgggaggcggcggcgaacgccaggagatgggcggcgcacaacgccgccctcgccggcatccgcgagtacgaccccgccgaggagacgtacatctacacccgctaccactacgcggacctgtccgagttcgacctcgacgaggagtcccgcctccctcccatgcgccacaccgccgccacctacgccccgccggcgcgagccctccacttcctctgcgatatgatcaacgtcctcgccgtccgcatcatcctcccctcctccgatcgctctgatggtggtggtgtcggcttccccatcagcgtctacggttctgtcatcgccagagaccagcttgattacaaatgtgtacatctcttccgccgctgcagagacgatcctcagctaatcacctcagaggtacggtacttagcttgttaattcatccattcataaattaatcgcatagtgtacaacacagcatcaatcagtatgataattttaatttgagaaaatttcacatgcgacaaatttgtcgcaaaactatatatttaactcgatgtatcacaaaactatagatttaacatcaaatttatcacaaaactacacatttaaagtggcgcttcacaaaattatatatttagaaccaatttagtcacaaaaccacaatgtttatagcttcaacgtaacaatggtgctagggatttaaactctagaatacgtagttttataataacttcaatattaaatatgtagttttatgatacttggtcttgtatctatagttttataatacgatgacttaaatctgtagttttgtgaaacttactcttttaattaattataggatgaactgtcgttgatattgactgggcctcatcgaggacttgtgctgtatgacgctctgtacattgaggtcgatctcaagatgaaggtgaagggtgatcaacaacaaggctgcaaggacaagcgactcagtaaagggctgatagtgttggatggcgtactgctctcaacaaacttgagcgaccatttgcgtgctgcggttaaaaccgccactcttgataggagaagcaccatgccctgtgccgtgcaggtcacttacgcgtatgtcacgcgtgcagtggaggccaccgtctccgttgagcttctgcatgatcagggaggatgagctcatttctgtggggagatcactgcttgcaccagcactatccgagatagcattgtgctccatgatagcagattactagcagatgatggcattgtggctgatggatctactgtccggctattgcgccgcgtgattggcgtctgtttggatgaggtgctgatagtgacaattgttgctcaagatggtgaccttgcaaaggcaactaactactgcagacaaaccgttgattttacaccttgtgtcaatggtggagacgaagctcgagttgtgggtggtgtcggcagttttcttgtgaaggttatttggtcgttaatggacccagttattgacaagtagtttgttatctttatcatcacgaatgtaggcttttagttgtgtactgattgtctgcaatagttatgtactgttgagaggaaaaagaaaacgtttgctccctggaattaggcactagcaatagcatgccacggctgaggaaaccgtgccggccaaagatgtgtacgaaactacgaactcgcaatcaacgtttagtgttcccttttggaaaaatgttacactgaagacgacgactggaaggtggaactatatattggttaaaaattccatatcatccatatggcaccatttccagcgaagctgatgtgcttagtactccatgcacgacacgtccatgagagtggattctaatccccatagggatatccgctcatgtaatgcacatagctatcccctcatgtaatgcacatagctgtgaaaaagtgttaaatatgtgatccgaattttgggaccacaatatattcggattagttatctaataggactctactttataggattagtttcctattaggactcctagatttctcctatatatattctttataggattagtttcctattaggactcctagatttctcctatatatatcccttgtaagccgcatggggagggtgcgacagcccaatgtatcccctgcgtttgtatccaattcctctatagtgatcattgccggtcggcgcccgtggtttttttccgcaagggtttttccacgtaaaattcgtgttgccattgtgcatctatttttataacaagtggtatcagagcattggaaatcgatctactaccatctcggctgccgacgagttcgtctgcttggagatcccatctgcaagttttagctgccggtacgctcgtcgtaagatctgatcggcagtagtaggcgcgtgtcgtcgcgtcgttccatctatcgctgccgtcagattgatttgtttgccgagataagattagccggtacgaagcggagtcagccgtcgactccgatcgggatttggtgccgccgtgcagcgtgttggagaaaaagcagcaatccatctacttcagcacgttgatcaaggaaagaaaaatcagcagatgcactcagccttgttactgttcacgtgaattgaatttcacgttggttttttgctgcgtgcacatgcctcttcgtaccagggattcaattcaattgcggtgcttcggttctgtttgggtgaatcaaattcaggttcaattttgtgctacattcacaagccatgtttaccaggaggttgtatatggagatcaacttcgttttatacacccagagtgtttcgcgtttctgctagggtttgacaaattgtaccagcagattcaggactttattcccaaggcgagtttgaagtttgatctactgcttctggattgagatacaatattctcattatggcaagtgaagttttgcagcggggtatttacctaggaggagaagtatgctggaaaaaaaaagagaagcacattcaagtcgtcgagagggagcctcgctcctgtctagatcacaaggtgatcaaatttttccggcgaattttgctaccattgtacccaacataccatgaggttatcaggggatctaagtacttcgttttgtgcacaagaatttttcgcgtttctgtttagattccagaaattcatgccagcagattcaggattttattcccatggcgagtttgaagtttgtgcaccagtttcacgtctctgctaggttcagacaagttaatactagcagattcaggatttgttcccaatggcgagtttgaagtatggtctacctcttctggatcaaggatgttatggattatagtccaagtgactatttggcgcacattgatcttatcatcacgaggttgtttagagattgaagatttttatgctacaagggaaattcgtctcaaggtggagatcgttaaatatgtgatccaaattttgggcccacaatatattcggattagttatctaataggactctactttataggattagtttcctattaggactcctagattactcctatatatatcccttgtaagccgcacggggagggtgcgacagcctaatgtatcccctgcgtttgtatccaattcctctatagtgatcattgccggtcgacgcccatggttttttcccgcaagggtttttccacgtaaaattcgtgtctccgttgtgcatatattttcataacaaaaagtctaaaaaaaattaacaatgtagagtatagtaatatctaatagtccatcaaaaatcaagtttaaattcgacctacacagtgagaaaaataagacaaattaaaatgcgaatagtatgctactatttatacgttgaatttgtatgtttatattgttgcgccgccgtcagcaccagtagaggcggcgtcagtgtcgcctatgctaacgatgacgatgtggccaccatcaccgcagcgatcaccgcggtggctagagcgcaatgcggcaaagcacacctacccatctcgcaagcactgtgattgtgtctatgggctacctcttctctcgttttctgttgcgaagcgacgagatatgaattatgaagggtaggtgcgcgacgggcgaaatatgttcgttcctcgtggggagtgagaatgacacgtgggccctattattttttatttttttaagtgatatgtcggctcatggtttttattattttctaaatcaaattgccacgtaaacgcaacatcaatgccacgtgggataaagattagttaaattggtcacgtaggtttcacttcagtcaaaaccggaaacaataccgccgaggggttctcgtttgcactacttttgtaagttagaggatccgttctatctggtttttcggttgaagcaataaaatcggaatcggtttcaagttaaggtatctgaaaagaacttattctattttcttttgagttgatttctgagcaattattagggctggcctttttatgtcagtcaccggtccgtgcgccaattcgtccggccggcctctgggcctccgcttgcaaattgcaatcgcgcgcgaccatctcccatctctccgtcggctactcggctgctgctccgcgcccccgcgacgcaccaaccgagagaccgcgccgcaaacgctacgcctcgtgcacctgtacgcgcgcgcgggcgcggctgccacacgtacgggcgaggagggagcaatcggatcacaccgtaccgcgcgtgtcggccttgctgtcgctctcgctctcgccctcgccgcggcggatgcgcacttgcgcggtacgtacaagcgccgcgcgcgcggccgaacacgtacgtacacgccgtaggctatacgtacaatactacctacctggctgctccaccgcgagaccgtacgtgcacgctacgcccagtgcgcggtgcggcgtgcgtacgcgcgcgcgggggcaattcagctgaccgcgcgtcgcgcgcgttcccctgcgcgcacggtcgccgctgccacgcgcgcgcgacacgctgcattacaattaaacctgatcgatcgattgattacttgatcggatgaaggatgagtagatctatgacgatcgtggctgctgctgtttgagtttaatcgatctactgctccagaacacccagccagcaaagcaactatgcgcatcattggcatatatacatatgctacaattaattaactaaatcaactcacctggacacgtactactactacttgagagtatttgacccgactcttcgactttgtggctgcaagttagggccctttgaatgaaaggatcctttatgtaggaatttcataggattcaaattctatagaaaattttcttatttggccctttaattcaaatgactgaagcttttcaaatcctatgaaatccctatggaatggcacattgcatgtggattttagagaaaatttagcaagagctccaacctcttggaaaatttccttttagtctatctctctcatccgattcctgtgttttttcctacattacaatcaaacgaccattcctgtgtttttcctgtattttgcaatcctctgttttacacttcaattcctgtcagaatcctgtgttcttcctattcctcctttttttctaccctacgattcaaaggggcccaagcaataatgctatttcctccgtttcatattataactcgtttgatttttttttatacaatttattttagtttgatcaaatttatagaaaagaaaagcaacattcacaacactaaattagcttcgttagatttaatattagatatagtttgataatatatttgttttgtattagaaatatttactattatacgaacgatttttctatacgagggctcctctaggttcttaagaggcccacatgtaaaaacatattttgcaaacaaacctcttaaggagttgtatgtaaaaataaacttattttctcaggcggagctcttcgcatgggaaaatatttttttgcaggtggcctcttaaaaatccatcttaaagtctgacttacctcctctttcaccgctcagcacttcaaatttttcaagtaatccttatgtcctttcctctctcttgcatcctctcctcatattactcatccctctctctctcatttcccaccttctctcctctctctccctccctccactccctcaggagcggtttgcggcgagcggtagtgcccgaccctcctccacgcgttgaaggaggtgaggggcactgtggccctcccccgcccagatccggcggcgacggacgccaccccacacgcgctttgaaggaggcgagggggcaaggccgtccccgcgtggatccggtgatggcggtgggagaagctcgacggcaaaggaaccttgctagagttccaattttgggggatttttttcagatttttgcatgcggacaacataagcacccgcacgcgaaactctgatttttcgtgtacgggtgcgttacccacatgaaaaatagcaattttcgcagacaccttcgggcagacgggcaactcaactgcatgaaaaatcggttttgaccatttggaaaaaaaaaacatttttagtagtggttactttatttttctataaagtcaggaaatttaaagaagtttgactaagaaaaattaaaagttaaatgacttattataatataaatcggagggaatcctatgcaacggttagttctaccttatttcgtccaaatatataaaaaatgttaaatggctagctagctatatatatatgcgctcccgaccaaaatctcacttatgctagctaggagctagtagcaagtttaaacactgtactgactgagcaaggcatgtggcaatttgtgggaatatttgtccggccgtgcatgagatcaatcgatcgatacgcatcacctagccagacatgcatgtacatccatccaactagatggaacttcacacttttcacttaacctaatctatagactgaaataggctagctaggtatgagttgtctttagccaaaatggggcaggcattgcctgctgataaggatgttagccgtccatttctgatcattttttttcctcggttactctctctctctctctctctctctctctaaaaaatagactacgttattaatttttgaatatgtatttgagcattctacttattaaaaaaattatgtaaaaacatatgatataaatcatatttaaagtatttttagtgaaaaaacaactcatagaaaataataattacacagtttttttttaaatagaacgaatgatccgtatttaacaaagttaacggtgtcatctattataaagtaaaggtagctttaccatcaacgctgtctatttaaacgcttgtcgaaaaacgagcatttcatatatacacacttatgaaaacaccaaaatacttatttaaagaaaaggaagatagtacttaatttaatatattatagtactcctgtgtatatacatccatagttatatatcctccttatcaatcagctcgcaattgatcatatatatatatatatatatatatacctaatatattttaatttgatgtgacacattctagctagtcgtatctttgtaatggccgtgtttagttcagcgtaaagtttggattttagttgaaattgaagatgatgtgactgaaaagttgtgtgtgtatgacaggttgatgtgatggaaaagaactgaagtttagatctaaacacaaccaatgttaggatttgttaagtgtagtagcagatcactctcggcacatgcagtgaagctagtgaagtcggcggtgacaagatataagtcggcggaaaaagaagcatattcgagctaaataggctattgctagctcgtagctcctccacacgtatgttcactgaggatgcacattcttgtcttcgtcttctttcgcccgtcagctcgctgcaataattcaactcttcggttaatcaatttaattaattaatcgccgaagaatcatatcgccaggaataagatgcatattgcatgcgtgctagctatatatccatctctcttattagctaaagcacatacgcgattgttcaattcgttcaaatcagcccaactagcacagtagctagcagcttagctagcgccgatggagagatcagcactgcaaagagagagattccaaattctccaacttttgcaaaagccgatccatctaatctatctatagagctgcaaatattttatgtaagcatactgtacacaagagagctgcattatttccatccacataataaacaatgggaaagaaattagggaaagggctacctctccctatgggaagacgacacaccgtgtggatatcgtatttgcctttagctggtgttcatctagaaatatggtgcatgcatggtcccctatgcacgcgcatttcgttaatttatctcatgattattagctgatcatgcaactacaagatctagaattcgtattatttttttttggcggccaactgatttcttaactgatcatgcatgcatctactgtgtagtgatgctgacattacctcttaagtagagcatgtttgtttgagctgtgccttagtgtaagacacaaccaattttgaattaacataattatttagggtttctaattcgttttcatcatgtttgtttgagctgtgccttactataagacaaccattttgaattaacacaattatttagggtttttaaatcgttttcatcattgtatttatgttgggaaaatatgtagtacacaaacctgaaaactagttttcactggatacatagatgatcgtcttaaaatttgtccacatcctctaaacaaaaaagataactcatagattaatataggagtgaaaaaattactcacagttaaatctgaggtaaaatggtgatgtggacgtacacatctcatctatccatttgtatatctaacgatagtttctagatctgcactacatgttttcccttgattttgcaccactaagggcctctttgaatcgcagggttgaaaaaaatgaagaaataggaaaaacacatgattctggtaggaattgaagtgtaaaacagaggattgcaaaatacagaaaaaacacaggaatgatcgtttgattggagcgcagaaaaaacgcatgaatcgaatgaaagagatagactcaaaggaaatttttcaagagattggagctcttgctatattttctccaaaatccacatgcaatgtgccattccataggaatttcataggatttgaaaagcttcaatcctttgaatcaaaggaccaaataggaaaattttctataggatttgaatcctatgaaattcctacataaatcctttgattcaaaggggccttaagagtataactgtgtagaagtcttattatatagggaaaagtccattttacaccctcaaaatcttatgcttgtgtaatatacaccctcaaacttcaaaaccggatataatatacccctcacctgtaaataccggacattttacctccagagctgttttgcagtggtttttgtacatgtggatgacacttcagatgccacatcagtccttcgccaggtcggatgaaatagagtaatatatcctacgttctctcttatacattcgttctttctctctccctgttcattgttctttgaaacaacaaggaagcaggcacgtcatgcatctttgaagcaataaagaaggcatggggcggcggtggcggctggggttctcaccgccggctcaggtggtggctgagaccggctgaaaggaggcctccctgttgtgtctgacgaaagtactaacatgcatggattaacagaacatgcatgaattaacaggcttaattatactgaagaaccaactgaacttttatctttttgcactttgtcagtaattagagattcagaattcagaaatcatctgttgtgtttgcccatcctacactgaattttctactccaatgatgagcagggatttttgttggcaccagcacgatcccttcgccggagaactcatcgtcagtgttcgccaagattgttcagtctaagtagaccaagcatgtgcgcgtgttcagcagcggcacggaccatcagctgctacgatcgttggtgaaccccggagaggaggtcatcctcaccgtcccgaacgaacaactggagcatgtcgtgcggttcctcctggtgactaggatcacgcgcatcatgaccagcgacgacgtcctggttaggtccctcgggaatgcgtatttcctcgtccccacgatggttaacctccaccccacgctcgcggcggcgcgcctggacggccgcgtgaaggtgtcgagcgcgtgcggtgccgccaaagcttgttccgtcggccgactcagccgcaaatagcacctacttgctgtggcttcctccccgcgcggagctgcttccctactcagccatctccgctggcgcgcagacctcctccgccgatgaccacagcagcttgtcggagatgctccttcctcgcgccgctgccatcgcagctcatgagaaagttggtcaaaacatcctgtgcgctgatgtggcatccaaagtgtcatccacgtgtgcaaaaaccatcgcaaaaacaactctagggggtaaagtgtccggtattgacagttgagaggtatattatatccggttttggagtttgggggtgtattttagacaaacataagagttcgagggtgtaaaatgaacttttccctattatatatatactacctctggtctgtttttaatagataattacactgttgatttattaacaagcatttaaccattcatcttatttaaatatataatcattatttattttttaacgtagtttatcactaaaaagtactttaagtatgacttatgtattttcacaaaagttttgaataatacaaattgtcacacacacatatatgtatgtatgtatgtatgtatgtatgtatgtatgtatgtatgtatgtgtatgtgtatgtgtgtttaaaaatcaacggtatcatgagagagtaatttttatttgtatgagtcatgtgtcttccgtttataaaatatagtccataaataccttgcaaattaagtagacccttaatttgtgttccgtctatatatgtttgttaatttcttgctagtttcgtacctttagttcatctcactacaaggatcacgatttttctaagtggcacaaaccgtcaagggaagcatcaaaaccgccatgtaaatttgattttgtgggacaatcttttaggaatacctgtcaaatctacgggaaaactatcttaattggcggtttgcccgacaaaaaaaactatggccatatcaaactttccagtgtgacaagaaatcaacaaatactcgtcgacagacaacaccaactacatcgccaaggtaattaatttccattgcaccctttagcaataattcgtcttttctggattctagtagtgtctctccagtataatcaacaatatatgggagtggggatggttgctctttctggaaaagggaggccgccacaaaaggaaatctagatgcgaagcacgtgccttttccaattattcatccatttcttgatttttgtttagcattatgtcgctgttacaatttgttctgtggcacacacgaaacaaagccagccatcagtagatagcaacactatatataattaccaaaaacttttattaggcatatatgcagatgatttaaatatgctgaaaacacaacactcatatataatattgtgatacattcatgaatttgctttcgatcgaataattcatttgcataacttacagcaagctgttcggacacagctactgtaaaagtaattgttgcaagaatccagattgtttaacaaatgctactcaaatcttgtagttgaaatttgcaggcaataacaagatgattatattgtaaaagtggattcttgggatgcactacacgtatgatagataatttaatcgatcatcatatcgctatcggtgacatgatcaaccacatggttaatctagctgggaaaaaagagtttacaaagttaaccatatatatgttcgatcgaattgaagaaaattccgcagctttgcatccgcaacccactaaaaacatattgtaatgaagtaattaatcagcagccagcagcatatcgaatggcaagaggatgggaataatagttagtccttgtatatattaataatcctttatataggattatgtatagaatgatggtgattaattttgctgaggattcccaccaacggcgtcgttggtgatgcaagccactggcgtaagttagtttgtgtgaatctgacaattaaactcgatctctccacatgtcattacctaagaagaagtcgtcaaattgctgacagtgtggctaaatttgggaggggtgtgaaaaggcatgtggtctagtggttattttttttagataatggaaatgggttacatctccggtctctgcccataggcacatagccaaaaagtccagaagtgaatagaaaagaggttaaaaaaggcgagatgggacaaacccccaacttctgccgataatatgatatactaaaatcatgtttttttaaaaaaatcacgtagagtctatcacgaaattctgtaggtaccacgccatccaaactggagtaaaagttccttggctaccaatttcaagcgtgtagcaccattgctcatagtatcctgttgttcctgtaaaagcatcatacaccaagagtggagccaattggaacacatgaagataacctgcatgatgttaggtattttttatggttaaaaaccatatcattacggcaacgccaaattgaccaacatatagcactagctccaaataaaatcattttttatgggtctaggcactccccttagccagttaccaaaaatatcttatgcattgtggggagggggaatattgaaggcaaagaagacacatcgccaagaaaaacgtgcaacatgacagtcaaagaaaaaatgttggatggtctcttgtgtattacaaaaacagcattgcttgtttcccctccattttctctttatgaggttatctttcgtcaagattacttttttgtgaagaaaccacataaatactttgatttttagtggtacctttaccttccataagatcctcttgtggattattacattggaattgatgatcgcattatacatggatttgaccgaaaaatgaccatttttatatagcgaccaaataaagcaatccttttcatttgacagggttatgttagctagtcgagaaatcaaatcattccactcaactaactttggtcctacaattgatcgtcggaatgaaacattcaacggtgttgtgctcataacctctaccaaagtagaatgtctctttcgaaccacattgtacaaagaaggatattgatatttgagtggttgcaagcccaaccatgtgtcttcccaaaatcttatttccattccattaccaggtttaaaagatccatactgaaaaaattgatcttttactttcattaggccagcccaaaattgggatgttcctggtttgtgtgacatgtgggagaggggtttaccttttaagtacttgttgcgcaaaaggttttgccataggccttcaccattaagaagcttgaatagccatttgctcaacaaacatctattcatgatatcaagatttaggacacccagtccaccttgatcttttagccggtatatataatcccattttgttaacctatatttctttttctggctatcactgctccagaaaaagctcgatcggtagtaatccagtctttgaagtacacctcgaggtatttcaaaaaataataacatgaacatgggaaggctcgaaagaaccgagttaagaagaaccaatctcccaccataggagttatttttgcccttccatgtgctaagttttctttgaaacatatcctccacacatttccaatcagaatttctgagttttcgatagtgtatggggattcctaggtatctgaatggaaaggaaccagaattacaaccaaacagttgtctatattggtcctccatttccttagctcccccaaagcagaaaatttcacttttatgaaagtttattttcagccccgagagatgttcaaacacacaaagaatggccttcatgttttttgcttgttcaaaataccgcatatattcggttggatttagaggccaggtaaaaaaaaacctctctaaaaacaattttgggaggggtatattaaattgatttggttgtcaaaatatgttcctcggtctgtcctgctacaatatattaaccatgctaatgaagaactgaatgacttgtgaaatatgttcctcggtctgtcctataatatattaaccgtgctaatgaactgaatgacttgtgattattattggagggcacaaatgaattaattgaatactagtataaagctgaaaaatggaattgaaaatattagttcatccacaccgttctattcattggaaaagaacaaattgaatcctgaaaatttccgatggggagggagatctagataagaacaatagagaggtcagagaggaatggcgcatgacatggggtgattggatagaatcggcggtggggcagatatgcacatgtgtgttaggttaaatttggtttagaattacaaggcgcattgggagaagctactgcttgcaattgcaccgccgtttacatggcttttgatcagagattcagagcgtgcagctagcagagtactccatgcaggagtagtcatgactcatgactcatgagtagtcaagccttcagcaatggaccatgcatgtcccatatagctggaaagaagaaagattcttgcatataatgtcgacacagatagtgctatatgcgaattcatgatcaacttttgatcagtagttcattttatgtatatatataattatactccctccgtctcataattaatataagggattttaaagggatgtaacattttctagtactatgaatctggataaagagcttatctagatttatagtactaataaatattatatcccttcaaaattccttatattttaggacagatggagtatattgtatacacttttcttttttgctatatattaatcctatgtaatagtcgaaagattatattttagctgtgaattaacagaaagaagtttattttctgtaaagttgtggactgtatgatcgatgcatgcatatatatggtccatccaagctgtagtaggctccaaagcaagcttatctcgttcatgtgtcaagcttgtcccacataggagaagagatgtcgagatggaagagagaagctaggctataggcagctactacggtcgataccagtagctaggttggtgacaagaaaattaattaattaattattaattaattaattcgtcttctctgttgttacatcaatcggccaatggcggcatctccccgtttattccattcaaacggaaactgcccaagtaacccatcctttccatctcctataaataccgtaccatctcctccacagctcaccatccaaatcaacagtaatgttctacagttagtgagatgtagagagagatatggctagctaatccatgagagaggtctagatagagagagggagagatgatcagttcttcagaagaggctactactagctatctagcttcatgtttaactcttcttggtttgtgtttttgtgtgcttgttggagttgttaggaggaaaagaggggtgagaggtgaggctgacacaagagagtgagcacacatggtgactttcttgcatgctgaatggactcatgcttgaagctatgtgtgctcacttctctctctgtcagccatttgatctctctttctctctttctccctcatgtgttatactgttctctcatatctatcttctttgaggtagtaatatacttgagcaaattaagctgcttaattatttgtgtatgatgatcagctgctgatccggcctcatttcttgcatatatgaccacaaccacatacatgcttgttcattttttttcacaaagaaagagaacagtttaatttaatttcttggggtttttggatcagttaatttgtcttgagaggggaagagatctctatgggttttggaggtctgacagaagagagtgagcacacacggtgctttcttagcatgcaagagccatgctgggagctgtgcgtgctcactctctatctgtcagccgttcaccatgcccaatatgattaatctccttctctcagttgacagtaatttctttgccagatctcctgttaaattttctgcctagctagctattatgcacatgcttattatgatgagcctgccaatatcatctccacggcaaaacacaaactagctatgatttgattcattatatttcttttcgctgtttaattaattatatgcaggcatacactagctagtttccagctagtacaaagacgagacgaggtcgttctgacgattttcatagtcgtcagaagaaggtgtgcattggtttaatttttgttcttggctgtcagactagatcatctctgaatgatcaagagccggatcaaataattattgtgagcaccgaaatcgatcatgcgtactctctctgtgaagtatttctgagaaataatatgagtgtagctagtatatatactcttgaagggtgtctaattaattggggtctctagctagctccttctctgaatctgtccatgaattgaatctactatgtatgtgctggtgcttactgttatttcatgtactacatataattgataaatcaatttaggctttcagtttctttaatttgtgagcacaagtttacattatattgtaattggaatctgttgcaagtactatatactgtttttttatgcatagcagttgagaaatagaatccaatatacttgtgcaatttattctatgccaccttaattaattacttcttcctagtaatgaagtgctagcttcgatctttcaatattacctgtcaatcttaatttatacttgtttaatttgactgtaatttgccagctagaattaaatgtacattaaattgaattcttcagtgttgttcttgtgaagttaaaataatttctgaacattcacccctctataatcatttgtctatatagaaaaagcatgaagcaattctaatcacaaaaatacatggagttgtctagatcaaacaattaattaatcaatcatcaatcaaaccaaagacgtgtaaggtcatataatacaaatttaacttgacaagttaatgagtagaagatgtatgcaacgatattttccccgtagcttatactactgtcgatatatgcgtgtgaccatagttcacaagccctgtattttatgatttcaaatgttcgttcatacatatacactactacaaaagcccttattgacaccgattgagaaccgaccataaataccgatcgattttccagccggtgtcaatttaacggtactaagggcacccacaatggttatctataggctctctataagatatccatgtcagcatattttcctacttgaaagagattaaatgaagagagagagagcaaagctatctactaacctggagatagtctatagagaaaaacgagacaatgtattagaaagctatagatacccatgtagacatactattgagatggtttactattaatctagtctattgctgagatgtacatgttttatagatagcaccttactttaccattgcgggtgctctaatgcacaaccatataggtaccgattttagaatcaacgcctatagagattatctgctatttgtgactatgtgctatttgctatttttgaaacatggagcaattaatctgttataataatcggatcggatgaacaagttgaaacaaaaagggtccaaattaagccatgcaggtttttgctatatagtcgagctgtgttgatagttgtaaaaaaaaaactgtgttgaaatcgtgaaagtacccaagtttgatctgaaaaaaaatcgaaaaagaagcccaagttggggcaatgcaggcacacgcacggcggatggatggtccggtccacatgtgtgagaagggaagctccacgttcctccggccaattcaggtaattgggccgtggtaattcatttcgcatgacagtaagtctattttgtctccctcttcttgcttctggttgaaccacatccctcaacagcaaaaccgggtacaacgtctcccccatcttcgaaatatggtggaaaggtgttacacccggttttgcagttgagagatgcaattcgatcagcagcaatagttcagagatgtataatggacttattcgtttctcaggaaaatatttcttctacttagcttcatctgggcttcatccttttggggcaatctctgtttgagccagcatctcagctatgcatgggccagcagcagctcagcataaaattggtccctgaaaagtgtaaaagttacaagtggttaaccggttacttgtccagcagaaatggtttggtttggtttgccatcatgtcgaatgtacttctggttcttaaatagtactctctccgtttttttaaattataagtcattttgttttttaattttttatttgataaatttatagaaaatattagcaatattcacaacgttaaattagcttcgtcattacatgtaactttgataacatttttgttttgtgtagaaaatgttgctttgtttgattaagaaaaaagtcaaatcaacttattatgatataaaatagagagagtgttcaccctcttaagtacaacactacgtaccaaagttataatcatggaattgcgtgctttttatggttgcgaatcacctaacatgtatcaaacacttttttcccctcctcgccaaatgatctttttaaaaactttttggtagacttttctggcctcggataaaagcgtgtaccttttacttgaagaaaaataatagctcagcatatttaaaacactatctaccttggccacgccctccatcattgtcatttcgatcccccgtcattcatgtagaattcgggttgaaaaaactacaagctccattttttatatatatgtttatcataatttgcatacgtccctttcatagatcatccttttgtcatcctagccgaaagggcggctgggctgacctccttggcaaggaaaatcaatcggatggaaaagaacattggatttgacctattgaaaatgagatcagaagaagcactcctaatggtgtcaatgtgatgttagtaccccttttctgcctaatctccaccccagattctctcccaggttgagaaaaagaagaaaacctagaaaaaaaaaagtggctttctgtgatggacggttttgtttggcgtgtttggctgtggccctctatatcactgctgctctatctatctatcattctatctctgcactgtgccactgtgctactgtgctcctgctttagccttaggggctaataaaaccttgtcaagttgcaatttgtgtggtgattatgctctgaaaatcttaacagtgcctggggtggcagggtcatgacaaggcacttttgctgtgtatcttggtgtggggttttcatgtccactcgtaatcagaaatatttccacatgtttctgcataaaaagcatgtgcttcattaattcttgagaaatgtcgagctaaaccaggctaataatttgtaacaacgcaatgttatttaacatgtgtccattgatgtatgatgcttatcagtcccaacgtttcatctacaattggttatcacaacattagtgacaaaaaataatttttgataaaaattttatatatgattttttgacgatttaaaagctaatattaaaaaaagctatgaaaaaaataaaaccaactctaaaattaagattttaaatcaaaattttggttgcagctaacaagctgcataggaaatgatgaagcaatatgtatatagtaatagtactatatatgctattgcaattaacactaatatccagttagcaagctattaactagtgtggaacatatgtgaatttatgatataccatgacgtcgaagtggaaataatacgatgacgttagagccattgtaacttatctaataatttacaaaatacatcaaaatgtacaagtacaacctaaatttcaacttgtttatggttgaccgacaacgttggatttgttaatcttgcctaaagccgaccttaactgcttcttgtaaatccagacaaactagtattccttggactgtgacatcttgagtcatccttgaaagctcaatgtatgacaagatgaacgacaaagtgcaaagcataatttccattttattctgtaatcaccttttctgcacgttggtgaaatcttaacttcgaattatcacaatttccatttctccctccatggatgaacataaaattggtggtccacaccacacgagtcatcaaagccatccaacatctaaaatttcgtctgaattctcacaatcctttgtagtgtttttttatacaaatcatagctaaatacacaatcatgcacagtacacaccatgcatctcttaataaaatttggccggggaacatttgttggctcagcaaaaaatcttgtttcattttccttttttttttctaaataccatggcctcctgaaacagatcttatcccaacattttctgatgtggtcttcttttagaacaacaaaaccatgagtaaatcacaatctccaaaaaggtgaaccgagcaatgtcaatataaaagcagccgtgcacaaactaaaaactgaaggaaaagaacaaattaaaagtgggaaaaatctatacgtactaactttttcttactaaatttttactaacattgacatgtcgtattatgagtgcatttagattttttatatcttccatctacttgaatcaaacagttgagatgattgttagtgcaaatttagtaagaaaattttagtacgtgtaacagtgctcttaaaagtgcatctatctgtcgtgtgcctgcatcactagatcactgctggtacacatatataggctgcccaattttttttcctgcatatattagcagaaaaaagaaaggagataaagcaccgtttacttctttcggccaccgatttctccaaaaacgcacgcttctttctgtctgaacttccttcagcatcaagccctttcttttcagaatatcttcagtctcactcttcaggcatctgtatatatcacaacaccacctggtgcttaggtttgttagagagaaaaaaaagtgtatttaattagtgttaattgcaagttatgatgcaatgttatatccttttggttttggaggcagcattaagttgatttgtgtaaatgatttgttttcttccaagaaaacttcatctgaaagtgttcttttcttcagagcagcagagcatgtgtgcagtgttcctgatcagtacttgtgtactattacctgtcaattgctaagagcctttaccaaaaagtttcaattatttggagagacaacacacttattgacaaagggaaataaagcattttttggcactagaaacaaaaagcaaattatatccagtttataataaggcaaagaaatggtgaaaaaagaaggtaataatacatgaatgtatctgcaaaaaacgtgatgactttctagatgtcttcctcttcaggcatcaaaccaccacctggtgcttaagtttgttagagaaaaaagtgtatttaattagcgttaattgcaagttatgatgcaatattccacccatttgatttgtaggcagcattaaggcccgttcttttctgattttgagatgctcattttcatttgcacgcttcgcctctaaacggtgtgtttttaaataaattatatataatttttttcttgaaataccttttaaaaacaacctttctgctctttagtggttaatttattttttataccctcaaacagctatcataaaatcaaattatccatcaatcaataaattttaggcatttttaaactggtttagtttccaactttttttttcaaacttctaacttttcaaacacatcaaaactttcctacacacacaaacttccaattttttcatcacatcgttccaatttcaatcaaacttctaattttgacgtgaactaaacacacccttagttaatttgtgtaaataattgttttctttccagaaaacttcatctggaagtatgcttttcttcagagcatgtgtgcagtgttccccagtgctacttgccaaatagtattgccaagagcctttacaaaaagtttaatttatttggacataacacgcttatttataagggaaataaagcatattttgcactagaaacaaaaagcaaatatacccagtttatactacaaggcaaagaaacggtgcaaaaaaataaaaacaacacaaacaaaaaagtagtactaatacaggaatggataagctggtgacctcattgcaaaaatagaggggcgtatttgcaaaacgtgaagactttctagatgtcttcctcgataaggttccagataagtccaataacttccatctttttatttttttcttttgaaaaagctcacctatgcactttcatcaagctaacatgtcattttaaactaaccaccaaactgttttgtgagctctgggcaaaagaaaaaaaaagacataaacaaaaacaaaatgtcaaccaaacatctacaggtactgtagatgataataattataggttttttactagacaacatatctgtctgaaatgagttaattaatgtaatagcagagcataaatgcaaaaaaacctctacaattctagatttatagagggataaataaaacagaataatccaacaataaatgtgctttttaaagctaaataaatctaatttaacacacttaagcaaagcagctgagaagaaaaaggtaggaaaaaaaaaaaccccggcgtcttctccagttctgctccacttgtccgtagtctctccactacagtccacacacaacgccgaaccctgcagtgcctacctacccgcacgaatcttaaagcaccatccgacgcctcccccaggttctccctccccctccccctcccccatggagaagaagaggagaaaaagaagaggagagagaaagagaagagactagtagtagaggagagagaaactaaacccaacccaaatagggggaggaggaggaggaggcgcaaccaaacccaaccccgccggcttcggcgccgccgccgaggaggatctccgtcgaaggcccaccggagctcagcttgcggggaactcttctagcggctggagtctgatgcgtcccagcccatggcaccccaccctccacctcccggttgctgctggtcgtcggcgtggcccttcggagcgcggggctgggctgggggggaggaggaggggagggggaggcgacagatcgggaggcgccggacccgtactcgatcctgacgtggcacgactactcgccgccgtcgccgccgccgccgccgccgccgccggtggcgcccgcggccacctgcgagagggacctgcacgggaaggggaacttcagcacccggtgcgaggtctccgaggaggtggagctcgccggggacgtctacatcaccggggagggcagcctcgtgctcctcgcgggcgccgccctcacctgccagaggcccggctgcgtcatctccgccaacctctccggcgaggtccgcctcggccgcggcgtccgcgtcatcgccgggagggtctccctcgccgcggccaacgtcacaatcgccgacacggtcgttgtcaacaccaccgcgctcgccggcgatccgcccgagcggaccagcggggtgcccacggggacgcacggcgacggcggcggccacggtggccgtggcgccagctgctacgtcaaggatgggcagacgcaggaggactcgtggggcggtgacgcctacgcgtggtccgacctcgagcacccgtttagctatggaagcaaagggggctctaccagcgttgagaaggactacggcggaagcggcggcggtatcgtgtggctgtatgccgatgacctgataatgaatggcacagtgctcgccgatggaggggatagcagcgagaagggcggtggtggttctgggggaagcatctatatcaagtctaagactatgtaagtgttcttagaattgcttcaaattccttcctgcttcctacatgtgctaattgaaatgatgcatgggcatttaaactgcctaacaaacttgcagattagaaacagtttccaaagctgaggtcacatatgaatatattggttcagtaggatttatttcgtatttatacctgtttttcattttgttattaatgagtcatggatgcggggaggtagtactaaacatattagggatttacagaggcttgctcggtctaatagatatgagaacaagatttcctgtcatgctgtttatatttttgttaataaacgattagccgccacaatggaattgcagcttcttcaacgaacaaaaagaacatgaagttattaaatgttcagtctggttgtaatttttcttaacacttgagaagttaaggactaatgtgataggaatgtatgagtttagcatatttagtatgtagtcatgagctcaagcttgactatggtactagacaattggatttgaggatttttttttgcactaggtgttaataagagaaattaatgtcacagtccagattagttcagtggttaaattatgcatataattgattgactaataaatgaatataggaatagtttcattttattgttaccaactttcacaattgcacatatttggtagttcaaaccaatccagctaaacactagaccaccaatgcagtaatgagtggcatttgagttgaggaatgctttcattagcttgaactagctgttattttggtttgttataaatctgttgactatgcgctctagtatattcaataagcccatgcagaattgcaaactttccccttctgatcttctgtttgcaacaggcatggtgctggcaagataagtgcttcaggagggaatggtctggctgggggtggtggaggacgcgtttctattaatgttttcagtagacatgatgacacccaagtttttgctcatggtattgtgcttggtcttatgcacactgtgacactgatcctttcttatatccctgaaatgcagattatcaaatagcaactatatatttgcaggcagcatgatcgtactgtattgtttgtcgcaaaatattctgagactcctttttattactgttaggcctcagtatgttattagtcttttgtttaatgagatgaagctcatattctgagtaactttctaatgatatatagaatatggatggagctatagtgtagacaattttattgttttgtttatgtttgaattaacgtttatacctttttcaggggggaagagttcgggctgtccagataatgcaggagctgccggaactctttatgaggctgtacctaagagtcttgttgttagcaacaacaacttgagtacacaaactgacactcttcttttagagttcccaaatcaaccactatggaccaatgtttttgtcaagaatcatgctaaagttgctgttcccttgctatggagtcgtgttcaggtatgaatctgtatctttcagatgttcattaattctctctctacagatcatggtttctttactctttagtatgatatttgccattttgctgtcataaattcattggtttctataatacttacatgcatatgcacttcaaattgtaagactgttaatctatacttactcttgttcctctttttgcatcagtggtagcacgttgaacaagtgtggataaatttgtactgttagtggtggatccacccattcggtaggttgggtcggctggcccagctatggtccatgtcaccccacactccccagaacccccttttagtactgggccgcccatattagccattatccaccagaccataagaagcccataaaattaattaagtactccagtccagtcatgagacaatcaatcgttgttccatctttcaatttcgtgatgatgtacctctttgccagagcacctgactattcatctttattgctcttgtcctcttcgctgtgccggttactatgctagctgccagagtcagtctgtgctaacactgtgccgtgcgcgggcccgtgggcacacgaccgcgcctctgccggtctgcccgatgccctagccagcagccagctatggagaggcgactctagaattatactctattgcgtatctttgatgttcttttgtgccttagtttattgactgtaatatgtttttttaatacaattacaatataaatatggtacagtatatgttgcgttctattatctttatcgagaatttttgccccatctttattttatagctgcgtctgccactggtacagtatgataatttacactcaatcagtaaggtctatacatgttctttttctgagtttgaggctgtctctgcattttggcaagtcacatatttcttacagtttccattattttgcactgcacttccttcacgtacattatgcaaatgtgggagttgccattacctgataattaggaaaatgcttgtcaatattgctttgcgcaatatttaacgatagtccgcaactttttatttatactttcaggtccaagggcaacttagtcttctatccggtgctattctaacttttggtttgacccgttatccatactcggagtttgaattgatggctgaggagcttcttatgagtgactcaacaatcaaggtgttattttactatttgttcttgccatgtattgtgttgttttatggtattcaccttactatatgtgctaaacgcatgccaatttctatgcaccaatatgaattgttttcaggtgtttggtgccttgagaatgtctgtaaagatgcttcttatgtggaactccaaaatgttaattgatggtggtggagattcaatagttgcaacatcgttacttgatgctagcaatttgatagttctaaaggtaatgttcactgtcaatgactctttttctcttctctgccttaacacttcgcataaaagttctgctcatatatttgtcaggaatcatctgtaatacactctaatgctaatcttggagttcgtggtcaaggtctgttgaatttatctggagaaggagacataattgaagcacaacgacttattttatctctattctacagtataaaagtatgataaccctttgttctactgcattttgctttaattctccacagcttttctgtagttatttatttttatctaccacatggttgttgcaccttcaaaggaaaggcttttgactttaacatggtgggtctggattagcttctttgccttagttcccataaaggaaagaaagtaaagactacatttgctccttgaactctgctcggagtccactttccaccttgtaactaaaaaaatggttactttttactcccataacaaaactggacaactgtcactgacagacaggttttagttttagtggtggttttgccacatcactcttttgtgccatggtgctgacatgtttagggggtgtacgttgttctgactgtctcagtaaagagtggcagtgggggcgtgcacctgcgcatatttagagcagctcttgctggtgctggagtggtgaaatgtaaggtgatgttcttccaatgacagctggacaccattcataagtgtggtccacctcaatggaaaccaccattaaaactagtattgggtgatatttgccggatttggaagttacttttgtattttttgggggtgggtgggttgaaaatggctggattttggcttagattgaatattagactcctgccagagttagggggccaaaaaagtactttattttaaaaaggaaagacatgacagtgagacagacagccagctttctaaagaaacctgtctgtgatgtgatttgcttatgtatattggattattggataaaattttcttcacctgctgtgtgctattgcagaattaattatgacgtgatcacttctgcatactttctttgttttggtgtattattttgtattttccctgtacttgtagttttaggatctgtacttgtactattattaagaagaggttgtgataagcatttcttttgtaggttggacctggctccattttacggggtccacttgtaaatggaagtagcggtgacgtgtaaatactgccaccttcaacattgaattgaaattatcttttcttatgttttatatgccaaaagattcatctcatttattcttgtgtgcatctattagggcaccaaagctgaactgtgatgatgacatctgtcctgtggaaataatacacccaccagaagattgcaatctgaactcatcactgtcatttactcttcaggtgcattcagtttttgaaccttaccttgtgatgtgtcatggatgggttcctttgctagtgtaatgcaaaatttgaccacttctctttcaggtatgtcgtgttgaagatattgacatctggggtctcgtacaaggaactgtaattcatttcaatagagctagaagtgtcagtgtgcacacatctggtaccatcagtgcaacaggcttgggtaatttttgtaccttccttttgtttaccattctgtatcattggcttgttccctgcacttctggatcaatgctgcagaaatttgtagagttgctgggtttctaagcttaagagagtttaagcttctggatatggtgcacatgtactacgatgttgaaactcagagggctttgtcatctcaagttgcagtatactgtttacataccttgcagcttcttcagtggctaattcataaataatgatgagaggagctatatatttgttttattttctattttccttcataattcaaaaaaaatgctttagtatacttaactacatctggttgtaactatttcaccacaggatgatcttttgtttgatggtatgctgttggcaactgatcccagaattaattttcgtatcttctaatttcaggctgccgaagtggagtaggacaaggaaagatattaaacagtggtgtaagtggtggtggtggtcatggtggtagagggggggatggcttttataatgaaagccatgctgagggtggatctatgtacggtagtgctgatttaccatgtgaacttggcagtggcagtggtaatgacaccacaaagctttccaccgctggtggtggtataataggtaacacaattgttcaattagcttacctacgtttattattaagttcatagattttaggactcatgctattgctgtaactgcactccagtgatgggctcatgggagtattctctaccaagtctttccctctatggttcagtagaatcaaatggtcaaagttccactgatgtggtaacaaatgcttctattggaggacccggtggtggttctgggggcacaattcttctttttgtacgtgctttgtccctagcggagagctccatcctttcaagtgttggtggtcttggaaactttggcagtggtggaggtggagggggaaggattcacttccactggtcaaacattccaactggagatgagtatgttcctgttgcagctgttaaaggatcaatacgtacaaggtcggtctgattctttctcctatacatgttctagtattctagttctccaggggaatgttcaacactgtgatacaagtcgaatatggtttgtctcatacaatttgcttagttttagtatggacccttgtgatggctacgtattgtgacttgttcactacattgaagctttttctttataacattatcactcagttatcagggtatgaaacaccttaagcaataattactggtctgagggcaatgtaagatatgaaaaagcatcattacaggaaaatgtttgctttgataatttttttgacttttgaccctaatccgtaatgaccaaattgaaaatgttaagacggtatttatatgtagaaatactttgatcttatggaattctggcgtagaaacaagtcactgaattctgattgattatactattataaacgtgctgtgattgaaatttgaatctgtagctttcagcaaattccatgatgcagtgtaatttgaattctgtcctttcattgccagttgtttgtgcaaacaatagacatgtggcatgcctggaatttttatgtgttcctctcgtgcactgaccaaatatccttatacagtggaggaatcagcaaagggaaaggatttcctggcgagaacggaacagttacaggaaaagcttgcccaaagggtctctatggtacattttgcaaggtaacttgctaatatttcatagttccatctgccccttgtcttattatttagttgtaacttgcattgtaaaagttgattcaaatacaccaaacaacctactcaattgttctgtcattataatatttgatatattaccccatctagtggcattctgttgcttacatctgctgtaatgctgttgctacctaatgtggttgtaattatttctgtggaaaatgcaggaatgccccttgggaacgtataagaacgttactggatcttctaaatctctgtgcgttcaatgccctccagatgaactccctcatcgtgcgatttacacaagtgtccgaggtaattctttctctatgcagtttttgatgtgatatagcggaaatgcagccaaggacaaaattttaacttgtttatctaatttctaaatcaattaggtatcataaatctactgtttttagatttatcttttgtttttctcctttgtaacatgcagcttcatctatattactttgctattggccttgcatttacttaagtttcaatactgttgtgcaagcttcagaagatgctttaactttgcttgaacattctaatctctaacctagcttatgtttgacaggaggtgcttatgaaaccccatgcccatacaaatgtgtatcagatagatatcgtatgcctcactgttatactgctctggaagagttgatatacacttttgggggaccttggttatttggcctattactttcaggtcttcttgttttgttagctcttgttttaagtgttgccaggatgaaatttgttggtactgatgagttacctgggcccgcaccaactcaacaaggatcccaaattgatcattcttttcctttcctagaatctctaaatgaggtattttatacaccgcttccgtcatgttgtgtgccatatgaccatcatgggttctcatagaagttttttttgtttgttgcaggtcttggaaactaatagggctgaggaatcgcatgggcatgtacacaggatgtatttcatgggccccaacaccttcagtgaaccttggcatctcccacacaccccaccagaacagatttctgagattgtgtatgtgtacatgccctcacatagatctaactactacctgaacaaattcaatgtatcttctattttggtaattgcatatgttttatccgtgttacttttgcatgcaggtatgaggatgcatttaaccgatttgtcgatgagataaacactcttgcagcttaccagtggtgggaaggatcgattcacagtatcctctgtgtacttgcataccccttggcctggtcatggcaacagttccgtaggagaaagaaattgcaaagacttcgtgaatttgttcgctctgagtatgaccattcgtgcttacgttcttgccgttcacgtgcgctttatgaagggctcaaggtttgtagttctgttttaactatttctagattgctaccacatgcttatctctgaggtcatccttccctagcctaagaactgaaatcctttgatgtttcactctatgattttttttttttacacttcaatagcagagtacctactgcatgcttctataactgaatgctatcagaggattggagtgcaaagttaccagtcatagaagttgtatatcttaaatatgccatattgcatgaataagagttgtgttgaatgtataattagaaaataatatctataattagaaaatatcatgcatggttggttgaaccatttgtgagtgactctgctataaatctttcatgctcttttccattttggttctttggacaattatgaactcattacatgtttttaccttcccagaattgattatatcttggaataaaattattaaatgaatgtcatgtttgatagtgttgtgatgcttggaattaacatctgcctacttcataaatctttaggtgactgcaactcctgatcttatgctgggctatttagatttcttccttgggggagatgaaaaaaggcctgatcttccacctcgtcttcgccaaaggtttccaatgtgcttgatctttggaggtgatggaagttacatggctccattttcactccatagtgatagtgtactcactagccttatgagtcaggtatgattttaagatctttctaactgcattagttatgttctgaagctttttcttatacttctataacactattttaaacattacaggctgttccctcatcgatatggcaccgtcttgtagctggattgaatgcccagttgcgtttggttcgacgtggaagtctcagaggaacatttcttcctgtcctcgactggcttgaaacccatgctaatccctctctgggtgtgaatggtgttcgtgttgatcttgcctggttccaagctacagcattagggtattgccaacttggtcttgtcgtttatgctgttgaagaaccaatgagtgcagagcttgatggtagccctagaattaaaatagagcaacattcactgtgagttactatttttattcgtcctgatcatttgttttctttccctttttcattactatttattcctaatgacttgttgcatcatacagaacacagaacatgcatgctgatactcaactaggccattctagaattaaggaagctcttatgcgcaaaaggatcacaggcggaattcttgatagtaatagcttaaggacgcttaaagacaggagagatttgttttacccgttttctctcatcttgcacaacactaaaccagttggccatcaggtttttctctgccattattacataagactcttatgataaaattcctggcatttgcacttaccataattctcttgttcttaaatgcaggatcttgttggcttagtaatctcaatattgcttctcgcagattttagcttagtgttactgacttttctccagctatattcatactctatggccgatgttctcttagttttatttgttcttccacttgggatactatcaccttttcctgctggaataaatgctctttttagtcatggaccacggcgatcagcaggccttgctcgtgtgtatgcattatggaacattacttcactggtcaatgttgtaagtatgctatgtccatctgcatttcattgttgcatgcttatttgtctatattgtattttgagatcctaagacggctgtagttagtgtctgccattattcactggttttagctttccccgattttgttcttattgttgatttatcttcataatcctcttcccatgatattcaggttgtggcttttgcttgcggccttgtacactacaagtcatcaaccaaaagacatcctagtacgcagccatggaaccttggaacgtaagtgccatttccctttgcagttatatacaatacaactaaatgcaattaggatatggatgcatttttttcccctttgccttgtcttgatcctcctttcatctcatcggcgcattttcaattctatcacagggatgaaagtggctggtggctcttccctactggactcatgttgctgaaatgcatccaagctaggcttgtcgattggcatgtggctaatttagagattcaagaccgcgcagtatatagcaatgacccaagcatattttggcagtcatgacacttggcattactactactaaaggttcttttgggagctttttacaactcaattttttgggagttgataaaaggaagggtgggggtactcaaagcacggcctttctttattgacctttggccgaagaagaagcaactactacagtgggttatagatgcaatttccgcgtccctctgctaatcatatgtgcagtcacaaccaacctgtattttggtgttgtatatataaaaaaggtgtacttgatccattatttgtaggatttagacaccatagagtttataaacagttcccaagctaactgaagagatgtgattttgttgttgttgctactgctcttgttgtcggtgctatgtactttgcctctagatgttgagctgggcaaggcaggcattgactgtgaaacttgtactacctgattggataacacaagtgctaacttggctgatggttttcatccctcatcattaacccaatgcaatgctgataccaccgagttgtgacaatgtgttcgctcttggatgtgcaatgcgcgtggatgtgctatgtgtggttagtgtgttaatcttgttataaacgtgtgttctgacttgtgagtgtggtatatcaatctcttataagatgttattgttggaaatttggtcacaattcagcatattttaatccaaaatattaagataataaacatgacgcttataggatatgatctagtgcaattgataaattggagcatcatgaacatgtttaatactccctccgtttcaaaatgtttgacaccgttgattttttagtacgtgtttgaccattcgtcttattcaaaaaattaagtaattatttattcttttcatatcatttgatttattgttaaatatacttttatgtacacatatagttttacatatttcacaaatttttctaataagacgaacggttaaacatgtgctaaaaagtcaacggcgtcaaacattttaaaacggagggagtataaaataagcatcaccatacacaagacaatgcaataacattgcgactgatagtagcagaaaatggagaaccaacagtaacggtaaaaggttatacccaagaatggccaaaatggagaatcaacggtaacagtaaaataaaatgttatactccgagaatggctctccgctggagtttgagaaagtattgcatccccgagaatggccaaaatggataaccaatggtaatagtaaaaggttatactccgagaatggccctccgttggagtttgccaaagtattgcatctgttgatgttgttagagtttgagaaagtattgtaccagttggtgttgtcgttcccattcacctccttgtctccggtgttctccgtggacatgttggtgaaggcgcagatgaacaggagcagtcgcatgttggtgaaggtgcagatgaataggagcagtcgcgcgtagtgctcccaaaaacttgagcgcccgcctacccgtgcaagaacgtaagcggacgcagttccggaggtatgcgaaggtagcacaggaacagaagaacatccggaaagaaagtgcgagagttggaggaagaacagaagtgcaagctccctctgttcgtcccgttagcgaaagatttgtagcgcatgcgagagttcattcagagaattcaatcaacgcgattaacttgagccgttagcgaaggatttgtagcgcatgcgagagttacattcagagaattcaatccacgcgattaacccgagttaaagcgattaatcaccaatccgttacgtgagttaatacgcgcgattaatcaccgatccacgacttaatacaccggatttaatcaccgtccgttacaaaacgagagagagagagcagccgccttgcccagcccgctcggcgcgcgtgcgtgtggctgactgcccaccatctcaaccggtcacacagagactctctgctagcttcatttttaagttgaggcctctacgcttagttttccaatgtggtattaatacccatagcactaaatgtaggcaatggaatttattaggatttaattgggcctagcctattaatctaacagttatggcatatcaatctctcgtctagattcacttatgtacatatgaattttaacacatcaaatacacataaatccgcatgaacctatccaagacccaaaacttcttataagtaaaacagaggaagtaaaaattaaggcatgctaaaaacggatgaagcctcgattgatagcgatcagtatacatatattctacaatttccttcatttcaaattataagacatttcagattttgaatagattcatgcgcggatcaatatatgtgctccatatatatgtaaattcatatgtatgttaatgaatgtagacaaggattaagaggctaaaacgttttataatatgaaattgaggctgcatttttatttgttctagtcccatattttggttttgtggtttaagtaaaaaaaattatacttaatcatcaaattttaattttaaaaatttatatagtgtaacattgtaagatttaggtttttggattaaaaaaaaacttctatactagcagtaattgctagcataggatttttttgacacaagtagtaatactgccatttttaagtgtaactgtgccttttttttttccaaagtttgaccgtctatcttatttaaaattttttatgtttagtattttttactattattagatgataaaatatgaataaaactttatacgtgacttattattttttatttttataatttttagataagaggaacaatcaaacattatatatagaaacccacacacttaaaataggacggagaaagccgtactaattcactacatcggcggtttgtttagcaatttgaggaaaggggattgagagtttacacgagggaggaattccctcccaattccacccttacctcaatttcccatcccaattccacccttacctcaatttcccatccccatccctgttccaccaaaattctgatgtctccaaaccaaataaaacaattaatatctcacccctcacccaatccctcctaaggctgtgttcgctagagcctattcccaaccagaacagtgcacacagaaaacggaacggtctattaacgcgtgattaattaagtattagctattttttttttcaaaaatagattaatataattttttaagcaactttcatatggaaacattttgaaaaaacgcactatttaactgtttgaaaagcgtgcgcgcagaaaacgaggaagatgagtattccctctggtttcattttaattgacgttttggacaatgacacggtctacaagatacatttttgaccttatttttctattataatatatataataaataaatgcatgtttacttttattatagtattttaaaagacaaatctatatatgttgttctagttcctttaaactaaatatttttaaaagttattgatagtctaagttataaaagtttgacctcaaccttattcaaaacgttaattaatatgaaaccggagggagtaggtaactaggctggctgtgtccctagcacgcaaaacaagcagtgtttagcgcatgcttaatcaagtactctagctaaaacaaattttaaaaataaattaatgtgattttttagagtaatattcctataaaaaaacttttgtaaaaaatacatcatttattagtttaaaaaatatacgcgtgaaaaacgagaaaggtgagttgagaaagtgaagataataagaactcagtctaaaactccctcaaaactaactggccgcggctgtaaagaaaaaagaaaggaaaaattactacacctagtccgaccccgaccgcgtctcgtcggttccccgccacaagcccacaaatattatgcgagagagagagcacccgttaccgcctccctcacctcacgctgacgatcgccaccgcctcccccgcaaaaccgtcgcgccgactcactctcgccgccgccgccgccgccgccgcgagatccgatcgccatgacgatctcctagtccctcgcctcccgcctcggccccggcggccccacgaggtggagcccctacgcccgggcccccgatcccggccacggggcggggaggagctccgttcctcccggtggtggtggtaactcccgccctcccctccgcgtcgcccccgccacggcgaggctcctcggccaccccgcgcggaagggggccgcggcgccgcccggatcgaggtgccgcgcggaggcggaggcggaggccacagccgcctccgatgctgcctgccctaacccgccgcggcgtgggtgcgaagagacgaacccgaacccgaaccctaagagaaaccctaagccggcggagagaggggaggagccgcccgtccgcgccgtcggctgcggcggattcgccttcctctgcgccctcgctggccacaccgaggtgattattgtctccccccactcaactattttctgcgatgaatttgcgtcgattctataacctaatcatatgatgagtgaggattttgctatattctatataacctaatcatctgacgagtgaggaatttggtcgattctataacctaatcatctgatgagtgaggaatttgctcgattctataacctaatcatctgatgagtgaggaatttgctcgattctataacctaatcatctgattgagaggaatttgcgtcgattctataacctaatcttctgatgagtaattgtccaacgctgcaggctatcagtgggatctctctgcctgtgggttccgacaagctttactccggcagcgctgacggctccgtccgcgtctgggactgcaactctggcaaggtagctgggctctccgctctcggcactcccttcaggctctttacgcacgattcaagttgagtaaattcaagttgggggttgcatctgcgtcgattcctccgttgattgtggcggtctttgaagtgcttccatgagatcaattggggagtactatctgattgcttcctgtggtcagacatattggtaccaaatcagttttttctttgcaagattggggttatcggcatgccggaccgaattgttacgggaatcttttcgcctgcttgtgtactgttgatcagtatatcagggtcagtttgcgagcaaggcaatgaggctggtttggctgataagcaaggggctctctggaattacattacagttctctctggctgatggtccatacatggttttgtcaaaaaaaaagtagtgaaaaaaagaaagagaaagtaaaaaaaaaagaaaaaaaaagatgtgagatgattgatgattatattttcttggaaagagaagactgaacaaggaggaaaagataggtgtctggctgataaaaaaattctaatatttattacattgcattgttttcttaatgtttctgtcatagtgcgttgatgccatcaagatgggaggcaagattggttgcatgattacccatggcccatggatatttgttggaatcacgaagtccgtggaggtaatattttaatttcgttgatttttttttgtgggagtagtccattttgtgttacatattgcgatgttactattgtgcattgaactgttgatattgatccctacaatgaattgtaggcatggaacacacaaacagggatgaagtccagtctccgtgaaccttctggtctggtttgttccatgactatcaaggatgagatgttgtttgctggtaccggagatggtcgcatcatggcttggaaaattcctgacaagaagggtgactctggaccagtggcaatcctcagtggccatgagcgccaagtgatttcgctcggtgtctcagtaacaaggctttactctggctcacttgacaagaccatcaaagtatggtaatgctgcaaaacttgtgcaaacttgtgcttctgtgttggctactaaggagtattatgttagtactagtatttgaccataaaactctattcatcaggtatgggaccttaaaactctgcagtgtgtccaaacactctctgagcacaaagctgctgtaacatctgtgctttgttgggatgaaaaactattatcttgctctctggacaagactgtaaagatctgggctgcttcaaagtctggagaccttcaagtgatatatacccattctgaggagcatgtaagttctactctggcctgcatcctctgtagcaatggttgcacaagttttatagcattgaaatttcaggcacaaatttatttagctacttaaccagttaaaatagtcaataagatgacatttttgtgtatctaaactgcatattaggttgacatgttttttgaccggagggagtactattgtgcgtattttcttgtgttgaacattactattctccaacactcaaatagtttctggctgctaaatcacttagggcatttttatttcagatgatgtagtaactaaattaaacttagtttaagagttaagtcacattactttctgtttttaaactgcatttcaatgctaatgcagttatactatgttgaatgggagcactacgtagcttttgcacaattaaaaaaaagacactatgttgaaaccttctttttttggggtggtcgtgcctagcaccaaatatggtatataaactgcactgtttactatctactttacttttctatcttttatttatataaagtttttcttggcgtgttctatgcattgagcagctccttcctgttgtcgaatggcagcaaaatcccttcataagcacaattagttctcttaattgacttggaagatctttgctcaagagtagttttgttgccgcaattggtcttgtgttatttatgtctattaatgagtccatcttcattcagtcaagcaagggtaccttcaatatgtaggatttcagtgttctagacttattctgtactgtatgtaggggtggaaacgagccgagccggctcggcttgcagtggctcgcaaaaaactaggcttggcttggctcggcttggttagggaaacaagctaaaacttaagctcggctcggctcgtttcctggctcgagccagctcgagctggcttgcaagccttcctgttgaaacacctcttcatatatattttgtaattattaaaaaaagtaaaaacaaatcatcaacatgtaaaatttaaataagtttttatattcaattcttcaaaatcttgatgataaatttcaagttgacaaataataacactatataaagtaaaataatcaatataaacacacgatggcctaggctcgcgagctaaaacaagcggctcgcgagctagctcggctcagctcatttcagcaacgagctaaaaaggaggcttgggcttggcttgtttggcttacgagctgagccaagccaaccaagctcgagccaagcccgagctgagctcacgagcccgagctttttttccacccctaactgtatgggtggttcagtgttcttggttagctggtagtgaagagtgaacttataatgatcagcatatttcattgtggcatcaagaccaaggagagaccctctacccgttttctatttaatccttgtaattaatctccatattaatcggcttggagaaacgaaacgacgttactgccgctgcatgattgcacaggcaaggaatgttccatgctgcatgcagctcgaaaatcgcatggcctactcgatctccgtgataactagttaatccatccaacatgcacatgctaccagcgttaatatgctgatcaaatcggaatatctccactttcgttatgcgctgatcattatggaatggagggagtaataatttggttggctggtagtgaagagtgaacttaaagtaataaggactaaacatccgcttgggaaactttagaaggctgctcagttcatctggttcccttgaaagagtatcaataagggagtatgatgtaattgaggaagctattgatggaagtgtctcaggctctcagcaacaattgaatgatttgtacaatctgcatcaaagcatgaacaaatggggtcgtgaattgtcaattcttagttctggatattcttcttgcttttctgcccagtattgctaccaaccctctatatccaagtattctttaatccttttcaagatactgctctagaatctgttgatcgctttgggtgtttttgttgtggtgcttgttgtggagaaacattctgtatttattgtggtgcatggttatggaaaccatgtaagttcaatgctagtgtccagtttgcaagttcagttttctttggatgagaatgctctgcttctgaaccttactcctttcaacagtcttcagttgttcccctgttgctaaacatgcacttctgttgcagggagtacgcacgctctttggcatgcaccgtgttggaaagacgccagttctgttctgctccctccacaacagcaactgcatacgtctgttcgacctgccatcgtaagtgcataaaaaatctgtaggccatcgaagaacgtactgctcccttactggaagtctcaaaaatggtttggtcttggtctttcaggttcgacgagatgggcaagcttttctccaagaaggaagtgaggaccatcgagctcgcagccggcggcctcctcttcaccggcgacggcgccggcgagctgaaggtgtggaggtgggcgcccgaggaggagcctgcaaccccggcgctcgtgaaatcatcaatgtagaagcactgtagcgtcgttgagtaaagatagcagctcctgcgaattgtcgtgagctccatctcagaatccatgtagtaataacttatgacaatgctgatgtaaatatatttgcccaatcctgaggcctgattagcaatattatgttccattctcccatgcactgtctccattaattgatgcttgagttgcgtgccataccaagcctctacttcgaatgtccacaaatactctgaatgtacgacgacgaccattcattttactttagaaaaatatatataaatatgatttttttaaggtataaatattatttattttattgtgcctggtggttttatcataaaaaactataatattaacttacaccttcacatatttatagttttatactaaatttttaaataagataaattattaaacgttatatgataaatcacggtatcatatattcattacaggggagtatatataaatatgattattttaaggtataaatattatttattttattgtgactggttttatcataaaaaaatatagtattaacttacaccttcacatatttacaatatttacagttttatactaaatttttaaataagataaattattaaacgttgtatgataaatcatggtatcatatattcattacggaggtaatccatccgtttcaggttataagacgttttgactttggttaaagtcaaactactctgagcttgactaattatgtagaaaaaaatagtaatatttacaacactagcatagttttattataaatatataattgaataaatttttataatatactataaaaaatgtctgtgcgttgcaacgggtgaagtctattttaatcctattattgttatatggtttagttaagatgaaattcactgtgggagttcgcttggatatatatattttaagaaaatcagttaggagtccgatcgtctcaagttagcatgcacgttttttttaaacatatttcttatatgattccttctgaattatcaaaagtgaacgatagaactgactcaaatatggatatgtattttcaaaagcaaacgaacttaaaaaccgactcatacacggatgacgtaaaaaaatactggcaaaaacatcttcaatttttataattgtagagatttgtcttaggttaaaaatattactacttttttctataaaattaatcaaacctagagtagtttgactttgaccaaagtcaaaaacgtcatataacctgaaatggagggactagtatgtcattttcaacatttgaagtttgtacacaaatataagcatttcttatccaacttcatcttatgattttttgtatttactagcttattgcacttacgttgcaaccgggttttaatttaagaaaattattatcatatcttaattgttgtaaacatttgttacttacatgtgaaccttgttagctccacagttttttcctcccacaaaagtagttggtgggagtagttgacatgtgggtaaggcctggtttagttcccaaaacaaaaacttttcacccatcacatcgaatgtttgaacacatgcatagagtattaaatgtggacgaaaaaaaacaaattacacagttcgtcaggaaattgcgagactaatcttttaaacgtaatcgcgccatgatttgacaatgtggtgttatagtaaacatttactaatgacggattaattagtcttaataaattcgtctcgcagtttcttagcggaatctataatttgttttgttattagactacgtttaatactttaaatgtatatccgtatatttgatgtgacaaccaaacctaaaaattttccccaactaaacaaagcctaaacctcacatgtcgttttttttttaaaaaaaagaagatgggagttggcactaacactactctcttttataaggagtatggattgctacattgccgatgtatcaaaatagttttacctcagtcttaatctcttctaaaattgctataaatgattacatttgaactactagaaatgattgtgtttgtagatgaagggattgctctaccgatgcatacaaatctctgactgctagaaatgattatattaatttgctaaaaatgattgtatttgtagatgaagggagtacgctaccattataccaatacatacaaatctccactaaaactgctagaaatgattatatatttgtagatgaaggaatactctacctatgcacgcaagaaatggcatgctttggcaatgtggaccgtacactttgcaggtgcagtagcagcaacaccaaccgtgtggagctctcaaaatggctagacaaactaaagagcctctaattaatacaaccaatgttgtgtaacatcgctagctgctgcgttgctgccgaactcccattgaccccagccacatattaatctgacgctatgaaacaaacacgcccacagatcacacccacaaagcgatgtctttatctgttaatgacgcaaaggatcgattaattgtcgccgacatgatccatctcgtcgctgttcttgtaaacaaatgcaattaagtagcaagagtttgcatgttttcttgctcttgcttgtacggtcaaaatgttagtggtagtttattgcttgaaaaagaaagaatatttggatgttaactcgtacaatcaaacgataggctctagcctgggattgcgtataatcatggtaactaagtaataatctatgaccactggtatcttttatcgaggtcaactatatacggggctagcttatcacgtctggagaaaagaaaaacccaatgttgcttagctttgctggagtaaatctctctatatttgtgctcgaaaagtcaacgagcaaatggatgcatgtggtaaatgctgagcaaataagcaaaaagtcttgggtcaactattattttcttaattgcacagcacacaccactatacacgtaacaccacactcacaccccgcgaatgcatcccctaacacatactttaagagacggaaaccattaatacatcgttaatttcaaagtcagcgttgaaagctacttgcatgtgcgtaatatttgcggacattaagatttaaaccctggtgtatggagtcatatatccacgactccagcgccgccacaccacttatgcttccccttggggtcaactattatggttagcagccgacttgcaaatgatcattgccgatttagttacgtaacagccatgtagtttaatgagattcccagtaacatctacaagaatctcgtccatgctcatcatagatagagatgcatttttcaacccgtgtgaaacaaaggtctttgtttggaaggtgaaagtttcaaacataaaaatgtagaattgttttttctaacatgcacagtcctgcttataagaaacatatgcgctgctctcattaaatatgtgatcctcactaaatacgtggccacttattggatttgacaataagccccgtgcaaaggtttgaacacaaagataggatgcaacatgcatgtcatgagtttgaaaacaacggtcatgcaaatttttatcgactatgattaaagtttaacaataggatatgtggcgaaacaatgtgtctctatctattggtgtctggttttattttctcatatctattttttaatatataacaccgttgatttttaattgaccattcatcttatttattttttttgcaaatataaaaatatttgataataaattaagtcacaataaaataaataataattacattttttgaataagacgaatagtcaaatataatgtatttaaaaaatcaacgacgtcacacattaaaaaacagagtgaatactttaaaactacatactttgtaataatttattagctctttaaagtaaaggatggatttctcattatattttaaaaagtattctaccgcaataatgcacccacaaatttaccactatcaagtgtgttgtttctaaaatgtaatatttttttaatcaccaatcaatttagtctttgtactatgaattagggaaaaggagacccgaagtgcgggaaaaagtacattaacatgttacagcgatacgtctactataagtggcagttgtacatttttacaaacaaaggaacatgcgttaagttgtattactagtttcatcatcttcttttttattgcttgtaacccccatctcatccttccatcatacaagatgcgaggaggagctacacacttttgttttcaagtcacagtaactacttatcaacagtaagttctcgacaacattatgtttatttcattttttgactaaagttaaccgctgtaactaattaattaattaattaattaattaggcaacaattaattaattaattaatcaatcagttgaagatgtcctggccaggggagagcagcttcttggggtcgtacttgtccttcctctgcacgaagcgatcccatttggcgccaaaatgcctcacccagtcgccgcggctgtcgtagtgcgccaggtacgccttgtacccgatcccggcgaggtcgcagaacctcagtatcctcctgttctgcgcctccagcgccgccacgtcgttcgccaccgccgagaacagcagcgacaccacgtagaacacctcctcctccccctccggcgtcaccgccgacatcgccgcatcccacctacacccacccacatattgtacagtgcatcgtgacgatgatgatcttcgagaaaagtgacaatgtcggcgataatgtcaatgtgttgtgtttacttggatttgttgacggggtagatgatgagaggtccggcgatgtcggtggccgtctggaggatgcccttgaagacgccgcggtcgaagtcggcgatgcgggagcccgggacgaacaggttgagccacgggtgcgggacgcgccatagcccggccttctcgagggcctcctcctcgccgtacacccggtcgaggaactcctcgtaggtgacgtcgcgggagaaggagaacccctcctcgaagtggagatcgccgagcgccgccgccaccgccgcgtccacggacgacggcgtcgcgttcgcggcgtagttgagcgtcgcctcgatgctgtacacggcggtggcgttcctcgccgcggcgagcgcgacgacgcgcgcggcgtcggcgtcggagaagaacccgccggagctcttgagcgccacggcgaggccgcggccggcaaggtacaccgcgccctccacgtagctccatggcccgtgcgacccgtcgggccgcgccgcgacgaggcgctcctggtcggcggagaaggcggcgaagtcggcgtacacgaggcgcacccaccgcgcccgcgccggcgccggctcgacggcgacgcgcgcgcgcgtgatcacgccgaactggcccagcccgcccaggacggcgtcgaacaggtccgagttgaccgccttggagcacgtcaccgtctcgccatgccctgcatgcgccccgagtcaacgtcgtccatgtaaactttcaattaatcgcggaaattatttcaaagtcaaccccccttgttgcgagccgccaaatgtacttatcaaagacgtcgccggccaaccagccagccatggccggcgcagctagcattgagtgctggacactaacttgtacccactaattataagtaacctttaattatcatttaagaacaccgtattaaaaacacgaatattagggaatgacctaatatcaaattattagaaggggcaaggcttcaaaccaaaatcgtctagcccaccatcttgtggagctagccggaaggccctgggaggaaaaaatatgtatgtgggtaacaagattaaaattagttagttaacaatatgtaaaaaaaattctaattatgcatgtggacacattatttttgaacagattttttaaaaataatgaaaataatttacatctcctacctctattaatagatgtgtaggtaataaattagataaacataaaactcgaggttatgagacaaatgcatgtatcccttttgatcacagcatcctacttaaataccgaatagaaaacacgtagaataattctataggaatatcacatttcactctgatgtagtatagtatatttaaattttataaatgttgattgcacggttagttcttgatcacgaggtttgtatgtgtgaggattaattagctagcaaaaggagttgcagtgaggtgtacgtaattagctagctagaggcaggcggttgcttgctgtgattaccggtgatgacgtcgagctcgagcacgttggagatctgtggcccgtgccggtaagtctgcccgctgacgccggcgttggagagggtgccgccgacggtgaggtggaggtagtccgtccacgaccgcggcgccacgccgcgcgccagcgcggcgcggagcacgtcgacccacagctgctcgccgccggcgtccacgtacgcgccgtccgccgacacgttgatccgcggcgcgccgccgccgcccatggactgcatgtggacgacgacgccgccggcggcgagggcctggcccatggtggagtggccgcggccgcggaacgagacggtgaacggccgccccggggcggcgtaggcggcgcgcaggagctccgccacgtcgccgggggagcccgggaacagcacggccgccggcagcgccgccgtgatgttgccgaagtccatcgacgccggcacggtggcgttcgggtcggtccggagcttgccggacgcggcgaggtcgccggggaacgggagaggcgccgccgccgccaacggaacgccgccgccggcgccatgcacggcgagtgcatgggaggaggcgatcagcgcggcgatcagcaggtaaatcgccgccattagcggcgcgtttaagctcgctaataccactttaattaatccgcgagatcgatcgatgagagtgtttggtaattagggattaataagggtgttgtgctcttgcacttgaacttgcacacctatatatatagatagatgatctatctaattatgcgtgtacatttatatccaggagattgttgccaaaattaaagcattaaatcacaatgggattctttgacgtataggtgatcttcagtttctatttctactgttgaccagagaaaaaaaaagtaatatgtatacgtgttgattgccgtagaatactggtatatataccacgtatttttacgttacatgtacatatttttaggtgtacacaattaatatttagctagatgtggatttggcagtatatgtacgtgtagttaatgtagtaaatatgtgcaataatgcactgaatatgatcgatgatcacattaatttaattttgtggtcttgtattaataggtatatatgactgaacattaattaattatttgtagaccagatacatcaaagtccttgtattaattgaaggtgccatatatactgcacaaataatttttctttgaaaaagcaaggagatagaataatatggtactaaaatttaattgcactgactttttttaagctttcatgtcactttaagtcatcttaacattcataagcaacgctacagaaaaggacacaaaattaacaacaattccatacctgattgtgacatatcctagtcaacaagtgatcatttattagatttaattacctgaggcaagaaaatgtgctcaaaatattccagaattgcagtcagttgggccgcctgttggatgacattttttttcagagactaatgatctggggtgttaacaagcaaatctgagtaaacattaattatatatagccattgctattaacgtttagttcatatacttgcctctggttttgcaaatgtactaagatgtatgactgcgtgtgcatgacacactcttttttgtccatttcagtaaaattaagaaaagaacatgttgatgactaggtgtggaattaaattgctagctgtttgactcttctgctgttttctcctagtaaatacttaacctacggtagatgtaaagaaaacacatattactttagcagagacgacatggatgtcaatttaattgatcaacactacataacaacatgtaatcgtaaaaagaacatcggttcttcggaagaatttcctacttggaattttggtgagcactcgatgacttaactattaagtgttactgatctgaaaaggacaaaataatatataggtcccagatcccttctgtaattctatatatatctagcatttttatgactttacatcactatcttttatagaatttattatattatcctcacaaaatttcgcaatatcataaacataaacaaaatcgtcaaatctagagtggtgtagttttaatatgtccaacttgggtaatttttacaaatataactagcacaaattaagtttatataactgttggtttgtactgatcaagcgttaaagataaaaggaaaaatatgtttagtgtgaaaatatatcttctagatgatgtgtgaagtgacatgaccaggttacacgatacacacgcgtgcgtgacgttttcataatattggaaacttctgaaccatgcatgtgaaaatttggtttaatttgcactaatttgacactttttaaagacattgctcccttgggtcgacagatgtatatgcaagtccccatcgatcagctaattagaacacatgcatgccaaagtacacgacaagggtttaattagatcaacatccacacgctgcaagttgcaacacgtcgtatctaatcaagttatttttagttatgccttacgttgcagtctgatcgatcgtgttttggtgaatgttgacccatattattccccttttgaatgtatgacatgggtaatttttaatatacgtttgatgatttgtgttgttaaaataattagtgtaaatatatatgaatataagacaaaattaaattaccaataaaacaaatcataataaaaatagctatataattttttagtaagataaaatagtttgtcaaaaatcgacaatgttatatatgaaaaaacttacagaatactccctccgtccctaaatatttgacgccgttgattttttaaaacatgtttgaccgttcatcttatttaaaattttttaagtaattattaattctttttctatcatttgattcattgttaaatgtactactactactcaagtttttaaataatactcatagaagtttttgaataagacaaacgcttaaacatgtttaaaaaaattaacggcgtcaaatatttagaaaataagggagtataattaattatatactccatgaatacctgatcgatcgatgcacactgatcgatcgactggcgtatacgtgctgcctgcgtgtgtatgatgatcttggaaacatacctctcatcacgcgcaccgaagcaaattaagcagaagcagtagcgtgtcaggctatatagcttcctctgaatttctccatgatatgtacatgcatgtatgcatctgccaatgtaagctagctacatacaatgctaggtaaccaaccgtacgtgtgtcacccatgaagtttttttaggtcatcttctgccgtatttcagtcatctcttgtgcctgaagttttcagtcatcttctgcctaacgtgcgtgtcctcctagccgagatggtggattgattctgtggtcatagatcttagttgtttctcatgttggtgggatcagcatcctccaacatggcaacatatatatgcagtaggtttgtgcatcgaaagattttgtttctcgaaggttatattaaagatcttggttgaccatgaagggaaatgtagtaactttgatgaattaatggtacgattcgattatgatatatttgtagtatatttgtgcaatcgactttgtctttttacaaagactagtaatttttttttgcacattacaatggatcggaggtgtgatggtggagttgtgggtgtatgcatgactttatccatcataatttaaattctgctatccacgaatactatgcacacgtaaagtacgttttcaataggaattcaatgggactatggatatgtgagtgtgtgttagagggtgcactcgtggatgtgtgagtgtggtctgtgtgcgtgtacgttaatacactacccgtgtaataaaaaaagaaaagtgttgatgtaaaatccagcctagttggcttaggtgagaaaatggaggatcgattttcatgtgggaatacctaggtttaggcctgttttcacgtgggagtgggttagtttttttataggggtggttgcacgctatggttgatggttaggaggggttaacatgtgaaattcccttttatcgtagcagaggtttatgattgattttctattatttaatatatcgttataattactatttaattagttaggtcatcaatttatcggatacagggagcaactttgatgcgtacgttacttgactagtggagttgagcattactatgtgtatgtgtccatgatggtgtgtgcatctttcatataattgaaaaaaaaattaatatgatcctacggaatatgatagctatatatctaagctaggcaaacgccgggttagataaacgtccctaagcttggtcatgttatactatagttatatacctagtctagtttaattacttcctccatcgtaaaataagtgaatttctagttttttctttaagtcaaactatcataaagttgaattatagcaatcttatactagataagagtattaagtatttaccattctaattaaatgagtaaactataaaattatatttcggatttaatgatgctcattcttttttttcggggaagagggaatatatcactcaatcataatgttctcccgcactaaatgcgagataaaattacaactttcccccaaccaaaatccagagaaggattcagctctagccttatttgccaaataatggctgataatattcttacttcggcatattttattaacagagataaccctctccccaaccaagagcaactttgctcattcgatatcctattttttttttaaatgtgacaaaaccaggatatacacatatttgggactgagggagtatatatgtcatagaactcaaaaaggaaaaaaaaatacatatatcgatacatcgagtttataaagtgtgttattttttcatgacaagtttgcaaacactggtactagttgtattaattaattaatcaaatttgcattatcttacaacggggattgagtcgatcgaaggcagttacgtaacgaaatgttgaaaacagtgtgtggcgtatacgtacggcgcctacaagtgtacactagctagaagggcacagtgtcctagatcctctcttctcccaacttaaacagatcttgcagtatctttgcaagatattgatgaggacgataagagcaagtttaatagtatagccatctactaactccaattcatctatagccagtctaatagctcattcgtataataggtacatactacactattaatatctgatcccacctgttatacacacactgcgtcttggagttcgtgctacagctggctacaaatctatagcccgatgctcttctctctccttatttatcttcttaaaatcctgctattgtacctgctctaagcatgcatggcgatgaatcggagaccaggaatgcaagcaagctagctagacttcgatcagctcaattatattggccgtacatatatgcagacatcatcgtcgatatggtggttacattaatttgtgctgttctgcagtttgatcaagacttggttgaccccgttttaaatgtgaaattttgtacgtctgtgccgaatttttttagataatttgcgcctcaatgtacacttgcttcacaaattcgagttagtctctgtactttggtggccaaatccagggaatagtggctgactaataagtgtctcttcttgagttctttcctagcatatactccagatgacttaattaggtttagctcatgtttttttaacttttagtctatgttgcgatgcgcttcaaatctttttttatacacatctaatcagtggcggagccaagataaaattatagtgagggcttctcagccttttaggccttctaataatctcagacaaaatctattttagccctcttccaatagatatatggatttaaattttaggggggtgttaatagaggctctaatgattcattagggggtaggggg

SEQ ID NO: 36007 - DNA, 5594 bp, Oryza sativa
  unsure (1)..(5594): unsure at all n locations
agcccccacgctgcctccgccactgcatctaatgcatatgttttataccaaactttcaataaaaaaagaaataaagttttttttcttcaaaatcctctggaatacttgtcttgaaatcttgggcgcactccaggaaaaaagatggagtaggaccaaatcagttctttttactcaaaacttaatttatggctatttgattgtctcgagatttgggcatacgagagcttgcttcgctagccagctggtatacaaaatacatataagttgcattctaattactatagttacatgtgaaagctttaaaaaactaacggatattgtatagctactctatttgtaagttaaagtgccttggaggtaaaggttgttcaaaacttaaaaaatatgctccctttgttcttagcttttcttttttaaaaaagtcaaagaaaatgatttgtgtttccagcctctatcgttaggcaatcaatttagttcggactttaatttaaaatatttaaaagatacgaggttatgtgacaagggaaagcatcctatatgcacataagctttctcatgtatatatcgtgcacatcaactaataaatatcataaaatattcttaaaaaatatacatatactttcaatagtactacatatgcgtatagtgtcacatcttcaaattcattatacacagagagagaaagaattctgacatatttatagtcttaaaactgtcaaaattccttttttaggctggaatataatgaacttaaggttaaaactttacacatagatgtaatactattgaaagtatatacatattttttttaatttattgtgatatttgttagttgctatgcaatatgcataagaagcttgtgtacacataatacatatacttccatgtgacaaaccccatctcccttcaaagaaatgagttgaactaataaaaagacatcacataaatttctataacagaagtttataggaactagctacgtacaccacctaaagtaggacgaaagactcttgatcatagatttattgcaccactgcataaagtatcctgcaaccctgtaataacaccatagatccagagtgaaaccaggtagaagaaatggatataacatttattgttggatagatcattttaggatgcatgcaaagtcgctaatatactgaatttttttgagagatttgaaaacaatgttagtagatttgtcaaaaaaaaatctttgatttacttgtacttttatttttttttatgaatatatgaataggaaaacaatgaaccaatgatcaatcattctcgctggaaaccttatatatgttctgaacaagtaaaaaattaatgcagagtatgtaagatagggagaaactattgaagcaattacttttctctgcagagtatgtaaaaatgatttttggcatctaccattcagatccacatgcaagcctgtgacttgtaaattaaaacgactgaggcgttttaaacttaacttcgcttgatttttcaactatacttaattgaggacctccattgttgtgacacgtgtataattacacgtagccgtccaatgtcgtcatttgggagattcgctgaggtatcgaagtctcttgactggctccaaagatacgccttcatctgtatctcccatgatgacgaactactaagagataattaagctaggctaatcagtgcctactaaatttaattgacgtcctggacagttactaggatttttcttgctgatatatatatgaccacgttaacttggtcagttatatcacacttcaacagtaaaaattttcaaaagaaaatgtcgctcctcgatcgtacgtacgtataaattttgactttttaaccagtttgtaacaaattccataaaaattccaccaacatcctcatcttatgtgttctatcaatttttattgttaaaatttatgtgtatttgtaaggatgagtatgcccatatgcgtatgtttatatgaatatctacgtttatactatattttaagaaaaatatcccccacagtaaattgatttttgcgaggcctcaacgagtagactaagagcaggtataatagcaggctataaaccagctataaacataatttaaagagataaaataggagagataagagcagcgggctacatatttgtagccagcagcagcacagactctaagacgtatgtgtgtataacaggtgggatcaaatattgattgtgttgtatatgtttatacgtaactattgtatgaattagctattaagttgattatagatgatttggagccagcagttagctatactattaaacttgctctaagtgttagagattaatcaagcagatatgatgttaatgaactgatgcatgcaaagccagaccgatcgatatcatatcgaaggtcatgatcatcaatatatgatccgaggattaaacacaaaactcaagatctcattaggtacaaggatcattagtgacaccgatcgatgaaccatcagaagaagccttctagcttgtttgacacggccaattttaacttctccagatctacgaagataatcgaagatctaatcgtgtaccgttgacgatctctcatgctgggactgtctgacatactattatataacgaactcgattatcatctggattaatacgcgagatttcagatcagaccgaatcgctcatgatgacgatgaggaaatattttgcttgacatgaatggcacgagtttcttctgtgtttttatgacagctggttcagaaatattgacttaagttgggatcgtaggaagaagtaggcacaacgtttttctggttggatggcactgccagtcacagctgcggccacattgtactaatcaatgtactggtcctatgctttgcatcaatgtagtccatttgtcatgcacatgtaaaaacaaaaataatatttttccccacaaataataataataattttgattgcaaatagtactacgtcatattcacagttaaatttgacattgcatattaatttatgaaatatatatcatgtattgatctatatgtcaatttttgttttagattgttttagctttttttacccatgtaaaaataagaagatatccctcgagggatgaatagattttccgcctgcatgactacattgcattttcatggaaagggtggtgattgtcaatgtcatggcaacttgggagatatcttccattgatcgtaaagttgacaattgttagcaagcaaatttagcttctttcaatgaactggtaccctcatgtatatgtatatatacctgtttggctgccttttcttctagattacaacacttttgccggccattgcctgcacaacaaggtcaaaggagaaagatgtatcaaatatttgcaagttcgtagggtatggggaattttttaaaattttgaatgtttctaaataaattaatgattactcctacttactaacttcctgctatttctgaacgttggcacgccagtgtgagtgacaatcacgacaataatgccgcggctatgatggtttggccacaaaactgtgggcagctcccaccatggcgaggcaacatggtgtgtatttcaaagtaatttcgaagtaagtttcgtgtgtgtgttttctttaaaaagcttaaaaaaattcctaagctatgtatgcacatgtatagctagttgatgccacttactctcttctcttctggcgatacatatttaggcccactttgattcaaaggaaatttataggaattttaaaggatttcattcctataggaatttttcctatatatccctttgaatcaaaggaatgaatcctatgggatcctatgaaattcctatggaatgcctcttcccatgcaaattttggaggaaatttaacatgagtttctacctcattttaagaatcctttgagtctttctctctcctcaaattcctgtgttttttctacggctcaatcaaacggtcattcctatgtttttcctgtgttttgcaatcctctgttttacacttgtattcctattaaaattctatatttttcttattcctccgttttttcattcatgtgattcaaaggggccctagcttgtttgttttggaggaaaaacaaaggatctagattcctaaggattaattcctatatgtgtcattcggtttatatgattgaagtataggagaaccaatagaaaatctcggttcctacaaattgtatagcgaaaacataggaatttttccatccactgaaacctgttggaaaaattcttatagattgatgtgtgcacatattcctatttcttcacgttttctattcctatggaatagaattcctctaaaccgaataaatccttacccctttgaatagcaggattgaaaaaaaacggagtaataaaaaaaacacatgattctgataggactgcaagtgtaaaacagaggantgcnnnacacaggaaaaacacatgaatggccgtttgattggaccgcaggaaaaacataggaatcagatgagagagataaactcaaaaaaaatttaccaagaggttagagtggatgttaaatttcctacgtttttcctctagaatcataggaataggaaagtttcctacatttttccttttctcatccctacgaatcaaaggcataaatagtgtagattttcaattcctttgtttttcctttatttttcctccaattcaaaggaggcttattaacatttaggatgagacttaatcaaaattcttggtcaaaagaaacagatttgatcaaaattttgaactttgattatcaatatatataactactcaaatgcttagtttaaaaataaaagaaatggtacgtgttgcctcggaaagcattgttatcatatcataaacttattagattttataaactaatataaaattgatgatagaaaatttaaaagctttaacccaataatatcctaaacgtgaaatatttatgaccagaaggagtaatagggaactcttttttcatcaaatagtgggggacatgtgttttactcctccctcggttataactataaatatttctagaattcaaattttgtatcacaatacaagcatttgtgtgtggattcccatgattctcattacttcaatgattcgaaaatcaatccaagtatgaagtatctaagcaattcaaaattcaaaaattggcaaatgaagtaactaaaaaggaatcatttgatctaacctctgctaaataatttagaaatccttatattttggaacggatggagtactagaaaagcattagcatttcttgtagacgatgcatctagcatcttattttcaaattcgcattcatttcattcatccgttgatgtctttctctattatgttttttttataaataaaaaatataatagagaaaaggatctgagctgagcccaacaaaataaaagaatcagagctgagccccaaaaaaatagaagattcagaggattaaaattattaagaagttcgcaatcttcacatctctatatgtgcgactatcagttcatatactactactaataagtgaactcatcacttgccaaaaagaaaatgtcaactcgtcaggtgtagtgacatatatatgcagggacta

SEQ ID NO: 36008 - DNA, 5640 bp, Oryza sativa
cagctgatggagcatgtgcagttctccaccgtgattaattggctcaacacagaaaaaataactgcatactgtattaacataagggcgttggaagatcatatttttccaaggaacacaatttagttaagtttcagtttataaggcattgaccgtaaccgttccaacttccatttcttgaggaaatgacttcttcaaataataactcaggggagatgtaccacatctataagttacttgtccacaatttatccccatattttatcacgtcttccaatattcaagagaaaaatatttgattacttgttccttgagttttccataacatgtttttttatgttactcagagatcagaaaaatgtaccatttatgctattggttagaactcattaggatgtagtcagttaaaatatgtcataattttgaattcaatcaatcattgagaagaagaaaattagtccaataaatcatatcccaaagtcttgctgagtgctgacacaccataaacaaacttataacgatataaaaagaaagaagtatctattccttgcttttttttatttatctatatttccaattaagatgaataacatgtatagcagcactaggaaattcgtagtcaaccagtgaaacgtctgataaacaatatgcctgtattatactttgttaatctccagcagtttgactacatttgagattatactatgaatgaatagtaaataatttccttacatatataactatatgatccttttcttcatcatgttggcaaataaatgctaatctttgtacagaggatatcattttcttgtaccaatcagattatttatcccagtctaaatgaagggaaatagggcttgaaagtgtcagatgggcagaactcttggttatgcatctcttgcagagaccaagagccggtccttccattatctagatagatgtgcataagcgataagtctagtgtattgactagaaaattagcgtgccacattatagcccgtgtgtacttgctaagtagttttcaaaattcatgtctataaaaggttggtaaatgaaatattcaatggtgttattaaccgatgcaacaagttaagctaaattagcttccatggcacttatgctaaaaaaaagtaactattaccctttaagaacaaaaaaagtaactattaccctttaagaacaatcatcaaaaactggataaaaccatagataaatatatatttacatgaattcactaagaaaaaaagcctgatactaccatagttgtatacagtctttttttttaaagaatacagtcgtttccggtctagcttctagctacggcacaaagaagaaacacaacaatgtagttacacaaaaaaatttcagaaccatagtctttcacatattttaaatccggaggtcatgatttcgagcaccttgtaggcggcaacaatttatatctttggtatcttgcatatccctagaaatataaggaggtgaacacaaattagttggacctatactgactatagaaggagatcaagagcaagagacaaggttaagccagattgttctggtgggctagtggcacagcagcaaaagctatcagagacatggcagtaaaactatgactatttttagattgaaacagcagttccagatctaaaggaaaactattgtttgtcaattgttagttcttattatgggtgcattcaaatgataatggaacaacctgttgataggcccatcaaagtgataacatccacccaacagaacaaaaaggatgggggagagggatacagagaaaaaaaaaatctctttaggaaatattttatctttatatatttgtcagataatcgcaaaattccatgttcagataacactatattttttccatatatagagaatgtggatagaaatataacaagctcatgatgtattaacttaagaatgtgggcatcatgaacaggtgcaatcgatcgcaacttcaaaatttctgaagtaatactcaggacaatcccttgaatagaacaattgcaagttgcaatgagcgcactaaccaattatgatgcaaatgtcagtaaattgcgccacttttatagatcattttcttttgtcaggaggagaagtactctcgaaataaactactgagcaggattgagaccaaagaaaaaactatgtatcaatgcagaattattttcatgattataaatgttattagaaagggtattcagaagaaaaaatcaaacttgagttttgtcaagaaccattcctgattatgttcttctagcgcattaatatttcttttccagattatgctaactgtatatatactaatagctctaactcatgtataattcgattgctgctacgatggaatcagtaatacataacttaactcattagtaatccatataagagtttcataacttagcatcaaattctgcaatttctagttgtgtgtttctcctggatttctgcagaagtagtatagtagcaatagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaacaaacattacactgtagcttgctcaccactgccggccatggcgacgaccgataagcgcgctctgctggccgccgagaacggccatggcggcggcggtccagtcaccgtgtcgttcaacaccaatgccatcgtcctgctcgccctcctcgtctgcggcctcggcgcggtcgcgctccacgtcgtcctccagtgcgcgctccgcgtcacgccgtaggctgggatccctgtcgttggctcgccggcgccgttaccgggagcgggaggcgtcgagatgagatcgattggaaggggaagaggcatgaggtcgatcgacccttcaggagaggacgagaagctaacctttttgcattttactccttcgctagatcatattttacattttagcccttcgcgggaagagcgtatgcacgaaccacgcagcgccacgtggcctcgctaatcgcacgctaatctgcatagatttcgatatatagagatagagatggcttgtccgctattgattagcaaatatcatatgtatttcccatagaattgcacttaatactattatattatcactttcagtactaggattattttatataacacacatgaaatacatttccttgtcttactaaactaacagagaagaggacattgtagttctaaaaaaaaaaagaggacattgtacctgaaaatgggcctccatacactgtacatgaaaatgggccaccaaaattctgctcggcttgctacctcactatcttctggaatgacctgtagcactcaaaagaaaacggataaaaaggatatacattagcaacacagcattcagcaatgcggattcttgatatttcagtttgattcaaacagcaagcaaacacactacagctaaaacagatatgacaaacaaaagaaacattacagattagcagaactacatgcttttcagcatcttaagcctccaagcagaaaagggtactacaatggtgtggatataagatattgtgagcaaattcagaagtcaggaattatattatggaaccaatacaagattaccaaccctgatcaacagaagttaacagaccaacccactacatccaaatcatactaacagcaaaacaactttatacaagaaaaaccttcagatcatttttctccagataatgtgagaaattatagtagtagtagtatagcatcccaacaggctaccgggtgtcaatactgtctgactaaaatgcaggcaacatttacgcaccaaaactgaaaaccattttctccaaaggatggaggatgtattatcaaaggtatatgcatacaacatttttcattatcgatatcaaagaacataatatggtgatacaactcagaagctgctacaaaagtacatgctcaggaccttatgcaacattctatggtattggggaagtaatatataatctataagatttgacccagcaggccttttccatgctttctcaaactgcatgaattgggctgttgtttctcttatttaggtcaggtccagccattggtgggttcacatgaaaagctgattgtcttgtatttgtcggtccagtaagctgaagggaaagagcagagggttctatggagttagagctgccgtcacctatggtaagcttggacatgccaacaacctcatcagccttattgatcacctcctttccattcactggagtgggctttaggatttcatgatttgtgcctgattcacccacattagcaacatttggaggccaaagagttagtggaacaggtattaatgccgggtagaatgttggcattgtcagaacaaatttagtcttgaaaggtgcagcatggttcatctccaagtctagtgctgctagtgaaggttctgtgaactcagattcctcatgcttccttagctgcaaatccgacaggtgtctagcaaactcaggttccttctgtttcacaagatgtgatattggcaattgatttgagcttgtggcttcgtcttgagtactatggagcataagctgttctacgaccactggggattcgtccatgggctgcaggttgaagatgaaattcgaacataagatggtcgtgatatagaaatatcaggacacaatttaacatatatggagataatagacacctcctgtctcaagcgaaaattgcaagcaaaaattgcataccatttctgggaccatgtcaaacaagcttgacctcctcttccttcttgatgagtttgtctgtctaatgaagtacttttgagcatggctagccacctgagttggtgtcctggaaacaacaaaattacgagagatcccacgccagtctcctttaccaagcttctgcagacccattagaaacattctatgctcttcttcagtccaaggtgtacctgaagcacaacatcagcccttgagttgaaactggactgaaaaatcccagatggtttctgtgaaaaaataatccacgaccccatttttttagaggaaagatcattatattgatagtgacctggctttttcagagagccaacagtagttcaacaaagaggtaaaaccaactcacacaccgagggttacacccactggatcattccagctacggagtacatgacaagctcagccaaaaaacacactggaactgcagggaccagcactgtagcatactccctctaacaccagaatactccccattcactagcatgtattcattacaacaaagacaaagcatcaatcactacttttgagcttgactacaatctcaagctttgggtttcttactttgtttatatataataaccatcaaccttgatgcatctcaatctagtgagtttaatattagatcagtaatgctattctctgtagaataatatgcatgagtctataattgattcatctgattccatctcacaaacaatggacactccagaaccacaataatagctttgtaaagaagaaagggtagataagtttgccttctattcagtactactccctccgtttcaaaatgtttgacaccgtt

SEQ ID NO: 36009 - DNA, 7742 bp, Oryza sativa
aagtcaacggcgtcaaacatttagaaacggagggagtaacatagttgaattctgggtatgcataatctagaatctctgttcaccaagatcaaccgctcaagcagcaggtttttccagcacaagaaaaatatgaaaggggaaaggaaaataactttgcctctcatcattaatacgattaagctctgaagctgcccaacttggatgtacatgctgcaagtcctccatagaaagtatggatatagactaaataatacagcatagcacttgtggtggacactcacggttcaaaggcctttcaatttttaaccatgtaaaaagaatgtccagaaagcatgacaaataactattggcaaattcattgccataaagttttacagcagaatcagcatgatgctgtcatgtagtagggacaggtgcttttgtttcaactaaagatgttgctcatacaagggaactccattgtgagttcccttttgagatttgttcttaattcttttagatagatggcttcatcccataaccactagcgccagctgattcataataatcaaaacagactcaggctctagcttggtctataagtaaactaggaattgcccctacagtttctttgaagccaagtgccagtaaagtctcttctacatgtaccaaaaaaatagcatatcactaccaaaccaaatacattaagaaagtacatagtgcacacctaggactggtcaaaccaactggaaaccaatgtggctagattccattaggatcaggtgattaaattaaaggtcaaagagacgtggggtccttagcccgggccagtcagtgtccctctcggaatgtgatctatacaggtcttcttgcgatgcacatgtgcacgtaacttaatcagatgggaaaagatatttagctaggttgattagtgtcggccattctggacggttcctatagattgcatcttcagcaatgatagcggccataccttgagtctagcgaacaaaatagggaggcgtgactattaaaacatgtctccgaattcattacaagaagatagcttgatcttctctacaaaattgtcaatcatttgttaatttcttgaatcaaattgggtctttaactctttgatatcaaaaggatacatctttttgtttctgttgatgattttccttatctttaatgttgctatcttggttgcataaaggatccgtgaaagtagaggaacataccacataccgacaaattaaaaggaacagtacattatgcgattcaaccacaaaattttgttttccttgcgcacaagttgcgatacctgaagcaatcgaactagaatattttatttcacaaaaaggaaacccatatttttccttgtcttggcagcaagaaatgaaaatagaaaagattcctaccgctcgctgagccgagcgtgctccatgaggcggtaggtgcatggaacgcgacgcgttaatcagaagcaaacaaacgcaaaacgcagcatttctacttgctcagttgattcaccaagcagaagagtatgaacagcgcgcagctgtacctctcgtcgccgcatttcatttcaccgagcacgcagctagcatggacaggatgcaagctagagtgtatgtttgaacggaattacagaaggaagaagaaagaagaaaaaaggaatctaacctttcttccgctcgccgcggccattcgtcgagcaggaggcgtgcgtggggtcgtcggacgcgtacccggccgcgccctctccccctcctcctcctccccttcccgttcccgccggcgacgaaccccctgacccaccgccactcccgagcgacgacgcgatgcagctcatgctcgcgctcttcttcatcgccacctccggcggcgacgtgagccgcacgccgaacagcctcaccccgcctccgcctccaccgccgccgcgggcggggcaggtccgcgcgttgtggccgttgttgctgcagtgcgagcaccgcctcgtcatcgcacacgcaccgtgacaccacgagatcaccaaaatgcgtcgcctggtcgaccctcgccgccgccgccgccgcgcgcggtgggttttctccttctctatctgtcttcttgttcttttccggggaagatgatatttttggccacttaaaaagagcggcgagttgaagtgaaatgacggaaaaggacatgggctgcggtggtggggggcgggggtattttgggaattggcggcttagctgtggccacgagatggacaggaagcgacgggggcgagcgtttcaccggcgagtgaagcggaggaggcggacacgtggcgcctcccgccgccgcctacgacaaagtacgacgcttaattaaccacagtaaaactgcctacggcccgtactcgtaaacacaactttaactttttatttctataaaaatatttattgtaaagtgatatatatacttttataaaagtatttttttaagataaatctattcatatattttttatatttttaaactcaataatttaagagatattcatgatttatattcctaaaatttgacttaaacattatcttaaacgacttcctttataaatatagagagagtactttctttgtaaaaaaaactaacttctgaaaatgagtctgaaaaattatttatctaaacttattcctaaaatgttattttttttaatgaatggtgcattactctgtcttaaaaaaaatcctacctacgaatctagataatacgttagattcataaataagattagattttttttatggaggggtaggtagctagcttgatcacaattaaaacggtactccctttggttttaaattggagtacaaaatttttaagctttggctagtctctgtttcttaaacactttaattaatattgtacgttttagccccttcatcccaaaactctctccatttcttttttatttggcattgcttagttaaaaaggaatgaagggatatatgcatttttagattcttagcaaacaaagtgttctaatctctacagatagagctagctacttaattcttcatttatagtgagcatgtttcccaaattgctaagcggtgcaattttttaaaactttctatatgaaagttttttaaaaaatataaataagttaatttgtaagtttgtaataattgatacttaattaatcatatcctaatcactcaccttgttttgtgtgcgaagaaaactctgcaaccaaacacaccttcgaacgaagcctaagtttaacagaagatagtttcttttagtcattttagtggtaaaattttgaattctgaatagcttatgttccctttccaagcatctcactggctgaaaatgcataaattccatgcatatattgaaatcaatgtcccagaaaatgctatattatgatataaattttaaatcttaaacatacttatattttgaaacatagggaatatcgtaaatataatcagaaaaagatactatatatacatactaatttattcttatagaacttttacaaacactaatgtgtatatagtgttgcaagtacatctaattaaattctctataactctcatattttatatagtaaaattaaatggttgagattattgtttggaagagttcttttagtttcgtgtagaaaaccatgacgactttcattaatagtagttttgatacgattaatatatagtcaaccgtgacaaatacatattaggatatactagtaacaattgtacaatgattttacatttaattagcatattgacttcttgattttaattaaccgcggctgttacttgctcctgcatcttcttcttcaccaagacaacaacacacctctgaattaattatacagtagattctgccatattcactgcatctcgttgtgtgatgaaggtattgcatgcattgcatggagatctcggaatgaacgatggctagctagctacaactccagcttaattaagccattgacttgatgatagttcatacctaggtatagcagcagcagctttttttttcctctcctttttcccctatttttctcgacgccgtgaacgcacgtctcttatcttgtcgtagataaagaagaaaagaagatccatctatccatccatgctacgaaacagaattagaaacgcgtctctctctctctctctctgacttccttgctagcttctcctaccactatgaactatcctatacgctatagctactatcagatcttctattcatgaaagtcatatgatctttcttttttagtttttagatatatttatgagagtgtgatattttttttatatatatagataataatatgagtgagatttttggatgttttctcttctccatccatctcttccattgcatccatgcatccatgccaactaattatactcactagctgctagctatctagttcctgtctacagaaaagaaaaccttatcttcctctctcagcagcttcgtagcaagctcacaattcattcattttatgcatgccatggaatgttccagaaacgtacgtgaacctcatggaaaattacacgacctgctgtgcagtcaatacgtatgtaatacacgctcgtgctattactttaactcaccgctggaatattattacaggattaagggagcacatcatgttcaacttgcagaaaaaaaactgacttaatcggctccacacaccccaattcttcagataaaacaggtataaattaccgatttatctctctgcgtgtgtactgcaaattcagatatataagtgttagctcaagagcataaacatgttcttgcatacttttgactctgaattatttatttttcttcagataaaaagggggcaagaaactttcggtatctgtctgaaagagctagctagctccaaagtctccaaagtaggtcaggaacctctctgcaactttggagcatctaggatagcaactcacttgctcactccagacgtccatgtcgttttcataatcttctatcttttattttggatctcatgtataatctgaactctgtatgcactacgcaaagtgcctgcatgctgcgtctgtcatttattttatcttatcttctctgcacaggtgttcgttcctagttaaaattgacagtttgcaagctagtagtaaacaaatgctaatcattgagacgcaaaaaggctcagatcgatctcgatcgagcaagtagctagggaatcgagattaattactgttctaaactgcatccgctgtatcattagtgcgctgcagaatctgatttgctgtcaggagcgttcagtttaccggtttcagactttcagtgattctgcttgttatattctggcttagaagagatgctaaatcaaaaggttattatatgtgcagattttgtcttctagttccaagaattgccgaataagtaaacatagtttaattaatgagtgaactgattgatggttaccgaaaagattgggatgctaattcgatcaacagctcgatcccctgtagatacagttgcatcaagccgaatatattacacgaactgttttacaaaagctataacattcagtgatatttgttccattaattgtcaaaaggaacattgatttgtcaaatcaaaaggggggcatcagttcatcactgaagcatgcatgccttcacttaaattagttctcatgtatatattcagttcaggaagcccatatgcatcttttctttatccatgtgcaggccggtttagcaaagcaaacaactaaagctgggtcagctactgggcaagtgtggtcacgtgttctttgccttatcaactaaggcatggactgatcaaacccatgaaatgataaaacgcatgtgcttttgcagttgcagtgcctgttcttttcagcttttcagtaataggaaaaaaaaagatgagatttgaagggagagacgtccctccaaatatttttttaaaaaaattataagcgtattgaggattgaacacaggagttcagagttgaaaccacacatgacacaatcgagtgcatctctagtagtagaaaaaataaaaaaaaatatgaaggaaagagatggagaaagtggcggtgtatgtgtgcgattgctggagatttcggcccaggtttagcccaatgatacaagagcgacccaatttgccaaaattatgaagcccacctagctatatccaggtttacaaaatgcgataaccacggttattattaccgatgaaaatcagcgaaattcgataaaaaattgccaaccatttaaattttgattttacatctttctgggctaaatgcctgtctacagctagaagacctgcttggccagaaaattggccacggcgtcgaggatgacgtaggcacgactgtggtgtcggatcgctgtcatgagctgggaaactgttttaacaaaacagctcgagtggatatatatacccatttattatatgtcatctaaattgttatgaaaaaatagaaaaaatatgaacaagatagatcaatatataatatatcaatgcacaaatatgcaagttaaaattcaacttctacaaattgtaacaaaaataacaaacaaaactcaaattactatatgtatatttgcaattaaatttgttgtttttgttataacttgtagaagttgaatttgaacttgcatatttgtgaagtgatatattacatattgatcaatgtttttgaaaaattttcgtaaccatctagttgacatgcaataaacgggtgaacgtccactcgaactagaatccatctccgtcgtgagctctccctacttgctgtacttgaggctgaaagccgttaggggatgacataggggccccacactatttttttaatttatgtgatgagtggtttgccatgtggactcaacgaaaaccgtctaaaaaacaattgagggagacgtttgaaaaggttttaatagttagtggggtgaggatatccggtttttagagttaaaaggataacagtaagattttggcattctaacctatattgagggactcaggttgaactttttgcaatccgaatcgatttgatagatcgagtccgaattgtagcggattctcaaggcccgcaaccatactagcccactagtccgagttgctagaatttgttgactttcaggcccagtagaatctggagatttcaacacgagctaagcccaaaatattgcggcccaaatctttcagctcgatagactggccccaaatggaaaacgtccactttgactcccttaaaagtaggccgaatctaattcatacccctcaactgaaaaaccaaatgaaaaaccagataagataactcctcgaactattgaaaccagtgcaatttgactcccttagcggttttgaagggtggttttgctgatgtggcgctgatgtggtggtgttgacctggtcttcatctcatgtgacgcctatgtgacaataaaattaaaaaaaatctgagagacccatttgtcattcaaataaaaaactattgtggagcccacctatcttcctttctctctccaacctttcttcctcctccctctctctctctcccttgtctctctcttttctttcctcttccgtggtgacggcggcgggcggcgctacccctgcagagacagcgggaaatggctcccactgtcggggggggggggggggggaaggtggctggcgtttcggggacgtcagtgccgtccgattttccgggcggagagcttcgacgacggcggcagaagcaggtgttcgtccgtggccggatgcccagcgcggccgccgtc

SEQ ID NO: 36010 - DNA, 7530 bp, Oryza sativa
  unsure (1)..(7530): unsure at all n locations
cggtaattcttgtttggttcaaaatcttgggtaatgagtagtagcaagctcgccatcacgaggagacgtccgcgggactccaccaggtagcggacaactcggatactgctcgcctcgccggcaaaacgggtccacctcgacctcgccgtccccggccatcttccccgcacccccgcgcggtccttggcctcctcctgcagccgcacccgtagtcccgccccccgccgccgccacgaagaggaaagaaaagagagagaagagagggaggaggaagaagggttggagagagaaaggatgataggtgggctccacaatatttttttttatttgaatgacaagtggatccctcatatatttttttaattttaatgccacttagacgtcacatgggatgaagagcaggtcagctctaccacattagcgccacgtcagtaaaaccactcttcaaagccgctgagggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaactttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttcttggcccaaacaccctgaccgtccgaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccagaggagcagcaggagcgaagcaggaaggaagcagaggagagggaatccaaggtgagggagggagagcatggagtgctccatctcgaggacgaatctgaattgcatcagcctgggtgacccggacaccaagaaatcggtcgcgctcctcaagcaggtcttcttcccttcttggaattcgcgattttctttaggctgtactactactctggatggatggatggatggattgtcttgacactctggataggatagcagaaagcctggagctttcttcgttgagaattacgatcatcgctaaatttcccatctttgtgttactgctatgctagtttcttatctgtacctgtccagggttgtttttccacctccataaaacgttcttcgattttatttttctaataacaacaaggtactctagcatctaggaatctgcgtgttacaaccgtttcttttttttttttgggtccatgtagcagttcattgggttggtccgtagaagtagatttctggatttcagctatgtgcatcggttcaacaaagaaaacgtgtcctttgttattgtttactctgcttggtttagtagagttatttgcactgatttgtgctaccctttgtcaactgttgctttggcctggatgctaatacctcgtccttagcatgattgcaccttaaattaaggattagtagtactaaagatttgctgaggtgagatgagagtgacatgccatggcctgcctctctgatctactatccaactgccatggaagcaccactgaagactggcttctccgaccttccacccgatcctgggcgatcccggatcgagccagatattgcctggaggcccttctccctatgtttgactcatcctagatgggttcacacttgtcgattccggtcaaagaaaaaagctttttcacggtcccatcacaccaatctacgcaacttgcagtcgtcgagcttggatggaccatgttcggtgctacttgtttggtgtagtcatatcattacctggatttgtactacattcattttcgatcacaattccccactgtgcaaatttgacctcagtttctgttacatatgcccagttttagaagaatatcaaagtacaacgcgttgcgtggaattattctagctgtaccattacattagttatctcatctattagtcagttaatctgtgccatttgtctaaactattaatgttcatcttacctataggaactgaatgagaataagatggcactttgcagtcatatgcataaacttctaacatcatagtattatattcctagttctactaaaactgtccaaggactaccatttgtgccttgagaaacattttacaaggttagaagctgatatagctaagttttctattatcgtcagatgaaaaatatagcaactgaattacatgttctatcagtgctgtaagtgggtcattaggcatgtctttgatgtgaactttcagacttcattgtcactgtgctctgctggttctatgtattttaatagtttttaaccatattttttcctaaacaaatgtttcatccttcttcataggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtaataatatttaactcctgcatgtgttgtttattattaaaattgcatgtcatgatgtactgacatactcttggttttgagattattagcaagctattaaaattggtagcaacagtacctcccaaagaaaagttgataaaaaaaaatgttatgcatagacagctgccttgagtaaacctcatttcattttctacagttatgtagtttttcctgctccaggtttcatactattcatacttgtgcattttcaggtgactacaaggaagggtattatataggtattgagataccagaagatgatccacaagcaaacagaccattctatggtccaaatcagtggccatccgatggtgagttgtctttcttctgttattagaaaaaagaaaagatctcttccaaaactgaatgctaatgaataaaatacacactgtctaagttattccatctatactatgctgttatgaacaacagtgcagtgaacaatatatacatgtcgaacttcaccagctcaactattatactcacttcgttacaaaatataaggtattttgattggatgggacacatcttatatccaaattcgtagtaccaagatatctctcatccaaccaaaataccttatattttgggatgaagtgagtatgttggtgtggcagtaaatccaccgaataagcttagcatccattagaagtactaaccctttgatctacaattcttatactttggtacttgataggaaggaaagttcctcggaattgcatggttttatttacttattttgcaaaattttcccttgcattatttcagaagtattgccaagatggaggaaggtgatggaacagtatcatagcgaggccctgtaagttttggacatgctgaacacacaatcaaattacactttgctatatatggatcagttcaacaattaatattgtcaagtgatcagtgatgatcaattaggtttaaacacttatcaactagccgttctctaaacctgactttgcagcaagttttggtgatgctctttttgtatgatttattactgtaatgatttgatttgcattctaatgaattcaggagggtggcaaaatcaattgcaaggattattgcccttgctctaaacctagaagaggacttctttgataaaccagaaatgcttggcgagcccatagccacattaaggctcctgcattatgaaggtggacaaaaaacaggtcatgcattcttgccgttcagtattttattacacaagaaacataacgaattctgtcgtttgatgttccttttttcatcaggtaaagtatcaaatcctgcagagggagtttttggagcaggtgcccattctgattatggcctaatcactctactggcaaccgatgatgtagttggtctccaagtaaatgcatcttgaatcgacaccttatcaaatgtttcattgattttcgtgacttctaataaaatggtagttttccatctgaattatgcagatatgcaaggacaggaatgctcagcctcaagtatgggaatatgtagctcctgtaaaagggtgagcttgctaatctaatcacttagcaatatttatgccaaattctgatttctgtgttggcagtataaaattgggatgtatcaatcataaggtattctacggcctatgccaactgttagtgaagatccttacatgttttccctctattttccagaggttttattgtcaatcttggcgatatgctcgaacggtggagtaactgtattttcaggttggccaaaccatcccttaaagcatgttctttggagtcattgtttttctttaggagaaccatcttggtgtcattgttttttttactaactgttactgttctttattataatacggctgtctgcatacctgtaggtcaaccttacatcgagtggtcttagatggacgagaacgtcattctgtaagtttcttctcatacataaatcttcatacaagatgagctaactcgttaacggcgctgcaagcctctacaaatcttacaaataaatcgaatggctttaattactccttttccaattcttcaaacagattgcgttctttgtgcaaccaagccacgattgcgtagtcgagtgcctgccaacctgcaaatctgaatcaaatcctccaaagtaaggacacattccctttgatgatcacaattcagcccatgtccataaccattgttcatcttcaccggggcgagaaacataatgtgtgttccattgtccaaccaggttccctccgatcacttgctcggcatacctatcgcagcggtacaaggatacgcatgccgatctgaccgcttacagcagcaacaaggcctagaaggccaagcgccattttgatctcatccaagctctcagctgtacttaagatgtacaacctgcaataataatcccttaggatggattgatggtgttctatactaattaaattaatcccagtgtacctgtaaccccagtctcatagtgatatagtagtatactagtgatagtacattgttcatgaagtgaggagtgagcagtggcatctgtttttgtactaccatatgtgtgggtgagctccagggctcatgcttttcgctgtcgatttcccatctgctttggggcagatatagctttcgagttggatgtgtggataattctggtgtctgcatctgttttttggatggttggtaggttggtccggtccccgtttgtggttgtggccgggatatgcgtcgtgaacgcgtggctgcgtctcacgccaggaactgtgcgaaatgcgtagcgtcacggtgtcatgaggcgtcgagatctgggtaggaatctgccctttcttttggatcaataatttccagttgcacgctattgagcttgtggtgtgtgcgagagtaaacggaaaggatgactacaagtagaattgacacttctatttgggaatttaccgtgtacagtacttgcatgtgacagcgatttcagggtcactaagtagtagaattgacacttctatctgggaattcgatcagtagctgtcgtagttatttcattgatgtacacttctatttgggaattcgatcagtagctgtcgtggttatttcattgatgtgctgcaaatcgtactgatcatgcaaacggctcgttgcttcaaaggataaggatgttcaattttgattagttatatctctctttctgttaggtgccttaataaatgcttctggtggtagcagaaatcaaacaggtcagggaagggcttttgctgttggggaaaataggagatttgcggcccattacaatggggactaaaactatgtgcttattgcactcattataatcgatctaaagaatgacaaacactggtggtacacatggagattgcttccataatgttacaactgatgatttatatagacagataaaatgccttgcagcagcagcaacggcgacaatggcaacacaacatagcagtatctctactgcattggagacgagcgaacggagaaggctgcgccgtcgttgagaggcagcaagctataataggcgccatctttgtcgatgcagcacgcatgccacttcatcttgtatgaaccctgaggaaattcagacacatccagcaggcagctagagaatcccaccccactgtcactcgcttcgaaacgcgcaaatgctgtcaccatatccttctgctcaacatggaccttcttcctccttttcttctccctcttctttcccaaatcatcctgtacgaacttcataagcttgagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36011 - DNA, 305 bp, Oryza sativa
gattataggagatatttttttctgctgagtttggattcaacaagcgaaggattattatatcacctgggagcacatctcctttgccttctcaattactctggcggcaccgcgcttcagatccaattctaaagtcggcaacagctccgtcgtacctatatttattacaagtcctcacgtgagtacgatccccgattctataatcaatacattcataatgtctaagagcgtacatccaaggttacctagaccggcaatgccgatgacggcggatgcggggggcttagaggtgagcaagacgaggtggt

SEQ ID NO: 36012 - DNA, 611 bp, Oryza sativa
actagcccagtctggtatttttatcttcccatcttcaatagggaccttctcaaccttacgagtatcagtggagcttgatgatgtcttggaagcatcagtaccaccaacatgctccacatcacttccataagtttctatctcaatcatctgggactcctcaattttcagtccagcacccgcatctatatgcaatatgccatctttcaaagaatagtctattggcttgacaattaacccaatccactgaagttcattcataagcaatgcagaggacacagcaggagtaatatcaactaaagcccttggttttctcacctgcagtaattacagaaaacacttgaggcaaagcccaatataatatggttcgttaattacaaaaatgtttattctgttagttgatatccatcttttagttgtgtcttgtgagttaatagtgactaaatttttgtgacactccagttaatgttaatgtcatcaccttcaaaacaggccttgttggcttctcaaagctcatgaattcatcagtgtccactggaccatcttgagaaaatccatgcgatctgaatgatagcttgccaatctggcccgtcagagcacccaacacataggat

SEQ ID NO: 36013 - DNA, 730 bp, Oryza sativa
cttgacctaaaaagaaatctagctaatatctaataccttgttagtttaagcaaagtctaaaattcttgtattgcaaacatccactatatataaagttttgtgtttttcctaattcttcagttttattacatgtgcatttttatgttttcttttcctacatttttatttctctgttttgttttcctcaatctaaacaaggccttatgtttgcttcgtcctctgaataccacccattttctagagtctatgaacctgggcacctgttaaataaataaaaagtaatatgatatgtattaataaaaacgaaatgcatttatgccagtcaccttaaaatcaagaaaaattcagttgatttaaccaccatttgatcctcgtcaagattatggttcagagtaggcagtgcgagaatgggggcaatactgcaagaattaatggccaagctcatgtggtattttttttaaggggtttgcaggttttaaatgattcatggttgcggttgtgtggtagcttgatttgtgggtgacacaagcggcccaggagacactgagacaacggtgatgtagcgcctagcttggccgtaggctcggttggtgttggagcaaggatggcaagcggtcaagaggtcatagtggatctagcaatgtaaacctccggtcagagatgaccagaggaatctaggtaaggttctgtttgggagatttttttttttttggctgcggtagcttctctt

SEQ ID NO: 36014 - DNA, 392 bp, Oryza sativa
tgggcttggctgaagaacagggagattgccagctgttggaatcaaaccatgacttaactcattcatttgtctatgtcttttgtttattttattagtgtgtattatcatagttatgagtatacatttttgatgatttagatcatgatacaaatgagagtttgctgcaggtgagtgatgctctgtttgaagtgctggaaggggatgccaggaatgttctttgtgagtctgttgagaggcatcaggcggagatgttggttgtcggaagccatggctatggagcaattaaacggtattgccatttcctacttttgttcttctgacccctgtttcccacaaagaatttcttcaatttgttgaaaactgctgcctcttcttcatctctgaaaaaaaaa

SEQ ID NO: 36015 - DNA, 654 bp, Oryza sativa
taatttgcgttttgtaacagttgaagatgtgagtgacttgtggctcaatgtgaaagaaagtttcgagcaacgcttaccagtgaagaaggcctgcctcaataacaaggcgaggaatcctgtttttgtggaaaacctaccagctgagtttatacagaccactgattcgaggctacgtagtcgatttccacaagatcaatacttggtttggttccgggaaccatatgcaactgttgttcttgtcagttgcgaggtactttcgtgtcctcatgcatgctgctctttctaattcttctcaagtaataatatcacttctcaaacggaccatgtggatgactttttgcattcatttctctctattgaaatctccaggatcttgatgagttcaagaccattcttaagcctcgcctcaaattgattgtgcaaaatgatgagagggaatggttcattgtatttgtgtctaaggcccatcctagcaatgaccaagcatctaagatggcaaagagagtatatgctatgcttgagagcgatttcaacactaaaaaaagagaaaggtatttgtttgccaattctgcataacagtattggtaatattcatatctttgactttgaaaaatgtaaatgttttggttgattcagttcaacatgctatttgcg

SEQ ID NO: 36016 - DNA, 719 bp, Oryza sativa
aaagatcttcaatattcacaggaaaccactgccattagaaccttctttgcttcttcgtgaggctaataggcgtagggcttttctttctgttggaaatatatctgaattatatgattcaggtgatgggtaaggactgtcgatttcctccattttcatgatgtaatctttcaagtgaaatttttcagcatatctgtgttaatgtattcttattaacacatatctatgttcttttttgtgtgggcagttcaggtctggatgcaaattcaaaaccttcgcccaacaaatctgcttcgaactacatggccaggacaatgtcagggccagcgacatctgagacgtctctgccagttgatcgccccatgaggttgtcagaaattcatgttgcagctgagcatgcactgaagcagacagtatctgaccctaattttatgacatcactttcatcactagaagaatttgaggtattgtaattattcaacatgctcatcatgatggattccttctaaagtaatatgctttttttaactaattactttagagacaatcgtgaacatacagaggtttgcacaagcaatagataattcattgcaacagttttttttttctgttaccagaaaagatatatggagcttactaaaggcgcagctgacaattatcatcactcttggtggaaaagacatggagttgtgctagatggagaaattgcagctctattcttt

SEQ ID NO: 36017 - DNA, 645 bp, Oryza sativa
  unsure (1)..(645): unsure at all n locations
gtacagttcatcaccaccttgaaaggctttatcttcgtatttggaccagcctaaggaggggtggcttaaatgatttaggtttggagaatctccactcccttcggcatgcaaccatttattcaagcagcaaggctgttgttagagaggcacttaaggactatcctaatcaagcagcgctcgaaatacgatggtgatgaactaactcaggtacttagctgatttcttcccctaatcaacaaccttttttttcatgtactagccattatataatgctaggtccaccaagcctcccactcaacgtttaatatgatgtatctttatgaacgttatttttttctatctttgcttggcgtacagtaatgcatgatagcctatgtacgtctttgatgcagctgccgcgttattcattatcttaaaaaaaacccaaaaaactctttatgaactttagcatatcagcatgcaatcaacttcttactcctagttatacattctttttttcccctccccctatatcgntacgtaagagaattgttatattgagatgatttcttttatgccattgcagtcaagtgtcaactatgttacgtaatttgacatctcattggaaataatgcttatattaataaaaacaagatttggagggag

SEQ ID NO: 36018 - DNA, 664 bp, Oryza sativa
tcattctttaggggacttccttttcttattgccacagagtagacgcatatgacctactaccattttcagcacattaggaaaaccgatgaccttcacattgttgattagtgaagaaacttaatgggtcgactattttgcgcgattgagatcgttaccgaagcacgaaacggttttttgtgtcactgcatgtgctctgctcacttcacctgtcttctagtacgtgtgaatttcgaaagcagatgtcacccgaagaagtttgagcttaacatccaactcgattccgttttgctacagtacaacttgcagcgatgcagtagctcttcattagatggatctttcagctttcaggctgcaacctgtttcatccttatgccctgtggatacgaagcaaaccccatgtatgatggagacgtgcattgaagtctcgattttactgcaggtctctgaggtgctataccgctgcgagtgataaattactattgccatgcgactctagcggtagtaccgtaactctagtaacattgtaccgtcgtcagaactcagaatctagtatctggcatcctagctacaactctcataatccaatacagatacagtactttctacaggggaaaaaaacaaaatatcgtatcttttccttaggggagacggaatcgaactctta

SEQ ID NO: 36019 - DNA, 638 bp, Oryza sativa
gactcgacgcgaccgcgactccggcgaactactactcctcctcctcctcctcgctcttcctcgcgaatgctggtcgcggcttgctgctactagcctctccaccacccagtttggtcgatgagagagaagggcccctgccgcggcggcaacatgggggagagggatttgggcgacatcgtgctctcctggtcgctcggtgaggtcatggacgacgacctctacagaggaaaggtgattgatcgatcctcatggctgctaatgattttgcgcgaggcagtgttgctgacctgagcaatttgtttcgttatttttttattaaaaaattcggggtgtgaactgcgagatggatgcatggggttttcggtgtacgatttttttttctaaaaaaacgcaaatattagggagtgacttaacatcaaataattaaataattaaaaggggtgaggcttcgaaatctaggtcgtttaggccaccgccttgtttagctaaccagaagacccctaagcgtttctcgtacaatttgttcttctatgtttacctgggagcaagctgttgtatattgtagatgttttgtgagtcgcttgtagtgtcctgttgcttaatgccttgttctgttatagaagctcactagtcagtag

SEQ ID NO: 36020 - DNA, 4693 bp, Oryza sativa
tcaattttaaaaacaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatctcctcggcatctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatgtaagtaactttgacaaatgcaagaaaacttacgactttgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtttcgatgtacctatcgttccttccggctgttctccattcatcaatgtatctattatgctctagcccccagtctttcaccttctttgttctcaccctgtcatacctagacaagtagaaggtgatgaaatagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacatctgaatcaatagcacacaaccactcatgttggatgatggtgcctgacgacaacaggcctcacagagctgtctatatgtccacactaacactgctgacccccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtatctgtcttgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactgggggggcatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggtcatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgtaccaccggtggtgaaccgatggcaatcctggaacaggagtcatcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgtttaaaagcctcaatggaaggaccaaagcaccagaatgcacgcataaaaatttttttggtcactccatcaacgttgacaaccctatcaggatgagtatcgatatggtagaccatactgggattcctttgcttaatggcttgcagcaaagtgggcaaacggacatacgcttcaccccattcaccgtaaatgagcttcatagcctcctctcgtgcccttccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccaactggaatggttctggcaactgatctaggttgatgccgccatctactagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcg

SEQ ID NO: 36021 - DNA, 404 bp, Oryza sativa
ccgcgctggtcatcgtcgttggtggtggttgcggggacgtcagggtgcgcgaagacgctgaggtagacaacggatgcgagttagctcacgacggtggagaactcatggtcgccgaggggccgctccctatcgctgcagaggagcaggccgcaacatcggcacgccctcggcctcggcggcgggttcttcgtcgacctccttccgtcccatcccaacgcaagccgaggcggcgctgctgtggctgcggacgatgtcaacgtagacctcgacatctttgtgagagagctcgcgaaggtcggtagagctgttgtcacagaggatggcggtggcagcgatagctcccccgacgccatcccacggtggcagctcgctcgccgcccctgaccgctatgcaccagtctcca

SEQ ID NO: 36022 - DNA, 1294 bp, Oryza sativa
ctcaaacactagcgaatggcattgcacgcatgcaaggtctagtactctgaataaaaccaacatggttgatactatgatgatcaccaataattaatgtcacttgaagttagatttgcaatcctttggctaggaagttgattaatttagaggcgagattaattaattagccacacatggttgggagttgtaagtagtgacatatttattgggagaaggagctagctccattttgaggggacaaaggcagtggaatatattgggactagtttgtgtgtcatatcgagtgccccagccctaaaacttggtgggtctagagctactccttgggcacgtggcctggatcaaataatgtgaatcctgatcatatcagcaacgagtaaataaattatgctctttgagatagaggtacaactttgatcaccaatttattataaaatatatttacataccttaatgaatattataaaagtatttttttagaagaatctacttacaattatgttttttcatgtatacattctaaaaatttcaagattttaatgtttgaaggttttagagtttgatttgaaagaaatacagactatactctcccgtcccatgaaaaacgaatctaggaccgtatgtgacatattctagtactatgaatctgaacatatgtatgtctagattcgtagtattaaaatgtgtcacatccggtactaggttatttttttatgggacggagggagtatatgtttccgtgacgagctgagtgagctgtagcaggatgcactactgctcaagatcgatatggatgaaaatttcagtaagataagttggtcctccaagaaaaaaatagagttggtccaccacacatgcatcttagatgtaccctagctagctctacattttggacatgctgcaccatatgcatgccaactcatggagtcgtggtggatcttgttatatatactattaattatcatcaattgatgatatgataagataatcttatgatatatatgcaaattaaagaggagcttctatgaatggtcattgagaggatacagatcattgaaaagctctcaaattcttttttaaaacacgacattccgataattttctgcagggggctttgccttgttttttagacaatcaaatttacagccagtggatttgtagattttgtagaatctgaagagtgactgtgagaaggttgagacttgaaaggcattaattaattaattaattagctgtatgaccaggtggaataaaaaacacactaataatccaacttcacttgagcatttgcaaa

SEQ ID NO: 36023 - DNA, 399 bp, Oryza sativa
ttttttgtatgcgtaagactaagggcctatttagattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacagtaacattccaaataggccctaaaaaataataaaattgtattttaccagtcttggagattttaatcttgtatagttttcaatataaaaagatttgataactattgatatttataaaaaatata
